United States Patent 7,745,391 (HUMAN THROMBOSPONDIN POLYPEPTIDE) - sequence listing, part 152

SEQ ID NO: 394735 - DNA, 776 bp, Homo sapiens
catggtggctcagcctcccaacatgctgggattacaggtgtgagccaccatgcccggctgtgttacactttttgtggtgtctcacaggtctctgaggctctgctcatttttgtttttgttttatttttttgagacagagtctctttctgtcactaggctggagtgcagtggcatgatctcggctcactgcaacccctgcctccccacttcaagtgattctcctgcctcagcctcctgagtagctgggattacaggcgtccaccaccacgcccagctaattttggtatttttaggagagatggggttggtcaagctgttctcgaactcctgaccttagaagatctgcctgcctctgactcccaaagtgctaggattacagatgttagccatcacgcgcgaatccagtgaattttatccaaccaagctctcatttctatatagaagcaatagccaatcatttaaaaatatctcaaataatatggttcctatgatcctttcccaaaaaagttgttagaaacaaaattcagtaagtacagtgacgaatgaagtaatgtgtcagaattattggtagtgatcattgaaattgatattaaaacgagtgtgtttttggctacaaaacaatataatatcacaaatctgaaaataaagaaatgttatactcacaaagactgaaaagagaaaagagaaagaatgttggagatggtgtaatacactgatttcttcaatacacttgttttttggaaaagtgtatccttaaaaactgacaagtataatta

SEQ ID NO: 394736 - DNA, 309 bp, Homo sapiens
gttctgatgggcagtgattttgaagtcttgatgggcttttaggtagactttccagtgactggctaatcattgttatatttgaataccccagaaaaggatgaaagctggtttagagtaaatcacatatagttttcatagatattaatattttttgataatgaatccaaataaggtcttgattatccaaaaacgatggtgagaacattgagatagctagttgaaatgagaatatactttctccctactgagtgaaagccttgttctggtgacagtttttcctattataggttctgatcaaggtggtggtag

SEQ ID NO: 394737 - DNA, 357 bp, Homo sapiens
ccaattatttttgatcactggttatttgaatccacagatgttgagggctcactgtagttaaattatccctagtattaagttacacagtattttgtgggaaacctttaacaaactatgcttgtttctgccagtgattagtaaaaaaaatattgttggccctgtttttcatcatttgtgcactttaaaaaaatagaagcttgaaaatgtgatttctgctagttatattttcgattagaaaattaaccatatgatcttagtggcaataagaatatgaccgtgataaaattgcacagtatattttaatcttactctgttcatatgtttagaagactaaacttgagactaattatatgatca

SEQ ID NO: 394738 - DNA, 275 bp, Homo sapiens
ctttgggattttaacaatgcatgtatggaataaacgaatatcacagctagaaggaaactcaagggctagccagtccaaaccctcaccttagatgagaaagctgaggttcagagacagagtggctcacccatggctgcagagcaagccaatggcttcagatacaaccaggctcatgttgccgcctcctcagtaccggacacacctgtgcctgcactttcaacacaggccaagccactgcatgggctgctcagtggtaagcgctgggcatcattttt

SEQ ID NO: 394739 - DNA, 319 bp, Homo sapiens
cttctaattctaaactcaagactccctgtattacacacaaataatagcagcattatctgatagggctgaaatattttgagactcagatttatggctcttaatctttatactacattcttgatttctgaaaatgtactataaaagtaacacatactcaatattcacataccattcccccaaaataaattttaatcaaagtcaggtacatctttcacacattctcagcatatataaacgaaactttattgttcatacttttaaaaatctattatatcgcatattctgttctacagcttagttttcaaacatttatagtgga

SEQ ID NO: 394740 - DNA, 440 bp, Homo sapiens
gaactgacgtccaaaaagggggaggaaaaaaaaagggaatcaggagggtgatcaaagtgcttaaaatggaacaactgtccataaaatgaacaacctccatgaaataaatttctgtaacattttggtcattttataaatttttttctgggtgggggtgctgaaaccatcaggcttctggctgcaatagtaaattacggaggagagtaaatccctactggttcgtctcttttacagttcacacccagaaattaattttaaaagatccaacccaaccccctatccaaagaatcagactcactcctgccctttgaaccttctgaaggttgaggaggaagacctccgtggccccaggtcaggcgctgcagcctctgaaggggagggcaagagcctctgaatgaccagattaagtgtgaatggaagaagaacctgtgattaagttt

SEQ ID NO: 394741 - DNA, 646 bp, Homo sapiens
accgaaagataacagagaaaagaatggaaagagagagaaggaaagagacacagagttaggacaaatacagggaaacaaggacagatacagcaacacatggcagtgaggtagtagcagatgtaaaggcacacaaagaaagaaaggccagtacaaggaaatatcagcatacagaaatagcccaccaagacatctcccagtcacactcacccacaagggatccccttacctgagctttcttgctcttgctcagtgcctaaagtgggggtgggtgggaagagagctaaagtgtacagagatggactgccttactaggatatggagacaattgtgccaagcgttttgtgggtgtagttgctcataatttaagacaaggttgaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgta

SEQ ID NO: 394742 - DNA, 224 bp, Homo sapiens
tacccactcatacttggagcttatggagttatttatccagaaattccttttacttcttgaaaatttcaaacaaccctctctcttcctccctccctgtaagcatgtttaaatggctatcttgagaactgccactttttgacatgattctgtctccccggctgcaaagagagcccttaccaggtttcccatcagaattcttcctcaggtcttgtctggctgcatct

SEQ ID NO: 394743 - DNA, 602 bp, Homo sapiens
acacgagttgattgctgcagctggtgatgggtatacatagagttcattgtactattctttctacatttgaatatttctgaaattttgcataataaaaagtaaaccaaaaaatcactttgagccaagtactcagttttaaagaggttaatagctaaagtagttgtgaaatactctgggtcagggttgctattaagatactggcattcagccaagtgcagtggctcatgcctgtaatcctagcactgtgggaggccaaggctggtggatcacttgaaaccaggagttcaaaaccagtctggccaacatgggtgagcaaaattatgtttcttaagccttattaccgatgcttgggtcaaattatttaggggctttttagttcctccttctggaatatccttgcccttttactgcctctacccccaatctctaagtgaattatagagcttcactgttgtccaagttggaactatacacaatggtatataaattttagtaacagaataagcatttctatagcttcctatgatttgcaacatattttcttttatattacttctctagagcctcacacagtccccctgggtaaagacaggtattgctat

SEQ ID NO: 394744 - DNA, 371 bp, Homo sapiens
ctataaagtgctttattttgccattagaatatattgctaaaattgcaaagatgtccagaatatgctaaactgccattggtcatgttttgttctgtctgtgtaggaattaagctaatagccattcatttcaagcaaatttctcccatccacacccaactttaaaatcccataggaaataggaactttgttattctcagagatcacatcttgatttcaaaaggtatcttataacctgacccttagaagcccactcatcccttacttaatacagctacatatttatagacagctgaggcccacagtatctgccctcccacctgccagccagcccacaactataaactgtgtgacacccaaatttatctacctca

SEQ ID NO: 394745 - DNA, 244 bp, Homo sapiens
tttcatggccggtgaagaggaggcttggcagtggcacccagtgggaaacagcagggcccctggaggggactataaatagccaggagggctagaacacagagtgagcagagggggagagggccgtgctggagaggaggcagggacttgctcctgagagcctcgtgagctgagccgagagccgtgcaggactcagtgaggatgggtgacctggcccatgatcctctgcaggctcttcaccggccat

SEQ ID NO: 394746 - DNA, 484 bp, Homo sapiens
cccctaatctgtgcatgaaatcaatctcactggtttttctgttctccctcaaaaacatatccggattctattggctcccttccatctctctgcccccatcctcatccaagcctccttatttcttgcctgggctattgcagctgctctccactactaactcatgctaccctgtctccatctgcagccagacaggtatttcttttgcgatgccaacctcactgtggaaccctctgcttatagcctctcctagcgtggcttacagagtccaacatgacctggcccggctgcgccccccacctcctctcattgtgctccagctagtccagggatcctgggactcagctgtgctaagcaggtccctgcctcagggctccaaaaggacactgtcctcttcccggtgcctcatgaactctcctcactcttgctggactcagaccatctgcctctttctcggttgagtcttccctgtcacaccctgacgtcc

SEQ ID NO: 394747 - DNA, 242 bp, Homo sapiens
gtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttct

SEQ ID NO: 394748 - DNA, 480 bp, Homo sapiens
aaggtttgccaactcatttgctcctcataacaaccctatgagatcggtaatattatcctccttttttaaagatgaggagatagaaacagagaggttagttaactttttgaaggtcccacagttagcatatggcaaagctagatttgaacccagacagactagtgcagcatctgtgctcttaagcagtagtttgtcttacagctcctttaggccttcctctagcccaacttacaccataaaagcaactccatttagtctacataaaacacttgccaagtctacagtgccttggagaagaagggagccatgacttcatcaacaaagtaccttttcctagtccctctagatccctgggaactcactggggaagagtccttttctctcagctttggacttcttccactttgacactcctttgagccagtctgtctgaagtggcagcaaagaagaagcagaggaaggcagcaggaagggcagagg

SEQ ID NO: 394749 - DNA, 364 bp, Homo sapiens
cctgggctcaagcagcccacctgctgcagcttcccaaagtgttgtgattacaggtgtgagccaatacccccagcccaatatgcttttttaaatctagaaaattagcaaggaaaacctgatgtttattcttccactagtaagagtgtaaattggaacaaactttttggaaggcaatctaataagattaatcgaaagccttaaaacatctataccttttggtgccagtggttcactttctagggagtctgtcccatgaaatcagagatgtgggaaaatatttcggggtggaaatgtttaactcaggattattatgacaattaaaagttgaaaagaacctaattgtctaccaatagatgagtagcca

SEQ ID NO: 394750 - DNA, 1075 bp, Homo sapiens
catattggccaggctggtcttgaactgctgacctcaggtgatccacctgccttagcctcccaaagtgctgggattacaggtgtgagccaccgcgcccggctttgtttttgtttttgtagagatggggtttcaccatgttgctcaggctagtctcgaactcccgggctcaggcaatcctccctcctcagcttcccaaagtgtttaggattccaggtgcgagttgccacgccctgcaggaaattttctatttaaaggacttctatggtgaatcattccatacagcatattagtatcatttctgtcaatctaggttttgagtcctggctctctctgtgctactatcagatagctgtatgatgttgaacaaatcacttctccgtttcttcagaagaaaatggaaaggggggttttgatgatatctggaatgactgataaggggcatctgaatcatctccaaccctgacattcggctttagtatgtctgaaagcagacctactgccacatttgggaatttccagagcagatgatctctaaggtctctttttaagtctgaaattgtcatttatgacatatttgggcttgctgaaattaagattcatctgtattgggaatcggcttctgttcttccctgccatattccttgtgaattgtgaattcccccacctcaaatacataacatctttatctgaagtcaccagtggtgctctaggaacacagctttgtttactttcaccaaagcatttcccatctgatatggtttggccgtgtctccacccaaatctcaccttgaattgtagctcccgtaattcccacgtattgtgggagggacccggtgggaggtaattgaatcataggggtggtttcccccatactattctcgtggtagtgaataaatctcacaagatctgatggctctataaggggaaaccccttttgctttgttttcattctgtctcttgcctgctgccatgtaagacgtgccttttgccttccaacatgattgtgaggcctccccagccatgtgtaactgtgagtccattaaacctctttttctttataatttactcagtctcg

SEQ ID NO: 394751 - DNA, 318 bp, Homo sapiens
cagagcaaagagaaagttcaatgatttcgagattaaccacatttgctttttaaaacaaatacgtattttgaaatttaatactaaatttataggagagtgatgcctcaactgtttaaatgttgtagaatttgttttttttaagtgttgtttcaaaggaaaaataattgcaaatattaaattgtgtcaattacctaaatcattcataaaggagtccatcgttgaggtggtctgtatgtaccagcttcagggcattaacttatatccacactgcagattttttgtgtgcatgtgaatttttttaggagttacttatggttt

SEQ ID NO: 394752 - DNA, 181 bp, Homo sapiens
aataagaattagtgctgttcattaaacctggggagctgataaacaggtttattcatttcattctgttcagttgtgctcacgtatttaccaaccattttgaaagcttaaggtagctgagtttgaagataatctttttgatgttactatatattggtatgcaagctgtggaagcagatctcca

SEQ ID NO: 394753 - DNA, 356 bp, Homo sapiens
agtttagaagtagaactgcaacccaggacccaagcagtttccaccaccgccctggaggccactgcctaaagagtatggtcaaagcatggccactttggtctacaacattcaagattcatgcaccggtcttccaactggaccagagattaattttcattagttaatttcattcttgcctagatattctgttgcttctcttactgttagtacacaactaggtcaaccagtatcccagaaggactgaggtggtgagaggcaaagtgcaaagtgaggtggacagcaacaggagcagtcattagagtatgtgtaaaaagcagaagttgcagaggctgggtcagcagattcatgtcatgagt

SEQ ID NO: 394754 - DNA, 442 bp, Homo sapiens
atagattagttgatagataatatagatggatggatagatagatatagctatatagagaaaaacagaggcacagatagatatagagagggatagatagagatagagagaggaatgggtagatatatatacagagaaatatacagggatggatagatggatggatgatgcatacataagattgatggataagatgactgacagataatagagacggatgcatggaaaaatagattggttgatagataatatatagatagagatagataaatggatagatggattagataaatagatgatatagatacctaatatagatggatacatagataagacagataatataggtgtatctatcaatggatagaggatgcattgataagatggctgggccgggcgcggtggctcacgccggtaatcccagcactttgggaggccaaggcgg

SEQ ID NO: 394755 - DNA, 370 bp, Homo sapiens
ggttgaggctgcagtgagtcatgatgacactactgcactctagcctgggtgacagagcgcggccttatataaaaaaaaaaaagccaaagaaatagttgtatggtgacaaggactctaatttctcaaacagagcatctgaaactacaaaaagtgtcaacattccctgagaagcaaaggaaagaaagtttgaagaacaaatttactttctctccccaaaccatgaacttgagagcaggaagaacttgagagctatgccagaacccagttcagtacccagatattgtaaaggtccgataaatatcggccaaatttgttaaaaattcattgaagaacaggccaggcacagtagttcacgcctgtaatcccagca

SEQ ID NO: 394756 - DNA, 295 bp, Homo sapiens
ggccctggtcttttgagaaccactgatctattccaacatcctacccaatatggtggctccctctacaggataccacatgggctacctggtccacgtgacaacattcacagagaccagtgctctcacccttttgtaagtcttgttccatttttagatggcttagttactagaaactgtattcctacattgagccaaatagtcaaagttctttggctccttggacttcacttacttagaccctaattttgtgctccagaactgacaaagaattccccctcctacaacagtctgtaaa

SEQ ID NO: 394757 - DNA, 188 bp, Homo sapiens
tatgccaggtgctagactgggtgctggtgcctagaccaggggtgggcaaactgtggcctctcatactgatttgataaaagctggtcttccccaagctgtgtcctgacttcccatgtttctcacctccctcggacacctcaccttcacctgtataatgtgacctccaagcccatgcctccaacccatga

SEQ ID NO: 394758 - DNA, 269 bp, Homo sapiens
agctggttcttccgtggtatagagtgaatctttcagtaggaagtgtttctaacaagttcccatgctgctgaagccaacacaaggcaagaagctttgaaatggctgatgtttaaattatgactccaatacatacatacatacacacacacacacacacctatatatatatatttagtagacttttttagagcagttttaagttcacagaaaaattgagtacaagctatagagatttcccatacactccctgcttccacacatgcacagcc

SEQ ID NO: 394759 - DNA, 483 bp, Homo sapiens
aacgtgatcacctgcactaggactggatgactgtgggcttttagtgtgaacacccacactaggactggacaactgtgggcttttagtgtgaacacccacactaggactggacgactgtgggctgttagtgtgaacacccacactaggactggccgactgtgggctgttagcgtgaacacccacactaggtctggatgactgtgggctgttacaccaacactaggattggaagactgtgggctgatagtgtgaacaccagcactaagactggacaactgtgggctgttaatgtgaacaccagtactaggactggatgactgtgggctgttagcgtgatcaccagcaccaggactggatgactgtgggctgttagcatgatcaccggcactaggagtggagggctgtgggctgttagcatgatcaccggcactaggactggaggactgtgggctgttagcatgatcaccggcactaggactggag

SEQ ID NO: 394760 - DNA, 112 bp, Homo sapiens
ggaggacctatagattgttgtgtcatgaaagccacaaaatggagaggttaaaggaggaaccacggaaggggtgtgatttttaactgtggtaaacacagcagaaagtttggta

SEQ ID NO: 394761 - DNA, 244 bp, Homo sapiens
ttagaaaatacttaattcatacagataaactttaccatttaaatggcctctggtgattcctttataagaatgaaccattagatagttaaccagtttactaatgacagacatttatattgctcccaagttgttgccattgttcatttatttatttctttagtattaattcctagataagttgctacatcaaaaataatgtacatttaatattgcaatagttacaaggaaatctgtacttttttca

SEQ ID NO: 394762 - DNA, 352 bp, Homo sapiens
tcttgacattcccatttctcttctttcatcgttaagttttctaaggggctccctacagtatactccataccatggcacttagccttttcccagctagaccatgacaactattatgtctctttttttttctcagcatatagcccaacatataacaaaaattaagtgctggatgttaccactgtacaaagggtacctctaagggagaaggacaggtaagtcaatgcaaggagttattaggatattcattacaaggaatcatgacagctgagactggtgaaatatagctgatatccctaaaagagtcataactctgcaagctaagagttaattacacaagaacgacaagccatac

SEQ ID NO: 394763 - DNA, 285 bp, Homo sapiens
cagcaacattgggagcatggtggccccggcactagggtaggaggtccaagaagttatctgcaaaacaaggagcacttctggagggccctaggcacctgcttagatatggggatgagcaagtgagtgagtgagcctggtgcccagaggcctggcaggtcagagatgaggtggctgagggccctgagggaagagaggggctgtgtgacagggtttgacggggcagaggtaccacctctgaaacccttcctgccagattgcgaaagaagcatgggggctgtaagaagg

SEQ ID NO: 394764 - DNA, 329 bp, Homo sapiens
gtgctgggattacaggcatgagccactgtgcctggcctaaactatacaaaattttaaatctatcccatgtcattgaacatttttctcaccctgttgcccaagctggagtgcagagatgtgatcacagctcactgcagcctctaccttttgaactcaagggctcctctggccttagcctcccaagtagctgggtctgcaggcatgtgctaccatgcctggctaattttgttgttgttgttggtagagatgggttctccctgtgttgaccaggctggtcataaacccctgtcctcaagcagtcctcaatcctcctaccttggcctcctcaa

SEQ ID NO: 394765 - DNA, 361 bp, Homo sapiens
gaggcgtgtatcgattggttggcgccgcgggcgcaggtgcgcgctttctattgggtgtgggcggaacgcgagggattgcggcatcttcgggggctgcaggtgagcgcgcgcacgcgccgcggctgtggtccgctcgggtgcgcgcgcgcgggctcgcgggggaggcggcagagggagaggttgcggcgcttgtggcctccgctccgccccctcctctcctccagcgctgtcgccgtcgccgccggggcccggagggagggagctgcttccccgcctgccgcgccaccagtccgaccctcggtcccgccgtgtgagcagctggtggagtggagctcagcgcggacgccggagctgcggccgc

SEQ ID NO: 394766 - DNA, 422 bp, Homo sapiens
acaactattataacaactcacttccttcgaagacaaagataattattctcgttttctctccatactatttttccctttcatcctctggtctccgaattcagtcaattctcttatcacgcacagaatgactgtttcctggtctcaaaaggtatatgaaaaaatagagatatatccatacaatggaatactcttcagcaataaaaagaagtgaactactgacactcaaaataactatacttttttttaagggggtaaaaataaatatactgaatggaagaaagtcaaacaaaaatagcttattctgtatggttccatttaaataaaattctagaaaatagcgaggcatggtggcacatgcctgtagtcccagctactgaagaggctgaggcaggaggattgcttaagccaagttctatattaca

SEQ ID NO: 394767 - DNA, 312 bp, Homo sapiens
aggctccggccacatgccagcagacaggggaaagatgtaatgtcacccgagatagtaaaaacaaatataaacctcgggggatatccacaagggagcctgtgcctttgctgctgcagaaatgcagagagccatgggcgcatgaataatattatggatgtttagaaaactatgtctatagcaaagtgaaagcccttcaggggccataggtctggcattacatatagaggcaactcccttttctccaatggttccgaggtctcttaacataagtaattggaggatgtgaaaaatgtacatatgaatttccattag

SEQ ID NO: 394768 - DNA, 272 bp, Homo sapiens
gagtgagctgctgttgaatgtaaaacagctgtgccatgtgcagatgatttcatcctatgagcttcctcactcactgtcagaggccaggctttataaagtattgtcaattgcttttactgttttacttattttttgtttttttgcattaggtacccactaaagtcacctgtcaaactacatcttgaagccaattgcagtcttgaaatcctgctttgtggtgcaggttctactgcatagaatgttatatgagttagctcctgctgctgatcaaa

SEQ ID NO: 394769 - DNA, 345 bp, Homo sapiens
gaacacttctacgtaacaggccctaagaacccaggccctcaacaggacacacgtgtgaatgcttggtcacaacgactgaccagaagaatcaattttccttcccaatcatcctttggcctgggtttggatatgacatacttctctaggctggggctaacaaggctgtgtgatgagtggacaaaatacacgtcacataaccatagtaagaaggtgaagactggagccttaaaaatcagccggcccaactgccagaagaccattatatttacggataaagaaagagaaacaaagtatttgtaactgtgagcgggactaagtgcctgtaacagtttttttctccctctt

SEQ ID NO: 394770 - DNA, 325 bp, Homo sapiens
gcagctcggacccgctcacggtagatttggagtgtgcgtgtgtgtgtgcgcgtgtgtatgtccttgaaaacaagatgatcaataacagcttatgctgaggaagtggaaaggttgatttggtcatttgtgaccaagtcacaacatgagaaccagaaactcagaatgtgtgcactaggatggatgttagaattcctccaatcccgatttatagttgaaaggggtcacttggggacgacgggcttagtttttggttaattggcctttttgatatcccctctagtacatgtgtaatgtagaatggggacgtttggtcactaactggctt

SEQ ID NO: 394771 - DNA, 345 bp, Homo sapiens
cagttcaatgtactttaaatcgcattttgatgagcttttctaatatctcactcattgtttatagagtgcagacagtaacattgactttttaacatctcatcctcatggagacagtgtagagtagtggtttgaatgcctaaactggaatgtcaatgttaccacagaggtcggtccctggaaacaatgacttaacctaaggtctttgtttcttcatttgaaaacaggcagaatacctatatgaagcgcttattgtgaggatttcacaaaataatacttagcatagtgcctagtagaggaggtaaataattaacgttaatttctttcacaaagtttatgttatggact

SEQ ID NO: 394772 - DNA, 653 bp, Homo sapiens
tctctacagtgatacctatgattaggaaactagagtatacatatttcaaaacatcatgttgtacatgataaatatatatttttttgtcacttaaaacataaaaataaataaaaaggaagctagggtatcagagttggaagggccttttgtgatcagtgtgtttacagtgcttgaatatacccagtggcatttctgacaagttgatttgtagcctggtcttgattcctttctgaaactcacaacctcctaaagtcgtccacataccacttgagtggttttggttgctaaaattctttcttactgtaggctaaaatctactcacaatttggccatatctatcaaaatttaaaatgcacaaaccctttgaccagcattctacctctgacaatttatcctacagatatagtccccatgggctcaaagacatgtgtacaaagatattcattgcagcaaagggctggaaataatttaaacgtttgaccggggactgatgaaataaattatggaatatctgtactatgagaaaccaagaggctgttaaaaaaattaaaccattctcatgcactgacagggaaaaatctaaaattcatgtcgatttgtgagaaagaaagactagctaaataatatgtagagaataattccatttatgtgat

SEQ ID NO: 394773 - DNA, 121 bp, Homo sapiens
caggctttctgaaaggacagtttgtgccctcgcctgacatacctatggacaggcgtggggccgtccttgtggtctttgttatgttgcagcctagcaaaaatgggagcactgggcagagcat

SEQ ID NO: 394774 - DNA, 219 bp, Homo sapiens
ccacaacgaagcagctgctgctggctcctctcccagagactggaagagaattgatgagaacaccggggacccagcagttccactcccaggcctaaatctaagagggggacagcaagtgcctgctcaatggccctgaggtttaaggtgatggagctgatctagatagaattgggggtgatggctgtataactgggaatacactaaaatccctgacttgta

SEQ ID NO: 394775 - DNA, 246 bp, Homo sapiens
cttgtgcacaggctccctctcccagatctcttttcccttcctgttctgcctctccttccctgggaccacactggcttctcactatgccttgaccatgccctgttcacagctaccatgggacctttcactgggcgctgcctctgactggggtgaatccttgcgctgcctggcattaccatccagatcttcatccccactcacttcttcagaggccttccctgtccccttgtctctaggacccatttc

SEQ ID NO: 394776 - DNA, 813 bp, Homo sapiens
attgcagctttcttttcttaggttagtgtccaggtagaaatgttcagcatgttatggactgaatatttgtgtctctccagaattcatatattacagtcttaaaccccaatgtgatggtattttgagatgaggcctttgggaggtaattaggtcatgaaggtgggtccttggtatgatgggactagtccccttatgagaagaggtaccagagagcttgatttgtccctctctgtgccatctgaggacacagcaaaaatgtggccacctgcaagtcaaagaagagagctctcatcaaaacctgaccatactggcagcctgatcatggtctttcggccttcagaagtgtgagaaagtaaattgatgttgtttaagccactcagcttatggcatttttttatggcagcccatgctgattaagattttgctaccaagaagtgggatgcctttgtaccaaatacctaaaaatgtggaaatggctttgtaactgttggtaatgggtagaggctgaaagaggtttttttgtttgtttctttgttttgttttgtttgagatggagtcttcactctcttgcccaggctggagtgcagtggcacaatcttggcccactgcaacgtccgcctcctggcttcaagtgatactcctccctgagcctcctgagtagctggaattacagacatgcgccaccatgcccggctaatttttatatttttaatagagacagggtttcgccatgttggccaggctggtcccaaagtcctgacctcaagtgatccacccgcctcggcctcccaaagttctgggattacaggcttg

SEQ ID NO: 394777 - DNA, 257 bp, Homo sapiens
atactgaacagctgccttactggagagaaatgttaggaattttttatttttactaaaaactgtcagaagtttctaaaaggaattagatgaatcctgaaggtcctgtaacttgaaaagttgatttacgctgaggaccccattttcatcaaggtatcaactagagagaaacttgtatttttcttattttgcattacaataatgcatcttgcttttcttttttatgaagtgttcactttatttttattactccaggtacc

SEQ ID NO: 394778 - DNA, 211 bp, Homo sapiens
tatgttgatttcttactatgtataaaatagaggaaattatccagcaaatacaaagatataagacaaacaagcttagagtctaacaatatggataaaacatattcaaagtactaaaaacaaagcaatatgtaacaagtgtcctaagagaggtatatctgaagaattaaagagtctcagctaggcatggttgctaatgcctgtaatcccagca

SEQ ID NO: 394779 - DNA, 608 bp, Homo sapiens
aatgtagtccttggtcttagcacccaaaaggtgaggagcacagaggttcactggtagtgcagggaatggagagggtccctcacacactgagtgacagaagaggttggctgtgtcactggtatgtaagggttgacactagcattagataggatttttcttaggattccatatccgggtagatcagaatctcttaacctagagcacactgtacccactttagagcagctatagatccctggaactatgtgaattttaggtgcttgcttagacaactctgagaggatgtggaagattccctatgaagaatatatggcacaaaagaaatcaagaacctctgatgtaccaaagggttattatgacagaagaagaaagatgcccatggccttcaaatgaacagcaacctgaaagcacttgtactgaagcgcttacaaatgacacttccaccacctgatctcaccaactatggatcctgctttgatgctgttttcaattttctttttttttttaatagtgtatttatttattcaagtacatattaaggctatgaagtggggatttggtatatgttgccaagattcagatctaatccatgtagttttaaaaaacaa

SEQ ID NO: 394780 - DNA, 351 bp, Homo sapiens
ctgtaggtgactctgaggatcccccatgttacctcctcagtataaagcagagaggagaggatacaacctaagatgatgaatgagtggtttgagtggatgaactctagtaagaaaggaaagaaaacatcttcaaactcatgtctagaaacaaaaggtggacacaatgatctttgcagggctttccaacctagctcttgagtagaattagggtcagcataaataacttagcaaatactattaattccccagcatgctgttttcccgaacctgtctttcataagcccagaagtgaaatgtttttgagagcatcctgcttgtgaacagattcctatttccgtgaggaggtaacat

SEQ ID NO: 394781 - DNA, 680 bp, Homo sapiens
tgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatt

SEQ ID NO: 394782 - DNA, 342 bp, Homo sapiens
ataacctttactttccataacaacctatttatcaaaatgcatcgattctggaatcggagtcggctgccaatgggctgtgtatgtcctcggcctgatgtgttcattaaaggagttttcttctgacagatacaatgtagcaatcaataaactcctattacctggatttatgagctgcttttgaatttggtgctatttcatgtctctgccttccactgtaactgaaaataaatcttccaatactcagatttgaattctctagagtgtaggtggagtgaggtgctgtggtccccagtcccccagcgagaacttgtctgtgggcctcggaggaagcactcctggccg

SEQ ID NO: 394783 - DNA, 1059 bp, Homo sapiens
atttggaagatcagagaggcctctgcccctacgaagggccatgcttgccaccagtcttcctgctgtgtggtgctcccatcgcacaggctgcttctggagatgctcgggttgttcaggccctgtggcttttggcaaggcaggagcatctgtgcttctgctgacataaaagagggtaataaaagtgacacaggaaagcggtgttgtgaggctttagtgatggtggagcagtgttgctgaagtccctcagggagtttggatttgattgcagtgagtctggctacatctgaagcctataatagtttacagtacaagatgctatgtataagatgtcaaacatttgcttggtagaatgctatgattgtcaggagtttacttttgcactgaaaatagtcttgttggtttggtgtaagtagagtcacattgcagcacacacacaggcattcatgcttttatgtttgttaattgtaaggaaatgttttctcaaggcaagagtcaaaggttagcagagtgccaaagaccttctcaaagaggaaagtctcattttagaaacttcattttgtacgccaaaacttgcctttcagtagtctcatgtaatgtttttgctgacatgagttgaaaagtgcattctgttgtaaaggaggaaaaaaactgaagaggaaccgtaagcgtgattatgaagaagagaaaagagcaggaagaaagtagacatcatcccagatttaaatttcatattgttaaaatcatttggttgcaagcagtagaaattttctataactaacttagataaacaaggacttgttggacacctgctgtccaacattcacaaaacctaaagaagaaaactgaactagatctagtgtggctagggatttcagggacaggaattaacaaatctcctgaggaggctgccatcaaaatgactgtgttaactgttgtccatcctggtgtattctactcacatttcagactcctgcgagaggctgattgacctggtttgaatctcgtgcctacccactcgtagtccctccagaccccagggggtgagcgaagggtgtttgc

SEQ ID NO: 394784 - DNA, 442 bp, Homo sapiens
ccccaaggaagtcaggctgttccctgtcctcaggtggtctccttgggcagctcccatgcccaggcactgagagacttctgggctgcactggcacagcattggcagctcaagttcagatttgggggaagaagagaaacttctggcagcccaccggtcagtccctcagggtggtctgtgcacaggatgagggcccactcataggtactggtagatcacgagcctgctgccttcggctctgtggcagcttgaaagccaaccagtatgacatgggagacagagatgagtttgagggtctgaaatgtgccctagttagaaggacagacacttgggagtcatctaagtctgctgtttcatgaatcacgatggccagactttcctcatttctcacgtcgctgcagatcttcccttttacccaggaacagtttagcttcaggactcctgg

SEQ ID NO: 394785 - DNA, 355 bp, Homo sapiens
tatatctctccgtctctgtcacactctcccaggtacctctgctccacagggaagcaacttcccagccctgatgaagtccctgactgtgcctttactattgatttccttagaatagaaaccagaaaccctcagagatactcatgtaaacatgtattctagctatcacgtgagttatctgagtgttttcttgtctgttatttttaaacttgccaaagaaaattttaaaatactatttctttggaaatcgaaattcaagaaaattggaataataataattaaaaaaaacctctttgggtaaattttacctgcgttcattggttttaacatgctgccacttctctctttctctctccct

SEQ ID NO: 394786 - DNA, 154 bp, Homo sapiens
aggaatgagggtgttcatctaggaagatttggcactgactatctcacaatccagggaattcttgctcaggtaagcatggcagccatctgttttgttgatggatatggttggcactttacccattacctgaactttgacatccctactgttgatt

SEQ ID NO: 394787 - DNA, 362 bp, Homo sapiens
gagtcctaggggctgctatggacgcttgagctctgcttccagccccaaatgagccttgttggaagtggggtaggaggaaagtgttgtctgtttgtaccagggcttccctgggagttctgagcttctcaggggaattccatcccaatctccagcttctttgcccactcacctgccctcctgtccaatgcctctggaaagtttcctagtgatggtaacttccagtgactaacctgtacctttgtagggtcactgggagtgagggaccctctaaaataccatctcctgcatgaaacatttcttgtttccctggttaaaaagagtatctcctgcaatcgcacttagcacttattgccctactctag

SEQ ID NO: 394788 - DNA, 571 bp, Homo sapiens
agtcaacaatcctcagatgatgcagaaaacccttgtgtgaaagttgataagaactttataaaggatagatcaagccaacataatctaaaaccactgaccaatcccagcaatactgaaagtgaaccaacctcatgatggtaactaatagaaagaatacagcacctcttataaacaatgctcaccaaaaaaaaaataccctctagaacgaatgttcagtttacaggaaattacaggggttaaaccaaaccacaaagatgtaatcagccaaacagaatgtgggaaattctacaggttaaataacagtttcttcatcaaataaagggcatgaaaagggtggagatttaagagaccatttagaaccgtatcttccaactgcaatatgaagactttatttgggtcctaatgtaaacgaacaaatggcaaagacattttagagacaggctaatctgaacatgttcttgctaccagatgccattaaggaattaatgttaatgttattcattgtgacaatggtatgacagttgtactatgaaaggaaagttcaagtgtgtcagagatacataccgaaata

SEQ ID NO: 394789 - DNA, 169 bp, Homo sapiens
cactatggattattagatggtaagttaactaacttctgaatgcttttaatttaatttttaaaaaacgatttaatacttggctggtcacagaccccatctattattgttactgaaaggttaattaacaacgtggctagctacttgtatgaccttgggcacaaaactttac

SEQ ID NO: 394790 - DNA, 325 bp, Homo sapiens
tgtttgctgaggaaaatagaggcgaggatagagcaggcaggggaagggaaataagacatggagataggaggttaaagcagttgggagtccatacacagcctacccaacttcctgagaactcttagagaggaaaaggcatccttaggcatccttcctgtgaagtttgcctattccgtgatcacgctgagaagatgggaactctgaagtttgcttcacaggaaggtaaaatccttaaagggaggcaccttgctgtgccactgttcagttttactataacatcaatctttttttagtttttattcccacctcaagaggctgagttgaa

SEQ ID NO: 394791 - DNA, 138 bp, Homo sapiens
gtgtttggcgtgtgtccaggcaacaactagatatgttttcaggagttaattagagaggcagataattttgcaggaacagacagggttccagtgttagaatatctaaacattttgtcagaaatagggagccaccaaaag

SEQ ID NO: 394792 - DNA, 320 bp, Homo sapiens
caaaatgaaggaagtggcattgggttactactattaactaaactccagactttacttgggtgtcgctagttttttccttaatgtcctctttctgttccaggatccaactcagggtactcaattgcatttagttgttatgtctttacagtctcctgtggtttgaagcaattggtcagtcttttcttgcttttcatgaccttgagagtcttgaggagaactagcccagtatcctattgaaggttcccccgtctgggtttgcctgttgctttcatcatgaataaacttgggttatggatttttgttaagaatgccatagaggc

SEQ ID NO: 394793 - DNA, 404 bp, Homo sapiens
gttctgaaaacagccagttacttcccaagagttgcacagagaagcctgcacacttccatctggatatttagttaccctcttggaaacagtctccactccacccatcacattctacctccaaggactggaacacagacttattcccacctccccgcttctgggctcttggctggccccaggtctctgacaatcctcccttggggccagaggtactcaaggatgccaagagggatattgagttcacacacacacacacacaaggtgcaaaaaaaccccttgggtattggcctaaccaataaacacttttctttggttaatcattgctattatcaaaaaatcttaatataaaaatctaggctatacaaagaaaattactcaaatacaaatgttgttcacattgtaaa

SEQ ID NO: 394794 - DNA, 317 bp, Homo sapiens
ttggccaagtggagcagttgacagtggggagaagccttgagtgaaagcacagttcttctagtgaagaaggaggcaggaaacgtgttggcagtaggcaactaaccacgtttaccatggactgtaggtaggaagatgttggaaagagggccagcatggctagatagtatcaagacaatacatcagaaagcgacatgcaagaagtaacctagtgccagaacaaagagagactgattagaaagtttggattttaacccaagagcagtagggagggttttgaacagtgttgtgatctgatctgatttacgttcgagtattat

SEQ ID NO: 394795 - DNA, 187 bp, Homo sapiens
cacccgatagcccgacagataacatttagcttagaaaagagctgctattggacttgggtagcagtaagagacaaccactttttttatcagaagataaaagatgataaataataagtcataataatcaataatggtttgtgcatttcatgtaaatctatttttttattttataatttttaaacagtgt

SEQ ID NO: 394796 - DNA, 594 bp, Homo sapiens
atgtgtctttatagcagcatgatttaatccttagggtatatacccagtaatgggatggctgggtcaaatggtatttctagttctagatccctaaggaatcaccacactgacttctacaatggttgaactagtttacagtcccaccaacagtgtaaaagtgttcctatttctccacatcctctccagcacctgttgtttcctgactttttactgattgccattctaactggtatgagatggtatctcattgtggttttgatttgcatttctctgatggccagtgatgatgagcattttttcatgtgatttttaaaggttacctacttgggtcataaatattctagccggaggagcaccattcccaatctgcagttagctatgcccttgcaacatcactttcttcacttcaaaggaggctagaggaagggtgactttggtgggtgagactttgcaatgcctgcaatgtcaccttgcactgcgtggttttgaatagcccgtgtaatgtaatgattagcattctcaggatggtccctgctgctccctcagttgtcctcatcgctgcggtgtgcttagcagcaaagccagcactttcag

SEQ ID NO: 394797 - DNA, 116 bp, Homo sapiens
cagcttcagcctcccaaattgttgggattacaggcatgggctcccgaacccagacagaatattctcttagtgaggcccaaaggcacaaatttgtttacctctagagcataattctg

SEQ ID NO: 394798 - DNA, 487 bp, Homo sapiens
tgggagcctaaatgtctagttgagctctagcccctggtggtgatatagcttggcgcgtagttagtgcttggctcatgtcggctgttagtaaagactctcaagctctgcattggcttccctccgagggctctgcctggatccatcagcagcacttactctctctgagttgacaacacagatggcacttactccagagctgtttggcaggattccaggctatcgccacgttcttgagaaggtatcactggcttgggggaggggaaaagagaggacgatctaggcaaaagcaagatcaaggccctctccaagaattttccagcctggcaggccctgttaggtggcatggtaccgctgtgtgagtgggagcgccacctggagatggccacgatagggtctctgttcccacgagtatcattaacacgtctctctatgaatctgggtgataaccaattaccttggggtttttttttgacactaagacaccaac

SEQ ID NO: 394799 - DNA, 117 bp, Homo sapiens
gaactgaggtgttgtagaagttttctgagattttgcacctatgctagtccttaaattgaggtgtctataaagactgtatctagataaacacacaacaaagtagctgaaagcagttgt

SEQ ID NO: 394800 - DNA, 741 bp, Homo sapiens
gtcccagctacttgggaggctgaggcaggagaatggcatgaacttgggaggcggagcttgcaatgagccgagatcccgccactgcgctccagcctgagaaacagagcgagactccgtctcaaaaaaaacaaaaaaaaagaaaagaaatgagactcgtggctgcctagggcaggaacagggaaaaatgaatgcaataggatacaagatactttgagggagacggatacaatctgtatcttgattggggtagtagttatcaggtatacatctttgtcaaaacactaggatcatacatttaaaatatgtacattttatcatacgtaaaccacatctcaataaagtagaaaaaaaattaaaataacaagtatgcaaagatagtatctcaatttttattatttttataatagtgattaactcaaaaatgtccatcaacaaggaaattataagtccaatatagatgatattcctaatcacattaggcataatatgatctcatttttattaatacataatatgattccaatttacatgcacatgctcacagaaacaagtgtagaagataagttatggttctggatgatagacttcagaagatttaatgcctttttagccatttaaaaataatgaacgtggctgggcgcggtggctcatgcctgtaatcccagcactttggaaggccgaggtgagtggatcacctgaggtcaggggttcaagaccagcctgaccaacatggcaaaacct

SEQ ID NO: 394801 - DNA, 262 bp, Homo sapiens
atggccacaaaccatgaaacactggcagccaccaagagctgtaaaaggcaaggaatagctgctgccctggagcctccaggaatagcacagccgctcgacaccttgattttggctcaataaaactaatgttgaactgctagcctccagaaatatgataaaataaatttctgttgttataaaccaccaagcttgtggtgattcctcacggtatcctctaagaaatgatacaaccatcccaaatgtgcaccgcgcacccgttatg

SEQ ID NO: 394802 - DNA, 277 bp, Homo sapiens
  misc_feature (221)..(221): n is a, c, g, or t
tatagtgctaatcatgtttctaggcaggtgcagatggcaagggcagtgtcttggtgagctttttagcacgaagagccaggtctgtcgaagcctttgtgagagctggaaacgcaggtgtgctgggcatgcgcagtatggggtttcgggctcagggcttgccctttggcatcagacagacctggcttcgcatcctggatttgcttctgacgtgcacccttccnctttgggtctcgtgatgtgaaatggagatgttgtcatttgtgagggctccatgaag

SEQ ID NO: 394803 - DNA, 431 bp, Homo sapiens
gggtgcgtgggcagcagtccttccctggcctgtctgtgtttccactgttgctctccagccagttagcggctttcggctcctcccgccaccactgtggggagatacttggctgcacccctccttccaatgcacatctggcagaactgccctggggcctctgccttagatgacctggcccaccctggttcttgatctgatcttcctctcaattccctgcctctggagcctgtgaactcccagtcaagttagacttgcagttatgactgtgaatatgtattttggaagaagaggctgtagcttaattcaatttctcaaagggatctgggacccaagaaggctgaggaagtgatccctgagatccaaagctccttcaaagcgtcaggctctgtcctgccctccaactcaggccccagaaacccatcacgtctgcc

SEQ ID NO: 394804 - DNA, 528 bp, Homo sapiens
agaaggatcccttgctcccaggagattgaggctgcagtgagctaagatagcaccactgcactccagcatgggcaacagagttaagaccctgtctcgagaaaaaaaaagtaatttaaatttttaaaaatattgaaaaaaattatgataaagaaaatcgatttcatggttaaaatggtgaattttgtattgtatatattgccacggttaaaaaaaataaaagaaaaagaaacaaaacacatgtgggccaaataaaaaaacctatgtctagattagagtcaggtgcggtctccttatggtcagtgtctgctttcgtactaagggctcgtattgtccttctttccaatgctaatgcctatctctccccattgctaaaatttgcttaactcttggactccagaccaaggcctgagaccttgaaatctgccacagaactatggctatgttttagaagatctgagaacggtctggtcctggattttgctaaattgtcaaatgccttacttccttctgttgcatagaaaatatctg

SEQ ID NO: 394805 - DNA, 160 bp, Homo sapiens
tcatgaatattcataacatgttcctatatcctattgaatgtgtatgttctgcctccccacttagcataaataactacttcttctttctctcatttgaatcatggctttacattcaaggttggaggctcgctttccacctgcaggacataccccccttaga

SEQ ID NO: 394806 - DNA, 521 bp, Homo sapiens
ttactgctgttcaatctgggtaagtctttaactaccctgggctttggtttcccagcgagaaatgaggataataataccgtattacattccaaaagctagaataaagtaattgctgtgaaggctctaaacaaatataagtgaccgcttatatctggatccctcttgggtttaaacaatttctgtaatagttggccaggactgcggtgatggatttgaattcatcactgtcataataactcacttcaataggtcttaaccacatcatcatcatcttttttttttttttggagacaaagtcttgctctgtcgccaggctagagtgcagtggcacgatcttggctcactacaacctccacctcctgtgttcaagcaattctcctgcctcagcctcctaagtagctgggaatacaggcgtgtgccaccacgcccagctaattttttgtatttttagtagagatggggtttcaccatgttgcctaggatggtctcgatctcttgacctcgtgatctgcccgcctcag

SEQ ID NO: 394807 - DNA, 342 bp, Homo sapiens
ccagtacttacatttttctcataccacctcttagagcccctgaaagtgtagactccactatggagaagcaacacaaatgtgaaatactagcttgcgagccacgtgggtagctctttcctcttcaggaaaggggaatgctagtgtctagaagtgggagagattgaaatgattctgtaatgaggaaataagttacgttagggcacatatataaagaaacagcagaaaaaatgtaaaatctcaatcactctgtagccatgacatttataaaaatgaaaattttacaagagtatttctaaatgctttgaagttggcccccaaaaagcctgcctaccttcactttga

SEQ ID NO: 394808 - DNA, 250 bp, Homo sapiens
gatatacatgtgtttgtcataggaatcatcttttgtaccaggtggtttctgtgctctgagagtgggtacaaggtgataccatatgtgtttactgggctatgagtcctaaccaggtggcttcagcccaggaaagagatggagtagccaactgagactgctgctgggggtcttcaggaagttgcctgtagctaagtaaaaaatatgtcctatggtttttcctagaaaatgttgtatggtatggtcagctgag

SEQ ID NO: 394809 - DNA, 347 bp, Homo sapiens
gtcagcaccaccaccaggaggcagctcagatcctgggctatggggccttcaaaactgcatccaagcccttcacctccagtcggggacccttcacctccagctggggacccttcatctccagctggggaccctgaggccagacaggggcaatgacttgtgcaagggcaaacaaacagtctgtgacttcttttatgccagtgtgatgccaagataggagtgacgctgtagccacctcgcccagcccataagcatttttaataactgaataacagccagataacaccacccatgtatcattagggtcttgggaatcactgagacccaagatcccatcctgcttatctcct

SEQ ID NO: 394810 - DNA, 195 bp, Homo sapiens
ggagttattcctcctctatgtccaaaagtgacatagaaacaaaatttggtaggaaaatcaagaaatcttaattgaataatttttaaacagtttattatacaaaattataaagcataactttacagttatgctttattcaattcaactgagatgcatccttcaatatccactacatggtttggaacatgttaagct

SEQ ID NO: 394811 - DNA, 332 bp, Homo sapiens
cagacggcacctgagacgatgactcctcttctattagctactaatcactcaattttagttatgtgctgctgaagcaaacatgctactaatcatccagatacattgttttattgagtttatgcttatttcttccaagtatatcaagaagtcccaggaagactatgaaaacatttacatccccatgttggagacatgtgggtttcaatatttcatggtttctctggaatattggaaaccaccaatatttcgtggtttctctggaaaagaaaggaggtatgtgaaattaaggaatggcatggtgagttctaacaaactcaaaaccaatctaaatc

SEQ ID NO: 394812 - DNA, 317 bp, Homo sapiens
catggatttatggggaggagtgtctgtagctaatgttgctcagttacgacttttattatgcaaaaaaccccaacaaaaccttactattagctgcattttatgctgagccctttttctggaaaatgaatgcaacactgaaactctggctttagagttatatgtcaactgcataccatttgaaaatcccagccttactgataccactgaattttgagaaatatcaaatcttcctcaaagtgataacaggagactgcttcttttttatttttgaaaggctgtttctagtctaatctcattccattttgaccttatctttg

SEQ ID NO: 394813 - DNA, 443 bp, Homo sapiens
aggcattttggaaagtacagctagtaaaaatgtaaaaagaaagctattgctccaagttcattgtaggcacagcagaagttactaaagtattccgatatctaaagaaacaaaatttttaaggataataagtaacttccatccctgaccattccaatttatttcagctcagatccattccatgtgttttaatttagttcagttccgtttattagttactgagccccactagatcaagtgcactcaacatagtttgatggggaaatgcaagatgattcagataggggttttgccctcagtccagctgggagagccttgcatgtctacacaagacctgatggctctcccatgaaacatgccaaaaatgaagtatgaacacattatgtgtaagctattagtttgcccctccagccactataatcacattagctactttctcagacagt

SEQ ID NO: 394814 - DNA, 596 bp, Homo sapiens
tcaaaacctctgggatacagcaaaagtagtgctaagtggaaagttcatagcattaaatgcctatatcaaaaagtctgaaagagcacaaatagacaatctaaggccatacctcacagaactggagaaacaagaaccacccaaacccaaacccagcagaagaaaagaaataatgaagatcagagcagaactaaatgaaattgaaaccaaaaaaaaaaaaaggaaagataaatgaaacaaaaagctgctgctttgaaaaggtaaataacactgatagaccattagcaagattaaccaagaagagacaagatccaaataagctcaattagaaatgaaatgggagatattacaaatgatactacagaaatacaaaagattatccaaggctaatgtgaacacctttacgcacataaactagaaaacctagaggagatggataaactcctggaaatatccaaccctcctagattaaactaggaaggtatagaatctctgaacagaccattaacaagcagcaagattgaaatgataattttaaaaattgccagcaaataaaaagtccaggactggatagattcacagctgaattctatcaaaca

SEQ ID NO: 394815 - DNA, 887 bp, Homo sapiens
  misc_feature (735)..(735): n is a, c, g, or t
  misc_feature (780)..(780): n is a, c, g, or t
  misc_feature (842)..(842): n is a, c, g, or t
  misc_feature (862)..(862): n is a, c, g, or t
tcaggagttgtgtcccagccctcagtttatcgttggtggagccacgcgcacagacatttgtcagggtggtctagaaacgagatggatgagaattggcctggtgggcttcagaagcaactaggaggaactctgaaataatctgaacaagtttcttcagctgtgaagagtttgcttgcttttttttctttttctttttccttttcctctccactgaaaacttagaaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccatgaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgagccatcaccaccagacgctggtaagagtcatgcgtactctgtcactggagtcgaagaggtgaatntccagggccatccagagaagctgatcagactcaggaatacatggnggtgaagtggaagtgtccgggagcctggaccgatgatgcaccaaagtggattccatagaccnccggccggaaggagaacctnacaagaaagttgagggatggagatt

SEQ ID NO: 394816 - DNA, 199 bp, Homo sapiens
taagagggttaggcctctggccccaagctgcctggagaactaggcagcctgccttgaatagctcacagactggcctctgtgttatgttcctgggactgctcttgaacagcttcttttcctcttagggataattgttacttcctcctgctgtgcgactccccttttagcagccttttcctcttactactcactgtttctt

SEQ ID NO: 394817 - DNA, 345 bp, Homo sapiens
gtgactctaaggatccctcagagggtaggtacactgttggggctgatctctaatgctagtaatcgaattaggtaaacaacaaagagttttttagtggaagtatatcccacgcaatagttttatttgctaaatctagtgactctagttgtatgcttattgttttattttgtcatgcttttttgtcattttgttttttattggcagaggtatgaaaagggtaaggaaggaatgaagagaaggagttattttgtatcctgtttttgatctggggttgaccgtttctgtcttcttatatagagatgtcataccaaggtttgaaggtcctttctatgaaatcttccaact

SEQ ID NO: 394818 - DNA, 261 bp, Homo sapiens
tccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaacca

SEQ ID NO: 394819 - DNA, 330 bp, Homo sapiens
cgtaaggaaccaagatgccatctgatggtcaatgcatttgaagtgggcctagaaaatctgcagaaagactaggttgtattttgtaaactaaagctattactgagaatgttcagctcaaaaatcacctgacaaattcatggaaaggatgtcataaataacataaaatgtgttccctggcttaaaataaaaagcacatcaacaatcatgctgatgtacaaactgtctgctccctctgttttgtgtgttttaccaggaaacaaaatgactagaaggcacccatgttaatggcaaaactaccaatagtcatttgcttgaactgttttatgatag

SEQ ID NO: 394820 - DNA, 415 bp, Homo sapiens
taactttttcccaaggcctgtgaccattgaagatgataaatgggaaaagagccgggcacacctcacacatcaaagcagtgcaatatgctgtagctgcccagccacacacctcggagtcgttttacaggagtgagcaaatacttctcttgctgaagtgaacaaggtgactggctaaaataagcctagtcatctgtaactgaggcataacacaagtttattcttagcatcccctttgcactcccagtcactggaaaagaaaggactcagaccaaggacccgtgaactttccaatacatttgaccccagtgaaccctgtgtttctcgtgactggccctgtactaaagacctcagtgttcttggtctccatttaggcaaggtcagaccagagatttagtcagaattggtttaaactatt

SEQ ID NO: 394821 - DNA, 426 bp, Homo sapiens
gatcacatggaactctcagtcatcaatcagggatatcagtcatgttaggtgaagtgccacttccatcttgaatgatactgaatttccatcttcacctggttgacatttgggtcattctttgtcatggggcgtcggccatgtgcatcctcaggcatttactggcatagctggtctccccacagatgctcccagttgtgacaaccaaaaatgtccccagacattaccagatgtcccctggggggtaaaatgccccggttgagaaattctactctccatttttattacagttatttctgttttttattgttgttattgtaaatggactctttaatattatatttttaagtggttaattttttatataggaaaacttgatttttatgttgcttttgtaattgactacctcattaaattctcctgttgtgt

SEQ ID NO: 394822 - DNA, 149 bp, Homo sapiens
ttcctaccaccaatgcatgaaagttctaatttcttcacatctgtgccaatatttgttatcatctgtctattttgatcacagtcaacctagtggcataaaggggcacctcattatggttttaatttgcattcccctggtgactaacgatg

SEQ ID NO: 394823 - DNA, 418 bp, Homo sapiens
tagtttctttcatatgtttccctagaggttttgctacttgttgatgagtgcttcaacttacacatttatgatgatgtgggagtatagccactatctcctgtttcttcaagcaatatctctattcctgctagataccttttcagtggagcaaagtgacaaggtattatggcattttgaaatggtgatttttaagaaaataaatgtatttatagcattgtatcttaaaacctctcttttcttcatccatacactcatatgggaaccccgatgcatacaatatttaagttatttggacagagagaagttaatataaattgttaaccaagtataaagtcattaacttgctaaacgaaagggtgatatgagcctgaaagtttcatagagatcgcaactgcagaaagcagttaactgctaggga

SEQ ID NO: 394824 - DNA, 331 bp, Homo sapiens
tagtttctttcatatgtttccctagaggttttgctacttgttgatgagtgcttcaacttacacatttatgatgatgtgggagtatagccactatctcctgtttcttcaagcaatatctctattcctgctagataccttttcagtggagcaaatgctgggattacaggcttgagccactgtgctcggccattcttatgattactttttaaattgttaattttttaacacctcacttctttgttcatatgatttttcctccacagctgaatgtgaagaaaggaagttttgtagctaaaataataaaagtgattaatttttacttggtgtgtac

SEQ ID NO: 394825 - DNA, 324 bp, Homo sapiens
aaagtacaattcaagatgagatttgggtggggacacagagccaaacaatatcaggaggcttcaggaaatttacaattatggcaaaaggtgaaggggaagcaagcacgtctttcatggcattaggaggaaaaagagggggagaaatgatacacgtttaaacaagcatgtcttgggagaaatctatcagaagacagcactagggggatggtgctaaaccataagaacaacctcagttattgaatcacctcccacaaggccctacttccaacattagatattacaatttaacatgagatttgggtggggacacagagccaaattata

SEQ ID NO: 394826 - DNA, 513 bp, Homo sapiens
tgaaagaaaaatgctttacaaaaaaccctcaggtttaaattatttacataaagttatgtattattattaacaagttatatgttattaagttatgtgcatacaaaaaatgctcaaatcttaaagacagctcaatgaatttttacatatgtatacacccatgaaaccacaacctaggtcaaaaaaacaacatttcaattaccccagaaggttccttcatgctacttctcagctaatacttcctctgccagtgaaatccttattctgacttctgtcaccatagattagttttgctggttcttgaattttgtacctttttgtgtctgtcttcttttactcaacaaatgctgtgagattcattcatgctgtcattatgtcagtagtttgttcatttttattactgtgtagtattctatgatatgtacaaactataatttattcattcacctatcgataaacaaggggattgtttctagtttttagcaataatgaataaagctatgaatgttcttgtat

SEQ ID NO: 394827 - DNA, 503 bp, Homo sapiens
acaggtcctttgtccaaagctccttgaggaggatgacatttagatgtattctctgtaattgataggccatccccaactggcgatggactcatatttttaaaaaaagacagctgaggattccatcagcattttgaagtaagctacctccaccaaagcccagctaacttcaaacctgcaataataacaatcggttaataatagtcataatttcactttagctctatattatgatgtattgttctaaaaagactttctcgcaaaaccaagaagagagcatttccaaatgtacaaagtattgtaaaagtacaaacggaaattatttctgtattgttatcatttccacctgatccgtatgagctcacagtgaagagggcagggcaaatctgattccattttacaactgagaagacgagccatttcatcagagtggtggtttccatgtcaaatgtacatagaggtattttgggaacacagcagggggcatctgatctggcgggggcatc

SEQ ID NO: 394828 - DNA, 159 bp, Homo sapiens
aaggagatgatacattaagaccagggttttcctagatgattctgaattattttaggtgacataagacaaaagcattaaataacatagaatcacagtgagcgagttatttccttttcaatcctcaatccaattcagttgattcagtccaggaaaagtctt

SEQ ID NO: 394829 - DNA, 355 bp, Homo sapiens
cgagatggggagagggatggaagaggcagctccgggcagctgcacagggccagctgcttccagctcttagcaggacaactggagcaggccctcgggccagcgtgagtcattgcacagggtggggcccctgggtaggcagtggtcctgagagccagacctcctggctatgaggttgtgggagggtatttcaccttcctgagcctgtgtctcaggctcaagatggttagtataaggctgaaattccaagagcattaaccagacacctactatgtgtatatcttgtgtaggggttaggagatactgccgttggctgagacacacagcccacatccttggtaggtccctcagagagcat

SEQ ID NO: 394830 - DNA, 384 bp, Homo sapiens
gaaggtctttgctcaggaggtcctgaacagatggcagagctggaagtttccatcctctcaggccgaatgggcaggttgctttcagggatagggtgcaggcaggctggggccacctgaatagtcaaagccctctgcttcagccaccttcagccaagggagcctgggctggggctgataaacacagccaaaggcatatccggtatgaatttcagcagcccctcctactaagacgccaaagcacgcaggtttgtggtgggaagccctggggagtggagaggaagagcttgggagaacatgtgggaaattgagccagccaagagaaatgaaaaacacattggctggtgtgaagggaagaggatgcagagacacaatccataactttaa

SEQ ID NO: 394831 - DNA, 177 bp, Homo sapiens
ctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagc

SEQ ID NO: 394832 - DNA, 344 bp, Homo sapiens
atgtccctagcgggctagcggggcgggatggtggaggttcgctgggctaggcaggcagtctgtcacttgtgcacttggacacccagttgctcctctctgtgggtgtgctgcttggctttgtgcctcaacctccaactctcatcttgatttctgcagctagagcagcactctcccactactgctgtggctgagggccctggtatcttcatttcttcagagggtttcaggagagagtttttgacatcagggagctctactaacttgcccagtaacacgtttgcagcactatattccagtagtggagtgcatgaatccagcatggtagcaagtctgcttggtggttg

SEQ ID NO: 394833 - DNA, 464 bp, Homo sapiens
cgaagtctttcactctataattggtacatatctttatactagaaaatttcttgaatgaatatgattgccttggcaaatataatcagttatgacttttttccccatagattttgtgggttttattattttttttctctgatgaaactctgagacattgccaaatgttgcagaaaatagaagtcagagtgccaaaataattctctggagctctcaggactttgggtgaccttgaaggaattcaatcctctcatacatagaaaccttgaagataatgaaggaaattcaccttatcacaggggaattaaaaccacatcttttctagcagataaatgcttccaagaatactagaaccccaaattttggctatttcagggggaagtatcatgtatttcacttgaaatgtgtagtagtttaatatatgtctataaagaaaggagcagtagcagctgttttaatgatcatcc

SEQ ID NO: 394834 - DNA, 276 bp, Homo sapiens
atagcatttattctgcactccttatgattgctgaatcaaagaaagactgttctggtgaagttaaaactgcatatgcacattcgtgtgtgtgtgcgtgggtgggtgggtgtctgtgtgtctgtgtgtccgtgtatagttcgcacttgtttagaagatagaatggggccgggcgcggtggctcacgcctgcaatcccagcactttgggggccgaggcaggcggatcacgaggtcaggagctcaagaccatcctggctaacacggtgaaaccccgtctc

SEQ ID NO: 394835 - DNA, 339 bp, Homo sapiens
aagctaccatgaacacctttacacacataaactagtggagatggataaattcctggaaatatatgaccctcgtagattaaaccaggaggatataaaatctctgaacagaccaataataagcagcaagcttgaaatgataatttaaaaactgtcaacaaaaaaagtttaggaccagatggattcacaactgaattctatcagacattcaaagaagaattggtcccaatcctgttgacactattctgaaagatagagaaagagggaatcctccttaaatcattctatgaagccagtatcaccctgataccaaaaccagggaaagacataacaaaagaaaac

SEQ ID NO: 394836 - DNA, 564 bp, Homo sapiens
caggacgggttgcagaggcctgggggcccctctgtttttcttagtctgtccttggttccagtgcttcgcgagaaaatccaacatggaggccagagcaaggccccctccctgctgtgtgcgggcagctccggctttggggttgggaatcaaaaccagggcccacgtgtacgtcgggagccatctgcgctccaccctgaccaggacggagccgcactcgggcgtctgggggaaagcccacggcgcggctttcttgcacgaagttgggtttgccgtgtaagcctccccatgcgaatgctcagaagaacacaggtgtcacatggccttgggaccaaccctgatctgcagcgtgggcctgttgtggtctgagtgagggtcctggcttttccttctgcttgggcagccttccgagggtcttgcaagaggagatggcgtggcagctggctcagcctcccctcccccagcccggagtgcaggcaggagggggtgtggcgggggaagtgttcggctagggggtgaaggcccgggcaagctcacccttcagtgttgatttaaagggatggggaa

SEQ ID NO: 394837 - DNA, 2368 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactctt

SEQ ID NO: 394838 - DNA, 2110 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattgga

SEQ ID NO: 394839 - DNA, 962 bp, Homo sapiens
  misc_feature (825)..(825): n is a, c, g, or t
  misc_feature (832)..(834): n is a, c, g, or t
  misc_feature (837)..(837): n is a, c, g, or t
  misc_feature (849)..(849): n is a, c, g, or t
  misc_feature (858)..(858): n is a, c, g, or t
  misc_feature (860)..(860): n is a, c, g, or t
  misc_feature (867)..(869): n is a, c, g, or t
  misc_feature (871)..(871): n is a, c, g, or t
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagagnggtcgtnnngcntctgccccctgngcttcagantngaccggnnntntcctctccggcttccaagaacctttgcgaccgggcactttctcagacccgcaactcggtccaagaaagcccaagaggggccacaccgtggc

SEQ ID NO: 394840 - DNA, 786 bp, Homo sapiens
gatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaagtgagttgcaaatatacgtttctttaaaaatgatgcaaaaccctttgtccccacttgctgccgggatgagaggtaagcacggacccgcccaccctctgacatcgttagccagtgaagaccccggagctggccatggagcgagcacctccgcatccaggctcggcagtgaggaggatgggcccccagcagatgagcttctcccacaggcagcacgcagggtagacagagccctcg

SEQ ID NO: 394841 - DNA, 4443 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgtcttctgcaattaaacacgatttttattcagttctggt

SEQ ID NO: 394842 - DNA, 4345 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394843 - DNA, 4335 bp, Homo sapiens
tcttaattaagggagcccctagaccttactctttcactttacctaggagtttggttcctaaactcaccattcaaatccagcaacagaacagagagaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggcatagccatgtggagatgttcacgcatgtacttccctttgtgatttcagccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394844 - DNA, 4335 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagagatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394845 - DNA, 4276 bp, Homo sapiens
  misc_feature (13)..(13): n is a, c, g, or t
  misc_feature (15)..(15): n is a, c, g, or t
ggggcagaggcgngnaaacttcggctaggtacgaggctgggttgtgcggcggttgatcccagggtggcgagtggcggccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394846 - DNA, 4316 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394847 - DNA, 4696 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaatcctggaagacggtggccgctagtctgagatgctgctgagcagagaagctgcagacagagcctgtcctccctggccccccgaccctgccaccatctccccatttgtggcagacgcttgcatctgttccttttgaatgaaggtcgcttgctgttgtcagaaagaaggtttatgacagctttctggtaaaagcaactgaaaagacactgaatggatgctgtgaagagcttaggatgatgtacttgtgtttatggcccgttccatttgaagtggtgtcgcactgcaggatggcgcgtagccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394848 - DNA, 4059 bp, Homo sapiens
cgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcataggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394849 - DNA, 3936 bp, Homo sapiens
gatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394850 - DNA, 1480 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtcgcccacgcgtccgcgacccacgcgtccgccc

SEQ ID NO: 394851 - DNA, 3311 bp, Homo sapiens
ctttagactttccatgtaaaactcttcatgtaaaaacgtgtgcagatagacgagattaaagttgccacggcgtgatgaatgcctggcgtcctgtgtggtgagtggtgtgctggctctgttgccgcagggcagccagtgtgtactgcccgcagggctgccctgtgtggagacgctgagctgtgtcgctttcttccctccaggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394852 - DNA, 2797 bp, Homo sapiens
ttttcttaagtgcccacatttgatgagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394853 - DNA, 947 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagagggtaaagtacgtgaatgtcca

SEQ ID NO: 394854 - DNA, 669 bp, Homo sapiens
tgccatgttccctgtgtcacagaagagtgtcactctggcctgaaataggaccttttcacacttggacattttcacacttacccacttctccatgctccccgaagttattacagttcaagagatttctgttactttgagatttcataactttgacttgccagagagaccttgatgtagtgtaaacctaaattggaatgaatagtaagctaggattatactagaagttgactgggctaaaatgacggtaatttgttttaaatctacacttgaaagaaatagagaagttcccggagagagcttttatggcttataccttttcctcccttcttaatctccagaatttattgaggagcacaatttttagcaagtgaaagaatgaccgtctagaactcacatttactgtatgcagtgagaaaatttggaagccagttcacttactagaatatatatgttatagggtcatttcccttttttttgtcttttaaattctttttgtatttgttacataccaaactataactgtcctgcctttctttactggtaatatgatttccaatgtcgtactttttcatgattcctatcctaaaagtgtgcataagttttatttgttttttaccatttgttttttgttttgttttgtttttttacctagagaagtgaaaggggcat

SEQ ID NO: 394855 - DNA, 418 bp, Homo sapiens
ccttggtggcccagggcagagctgtcctggagatagccgtgtggcgcatttgcagtctgctgtgaaagatgggaaattcctgttttaactcagctcaaattcttcttttctcttttccttccacaggggaccgtgattagggtattttccattccagaaggacaaaaactctttgagtttcggagaggagtaaagagggtaaagtacgtgaatgtccagaatggattctggaggttgtatttggatttcagttttatgttatctatgaacaaacaagtagaacccccaggagaattccacacgagcatttctagcccggctgggtcaccgggtaagatctgggcgtcggtcttgtcatgggaattgaagagcactttcagaaaagcaaattgggtttttgtttgcgatcccaccagct

SEQ ID NO: 394856 - DNA, 4399 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394857 - DNA, 4366 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394858 - DNA, 4359 bp, Homo sapiens
  misc_feature (13)..(13): n is a, c, g, or t
  misc_feature (15)..(15): n is a, c, g, or t
ggggcagaggcgngnaaacttcggctaggtacgaggctgggttgtgcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394859 - DNA, 4336 bp, Homo sapiens
gcccttctttcctgtcacacttgctaggtcggctggtttagcggttgatccaggtgtgagtgtgtactgggcgtggaggggccgggcgaccctagtgctgctgaccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394860 - DNA, 4057 bp, Homo sapiens
  misc_feature (1)..(1): n is a, c, g, or t
nttcatagatctgttccagcttatccacagaagaaaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394861 - DNA, 3624 bp, Homo sapiens
gactctctgtagcagatttggcagagagtataatgaagaatcttaggcgggtgcacccagtgggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394862 - DNA, 3467 bp, Homo sapiens
ttactgacatgatcacaattaatccctcagaaaatcctgtgaagtaagtagtttcccttttatagatgtgggaatgaatcaagactcaggtggtgtgcacacacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacata

SEQ ID NO: 394863 - DNA, 1300 bp, Homo sapiens
aggcggtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaaccccagaggagccacaactggacgggtactcgggaagtgtcatgactcacagtactggctccacagtgacgaagtgtaacaggcgagcctcgcacgccgctgcataggggcaaaaacttgtcgtagcagatagagatcccggtgggggcgcacggtctgcacgtgaacggcccgaagggatgcctaacacacggggataaacagactgaccgccagcctacacaagcgaaagtgacacagaaagtggccacccagataccatcccagttttgcgtgtcttcggg

SEQ ID NO: 394864 - DNA, 829 bp, Homo sapiens
  misc_feature (13)..(13): n is a, c, g, or t
  misc_feature (15)..(15): n is a, c, g, or t
ggggcagaggcgngnaaacttcggctaggtacgaggctgggttgtgcggcggttgatcccagggtggcgagtggcggccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggttagttccaaccctggtttctgaaagtatcaccttggaaggcttatgttagaggacttttttggctttttgaaattgcagtgaaccagttaataagtgggagaggatcacttgaatctgaaatggaaatatcaaggactacatttttccagtggataccacagcttgtgggaagtccctagctgttggtagtaagtccggttataaatttttctccctttcttctgtggataagctggaacagatctatgaatgcaccgatacggaagatgtgtgcattgtagagagattgttctccagcagcctagtggccatcgtgagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggttccgcagatgagacagattttaaaagtattgatcccaaaccaagctgccttcctactgatgctggtcatgtgaccac

SEQ ID NO: 394865 - DNA, 315 bp, Homo sapiens
tcaaccccttctcctggctggaacattctccctggctctttacacagacagctccttttcatctgccccaaactcacctcctcagaggggccttcattggccaccctaccaacagctatcgcctcctctgccaaagcccccaggctgcccctcctgcctttacattcttcacaacactcaccactctttgacagacaggatttgcttcctgcctttattcacccttaagctgtctgttaccctccccagaatgcaaaccccttgaaggcagagattttgctgccctctggttggattgtggttacgtatctaggc

SEQ ID NO: 394866 - DNA, 159 bp, Homo sapiens
gaatgtcttgcagggaagccaacagtgaaaagaaatgatggtgcctcattctgtcttaggagtctccctgacacattcctgaagcacctggtgcttatttaagcatagcgcttttaatcatggtcgcaattttctgtttacttgtctgttgcttccacc

SEQ ID NO: 394867 - DNA, 367 bp, Homo sapiens
aagttagcctggtatggtggtgcacatctgtaatcccagctactcaggaggaggaggtgggagaatggcttgaactcaggaggtggaggttgcagtgagccgagattgagccactgcactccagcctaggcaaaagagcgaaaccctgtcaaaaaaaaaagttaaaaaatcaaaatcaaggtgctgaatgagatcacctagagacaaagtctagataagaaagataaggaaactcaggacagaaccttggggtactcgagtatcctagaggttgagcagaggtcgggcagcccacaagactgagaaaggagccagtgaaataaggaaactcatctgtttgtgctgcctgccaagacaataggggtga

SEQ ID NO: 394868 - DNA, 297 bp, Homo sapiens
aagtggctaattagctccaagtagtaagaataaagagttgcatttaactaagtaactgattcttatcctggaaaggatagaagtgaacagggaaaagtgaagaaaatttagataaattaatagaccacaaataaatgggttgtcagaggaagttaggatgtttgaagttttgcagatgctttttcgtagcatatcccgctctgtcaaagataaactaggaaagacgccagttctgctgtcttctgcagactgggtcagcaaacagtgaccgctagacactgaggtcaccaagatgaa

SEQ ID NO: 394869 - DNA, 478 bp, Homo sapiens
caccagctgtggatggatgggtgtggcatgtgacacacttagtggattgagggaactgttaggtatttgaagtgtgtatgttttgttcattctcatgtcttagttcacctggtacggttgtctgtattcacctagcatttctcacagacacaattgtgcataggcaaacatgaatttgctttatgcttacattggttcctaatctaccagttatgctgggacaagtttatgtttttaaaacatgatttgctgtaaaatataactgactgtattcgaaaatagcttattaggtatccatggaaacagacaacttattagttgttcttgggattggcaaggaaacctttctgtgaactttgttgtcggtgttcttcgaaattataaggaagcatttctgagaatttctttggaaagcaaaagatcatttatgtgttatgtgtatctagattttagtattttaagcgctttggcttttaat

SEQ ID NO: 394870 - DNA, 437 bp, Homo sapiens
cggcacaggtcagggggcaaagctggctccgaggagcctctgaccgctggccactgtggtggtcttggggcagctccagacacacaagcccagaagacccagaggctgcctcacgtcggagaaatgcgctgatcgtctctctctctctttgtctctccatctctgtctctctccgtctctgtctgtctctccatctctgtctccctgtctctctctctgtctctgtctctctctgtctctgtctctccatctctttctctgtctctctctgtctctccgtctgtctctctgtctctccgtctgtctctctgtctctctttccgtctctgtctctccatctctgtctctgtccctgtctctgtctctctgtgtttctctgtgtctgtctctgtctctctccgtctctgtctgtgtctgtccctgtctctgtttctctg

SEQ ID NO: 394871 - DNA, 272 bp, Homo sapiens
tctaatagaatctcctgttccctagattacttttcccactacagaatccgtcaacccctctgccttttattgtagctatagcaaccaatcactccatatctggaggacataacccacccttgaccgccccccataacactagcatgaaaaatgttttaagcttcatgaagaaagaaatttgaggtgtttggtgcactactgaattcccagcacctagaacaatgcctggccatagcaggtgctcaataattcttggtaggaaggatgaggga

SEQ ID NO: 394872 - DNA, 180 bp, Homo sapiens
gtggatgacaaaattctgggaaagtccctttaaatggataaccacagtattgaaaagtgtatcatataataatacaattcttacaaatctctttttcctcttttgtttaatatcgtagtctccccttatctgtggtttcactttccagtttacatatctagtgtatcatatctttttttt

SEQ ID NO: 394873 - DNA, 330 bp, Homo sapiens
tcactctaacagtaatcacttatttcagatagttcctgtgacatgtcctatttgtgtatctcttccttggggagatcctagccagattaccagaaatttcgttagtcatctaaatcagagacatcagtttgattatggagaatttgtgaatcttcagctagatgaagaaactcaatgtcaaactgctgttgaagaatcatttcaagtaaacatctgaaggctgtagacatctctgcatctttgtacctgcaagtgccatctttaagggggaaactacatgaagtcaccgtttcagtaacttgatgtgtatattaataaaagtaattcagt

SEQ ID NO: 394874 - DNA, 350 bp, Homo sapiens
gtgtctttttggtagaatgatttactttcctttgggtatatacccagtaatgggattgctgggtcgaatggtagttgtattttagttctttgagaaatttccaaactgcttttcatagtggctgaactaatttacattcccaccaacagtgtacaagcattcccttttctctgcagcctctccaacatctcacaagcaaagttttgaagtgttcacaaagtaaaacaaactttagtgcatgcaatattttcatgagaatctagatatatattggataccagtatttagaagccatacttctcgcatttggtttgtaggaataactaggaatgttgtgaaacagaaatctt

SEQ ID NO: 394875 - DNA, 343 bp, Homo sapiens
aaggcaagaccacgaggcatgattagcaggacttgtcttacactatttacaggactgctttgattttcagaccacaatcggttttcatatgactgattaaaaacatgtgccagttgaagtcacagctgcagaagaaaactggaaaaagcagtgagccttagatgttggaacttgcctctatttgcaaaaatgacctctgacttgatttatgcccttgatttcctgacagtgagggctgtgtccctgaaccacttctcctaccacaccccaccctaccaccacattggcctgactctagcaaacatcatgaggctcatcttacaattacccaaagaaaagcatg

SEQ ID NO: 394876 - DNA, 253 bp, Homo sapiens
actcacagtttctcaggctggggaggcctcgggaattatggtggaaggcacctcttcacaaggtggcaggagagagaatgagtacccagcgaagggagaaacctcttataaaaccatcagatctcgtgagaactcactcactattacgagaacaggatggaggaaaccatcctcatgattcagttatctccaccttgtccctctcatgacacgtggggattatgggagctacaattcaagatgagatttgggt

SEQ ID NO: 394877 - DNA, 343 bp, Homo sapiens
aaaaaaatgaggaaaaaaacagatacagaaaaggaaaaaaggatttcacaacattcaagactcactcataataaaaactagcaaaataagaacagaagaaaacttcttaaaccatgtagagagcaactacaaaaaatctacagctaacatcatacagaacagtgaaagactgaaagactgaaagcgctcagaacaatgaacagtgatagcccttctcagcacctctatttgacagtatactggaggtcccacccactgtaataagacaaggaagaaaaaggcataaagattggaaagagcaataaaaatttatttgcaggccaggcgtggtggctcatgcctg

SEQ ID NO: 394878 - DNA, 282 bp, Homo sapiens
gcacagaggtctcagaccagcagggccatttctagcacaagagttagaagcagtaatactctaatttggcctgaggcagtggtagcattgaagtgacaatattcattcttgcctggtttcatgaagtagaactagatccctgaagttttttctttaagggattttctcctggaaatgcatcctctaggagaacacttagttgcaatctgcttgttagaagacagagatgcatctgctggcctcctgccttgtgtatggttttggagtccagttgagcagctg

SEQ ID NO: 394879 - DNA, 352 bp, Homo sapiens
ttttttttttctttttgacatagggtctcactctgtcacccaggctggagtgcagtggtgcaatcactgctcactgcagcctcgaactctcaggctcaagtaattatcctgcctcagcctctgaagtagctgggactgcagatgcatgccaccacgcctggctaattttttgtattttttgtagagatggggttttgccttgttgcccaggttggtctcaaattcctgcactgaagtgatccacttgcctggtctcccaaattgctggttttacacgtttgaaccaccatgcctggccaaaggagaagtttctaagattgtagtatgcttctcttggggcatagcagctttt

SEQ ID NO: 394880 - DNA, 421 bp, Homo sapiens
cacccaagaatgatcaataaaaaaaaaattaaattaaaaaaaaaaaaggtagtaaggattaactgtgaacttactcataaagcttataatgcagtgactggcattttatcagtttaagaaatgttcatttctctcctccctatgtgcagactgtgggactacaaaggtgaatcagatgtttttgcctgacaagaagctcataatataataaagatgacaaaaatatacatgagaaattaaaatgcctggatgaaagacagtgcagtttcatgtaaatgtacctaaatactatgagggtgtagagaagaaaaggaagagctgagatgcccagaacgaatcctcagagtgcctggcatttgaactggtcccaaggtttctcagggggagggggaacatgaattttgccattcagagacaggat

SEQ ID NO: 394881 - DNA, 440 bp, Homo sapiens
tgggcaaaaaaatttcctactcgatctacttagtaagtgacattgccaagatctgaagacagatccggctgcctaccccattcccagctacccaaagtgcctttaactgggcacttaaggtgctattttagccctaacttcccttggcttactctgtcatccttacggcatcctatagccaaaaaagagctgatgagctgttcagcgagccttaccctcaaacaggccacacaagagtctccctccctccctgcctgtgctcatgatgctcgctctgcatcttgccccagtatctcttgtagaactctttcctgtaactttccaagcaggggtaacaaactcaaatgccctcaggaagcagacgggtagaagaaagcttctacttcactaagctgggttgggtcccgcataccacccctgaaccgcctagacccttgatc

SEQ ID NO: 394882 - DNA, 269 bp, Homo sapiens
cctccctgcttgctctttatgcatgctcctttgcaatgtgattttgctattagctccatcaagagatgggtctccttgaatctgagcttgaccacgtgaattgctttgaccactggagcattcacaaacatggcacaacggaggcttgaaaaatgcatgtgccttgggacttgccctctcttgttacttttggaaccagagacctccatgcaatgagcctagactagcctcctagaagatgaggacaagaagaagcagaaatcaagcac

SEQ ID NO: 394883 - DNA, 360 bp, Homo sapiens
ggcatggtgaagccgtctctactaaaaatacaaaaattagccaggaatggtggcgtgcacctgtagtcacagctactcaggaggctgaggtgggagagtcgcttgaacctgggaggtggaagttgcaataagccgagatcgtgtcattgcactctagcctgcatgatagagtgagaccctgtctcaaagaaaaaaaattagaagcacataagcatataatcctacatgaacaagagtgaacaaacaacaaaattgtgatacttgtttcagatattgttggacatttagattgcgtgtactcctttaacagactacaagaattttttttttttttttggggagggaaagggggatcctcta

SEQ ID NO: 394884 - DNA, 258 bp, Homo sapiens
cccaataatttactgcacctgatatgctgatccttcttttgtctggcacataaaaggtgtccaaggaaggctgaactgaacagtctacacctttgcttgctcaccaatgactctgtctgaccccgtctgacccctgaagcttccattaaaataagcagtctcaaaacaaaaaaaattaaaaataaataaaataagcagtctcagccaggaggggtggctcatgcctgtaatcccaacactttgggagggggagatgga

SEQ ID NO: 394885 - DNA, 299 bp, Homo sapiens
tgacctagcccctgacgaccacagcagcctgaacactctttcccatccctctttacctgcctagtttctattcatcttcagatttcagcttgggatggtcttccctgactccccaggatggaactagggctccctgcttcccatgtgcacccaggccctatacttacttccatgtatcccttgtatggtattataattgcctgcttatcccaactaaatagaaagctgcttgagagtaggaacgatttcttggtctttacaaaattcttagtgcctacacagtgcctgttacaaaacaa

SEQ ID NO: 394886 - DNA, 456 bp, Homo sapiens
ctttaattgttctcactcacttccaagttttgaataagacttttattgaggtatttacaaatccatatctgcatcccttctttctatgtttctaattgtcactttcacctatacatgctgactcctagaaaatagtttgttaaatagcaaggcatgagcaattattaataatccccaaattcaaatttttaaattcatatttttaatgacatgagcatttcccatgtcacctatattactttttaaattactccttttccctggcttgccttattccacatccacctaagtccatctgtctttcacatgctatcatatttatctttatgagtacagctttcattgaattttactaaacctagaaattgcaagacacttgagaaacttctagtaacctaatatgtaatcacatgttaggtaatcaactttttgcaggttattttcaattactctcca

SEQ ID NO: 394887 - DNA, 580 bp, Homo sapiens
gttcactgaagtgataagcataaatatgtaagcagagaggctagaaccctggtctaagtcctagaaattcaatgtaggcctgaagaaggacaaaagaaatctgaggttctatatggaaatttacaagggggacccagaaatagaaagatttagaagttacattaaaaactttggcgaattctaaaagttgtagccatgttcaagtgcactgaaagaagaacctgaagggaattgaacctccttcacaatcttgcaggcagtcttttctgaaagctgtagtccagtgaccctttgaagtggcaaggcacattcaggatctcatcatcctataatgctaatgggtaaaaagtgatacctttcatctttaaagctttcagacaaacttacatcattcaaattcttcaagcagttcccctttcctgcagaaaaaaatggcaatttcttctttctaaaaatctttttttaatttttaagtttttttgtgtgattgagatggaatatcatggagtcattatgtcttttgtttccagacatgatgtcagaaatgtcatcccgaagaaagacaactctgtgcatcaaa

SEQ ID NO: 394888 - DNA, 178 bp, Homo sapiens
cacttggttctccctctctggacatgtgtctttgaaataaatcctagtttcagcacacacaaaaaagacctgtttcccaggctagtcccagaagattctatggtaattacaacaggatcccaaatccaagccctctgagtaacagtccattcatttctttttttttttttttttttga

SEQ ID NO: 394889 - DNA, 606 bp, Homo sapiens
tttcagttacaacggaaacttttggtgggcaagtactaaaggtaatcctgagccaggatcagtacagagtggaaccaccaggtcttaggactcacccaatagacttttaatcaatttacaaatgtgtaattgaaatagacatacttagtgcttggcagaatccccatattgttacctggattatggggtaagttctctcatagtacagaaggccaatctgcagctttgaaactgctcacctgtcaagtcagtaagccaaaaacaatatcacttcctggagaaaatagcagaaattaatgcaactcttaaagatctaaaagggtgcagtggtagtagcccccatttttattcccaataaattcatgaatttgtctacaacaaaagcccagagagatcctgaaggataacaatggattatcacaaattcatccaagaagcattctcaattgcagattctttctggaattacggatcttgctagcctataacacaacagaaatgcatggtagctcaaagcttttaaggatgaggctatgtattaccccactaagtaagacaaatacaccagcagagctgttcacatacggaaagttccgttgaagccgt

SEQ ID NO: 394890 - DNA, 160 bp, Homo sapiens
atcatttcctttacattttctaatttaattattttgtcacaagtaggtgtgatttttaaaatcacaaaagataaacgttgtttttttgtttgtgttttgttttttgagacagggtctcatcctgtcacccaggagctggagtacagtggtgtggtcatag

SEQ ID NO: 394891 - DNA, 186 bp, Homo sapiens
actgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctc

SEQ ID NO: 394892 - DNA, 739 bp, Homo sapiens
agaacaatgtaaataaaaactaatacaagcaatggaagttgaacagtgcagggaggagaagtgaagaaaatataattgtacccttcatatcccagctattctagctgtccccagatactgagcctgttgggtacaatctctttggggaataagttttaaacgaaatcctacatctcaaaccatgagttcccaccttacacctagcccctttcccctggttggcccaaagtactgggagccaggcttataccatctaggcagaatattgaaatatttctttcgagggaaaatggtactgacattttgggattctctaaaggaaagtcaggttcctaccccgtccctagttctgtgcatccccgtgcttgaattataagcatccagtcagctgttttaatgtttcattttgttgttgctgttgtttaaaaatagtgttattgagatataactgtataccatagaattcactcaaagtgtataattcagtggtttttagtataggcacagttgtacagccattgccacaatctaattttgggacatttcaccacatcaaaaagaagctataactattagcagtcataccctattcccactcttctctccatggcccaggcaaccactacaggagtgtccaatctttgggcttctctgggccgcattggaaggaaagaattgtcttgagccacacatgcaatacattaacactcacgatagctgatgagctaaaaaaaaaaaa

SEQ ID NO: 394893 - DNA, 460 bp, Homo sapiens
tagtgttaataatggcctctcctggttctgaatggtattatgaggatggctgagtttctcaagtctgttaaaatggcttttttcttcaagtctatgtcctagcccaagtctctgaagtagagatagcagtagtaaataaaacaggccccacaagcagctggcactggctccagagggccttgtccttcctcctttgcagtgaagcacagctgagagggccagataaaacggtcaggagcagagctcagagccgggactgcaggaactgtccctggtgaggtctcagaggaaacagctgagcatccattcactctgagcttcctgcaggacagactggaggaggagggaccacagcagcctgagggaatctcactcctgaccatggacttgccagcagcattgctgtcatttgaccgaaagcagtgaaccctgtgcctaggcaacatggcaaaatcccgtt

SEQ ID NO: 394894 - DNA, 296 bp, Homo sapiens
ctggagggaaagatatgacttgttcatcttcatttactggcatgacagagatgacttcctttctacctccctgtttgcctccaagtagcaatgtccatcagtgtccttgcaatccaagagcagaccttttagataccttgatgtgtagaccaaaagagcaatgaacaaaggagagtaccagatgccaacttccttttctccctccttgcaatgacctggcctcagagagtcagtcacctgggagaaaagagaatttctttctgaagatgatcccttccccaggatgtcagggaaag

SEQ ID NO: 394895 - DNA, 426 bp, Homo sapiens
gctaacataacagaattttaaagcaactattgtaacgaagctcaattaaataaaataaaacatgcttaaatgcatgaaaatcacattggaaaaacagaaacaatgaaaaacaatcaaatgtaagtcctaggactgaaaaatacaatttctgaaataaaaaaatgtgttggatgaacataaccaaatggacatgacaaagcaaaaataagtgaagactgactaaagacagacaaaaattatccaaggtgaaaacagaaaaagactgaaaaatgacaaatttgtagacacaaaatcagaataaacacaaagaaagccacacagaggcatgtcatggctaaactgttgaaagtaaaagatacagagcaagatactgaaagcagcaagagaaaacccaaatattacaaaatgtgggaacaacaatctaat

SEQ ID NO: 394896 - DNA, 227 bp, Homo sapiens
  misc_feature (78)..(78): n is a, c, g, or t
gtgtgcggcttctccttcttcatggggtagttgcgaaagttaataatatcttgtgggtaaagacctcagaaaaggggncaaggttgcacagcttctctccactcagtgggccgacctgatttgtattcccacactctgctggccctgggtgctggcctccatgtgccacagtgcctctgcgggccgtccggtcattctgtccacctttgcccacttcctgctgcatg

SEQ ID NO: 394897 - DNA, 807 bp, Homo sapiens
ggagagggcgttacacacacactcgccggagcgctcgggccctgggaatcggcaaacgctgcgggttccagccccgcgactcaggccgggcgaagattagagtcaccgcctcagttcctccatctgtaaagtgggacccaggagggtcggacccccaggggtgtggctggcggcagcgtaggtcttcggggctgcggactcccggcccccgggacccccctgtcccgctgtggaaactggcacggggaccggagggcggatcccccgggcacttgccgaggccactgacccaggtctggatgttccccgaggcccaaggtcaccactgggcccccccggggactgacgagaggcctctggcgggaaaaggggctggctcaggcaggcagcaggccccagaaccccccgcacacgcgggcacaggaagccccagcaatgcccctccctccaatttctcaacccgtgatgggaaaagaagagaaaaggaagaaagatttcctccaaagcttcactgtggcagaattccgctctgaggtccttacccgcctccaggcagccctccctgctcgccgctcaccacgaacacagggcacaaattgtgtccttcttctgctctaaactctgctgtggctccccagtgccctcaggagaaaaaccaaactcctccctgcggcccatgaagccctcagcaggcttggcatcccctgctccagccacaccagctgcccgaaggacacaccaggctccaggtggccccagcccttgcattggctgccccatgagaacctgctcctctcgccttcttat

SEQ ID NO: 394898 - DNA, 415 bp, Homo sapiens
cagggggtgggtccctaggagggactgaaggcctccaaggatgaggcctcgggaagccccctcatggcatcttcccctcagcccgatggaggcctcagacagcagccagccaggccggctgtgcctggatgctggtctgggttagggccactctcttccctgtatttctgtagtttgtggacttctctgtttcctaggaccaagtcctttgtaaaaacatcgggcctgccttgggtgagtgaagtgggtggttaggaaggtcgcaggccctggccggctgcctggttcaagccctggctccgcccacttcagcctggagcaagtctccgacctcagcattcctcggtctcctcgagtggggccgtaacagatctactttttgggtgattggaagatggaatgagtccctttgtgt

SEQ ID NO: 394899 - DNA, 160 bp, Homo sapiens
agtagcattaaaggagaaaaactggaaacttgtgtgtttctgccacccgattcagttatttagcgtcccgtccctacaccacctaaattacatcagatgtccgcaaggggcactattacacgttgctgtattcagacctagtctagagcttgaccaattg

SEQ ID NO: 394900 - DNA, 400 bp, Homo sapiens
tttaacattatataacataatgtattaacattaactcaccttccacgaattgacatttccacttactacttgtgctgtgctgtgaagaactattttgttctatttactttttaaaacaagctatttgtgaagcactaaactggtatatgaccctgttgttggggaaaccactgatccagataggacctagcagtatctgcagagcattcttctgttcagaagatctcagtagctgagggtgtgtctgcgaagcctggtgctttctaaatgagcaagcaagcatctttgtatactgcagagggtttggggatccctcagcctgtagtcagcagatgttgattaagcttctgatatgtgacagtcactgttgtaggtagcatgtgcttccccgggaggtgct

SEQ ID NO: 394901 - DNA, 396 bp, Homo sapiens
tcagtctccaagacagtgcgagcaagggcggggcctctatgcctgcgttaggatgttcttttcttccaaacgtcagctgtgggctataggtccagggactcaggacctggataaccaccaccacagccccactcatagtcctgtgtccgtggcagtgaaggtaactggccagaaaaggcaagcaagcacgctgtccatgccataaagttctgggaggcggtggcctgaagccaaggtgtgcctggtctgtgtcccaggctggccaggtgtgagaggggtcactggaatacatggtcaggtgttcaccgcatcacctcccacctttgactttggcaagcatgtggcccaagaagctggtcctgcctgctcctggcctcgtgctggcccttggaatgt

SEQ ID NO: 394902 - DNA, 264 bp, Homo sapiens
tctctattaaaaatacaaaaattagctgggcgtgatagcgcacgcctgtaatcccagctactcgggaggctgagacacaagaatcgcttgaacccaggatgtggagattgcagtgaggcgacatcacgccactgcactccagccggggtgacagagaaagactctgtttccaaaacaaaacaattaaatacagtatgattccatttatctattaagtgtctagagtagttaaactcatagagttacaaactagaaaggtggccc

SEQ ID NO: 394903 - DNA, 405 bp, Homo sapiens
taggatgcaaggatgattcaacatatgttaatcaagaaatgtgattcatcacataaacagaaataaaggcaaaaaccatatgattatctcaatagatgcatcctagggataaaacctactagatcatggtggattagctttgtttcttattttttaagacagggttttgctctgtcacctgtgctggagtgtgggttgtgatcaaggcccactgcagccttggactcccgggctcaatccattctcccacctcagcctccactcctgggactgcaggtgcacaccaccatgcctggcttatttttcaatttttttagagacaaagttttgccatgttgctcacgctggtctcaaacgtcgacgcggccgcgaatttagtagtagtagtaggcggccgctctagag

SEQ ID NO: 394904 - DNA, 211 bp, Homo sapiens
catacaaattcctatatcagaagctatcttcttgctcaacaaaatgcaaggcaagtcttcattaactacggcctggtcatttacaacacacaccaaaaataaatgaggatgctatttaagataagaatacaataatgtttaaagagtattaagccacatcagatgcggtggcacggacctgtactcccagctactcgggaggctgaggtga

SEQ ID NO: 394905 - DNA, 269 bp, Homo sapiens
tgccattccatacctggtccttcccctatgttacatatggcagaaatactgaaagtggagaatatacagttagtactttataataaataacttttaaaaatatgctcatattaggtattttagttgcacttttatagatgaggtgcaactaaagattgaagctcagagcagataaataactaaataatagtcataagaatgcgtgtcaggcacttcacatacattattacatttaattcttataatcctgtaagaaaagaattactctg

SEQ ID NO: 394906 - DNA, 228 bp, Homo sapiens
ggcctagacacatttaaaaaataagaaaactgaggttttggtcagttgacttggtcaaattcaactaaattccgactgaaatataaaactatgaaattcatactaggtttttgttttatattttttgttttctataacttttctcaaaaattaaattaaattaaattaaattcagaattgtttgaggttttattttctaaaacatattctatcatggaaattttgttt

SEQ ID NO: 394907 - DNA, 259 bp, Homo sapiens
catatgctgttcctctgcctggaactctcctcctcctcctcagctcctgggcttccctctccctgtccttggctggctgcccattgccttctgggctctttatcatctcctcgactagaagccgcgtttccaaagggcagggactgcctgtgctcagcacattcctcaggattgacccgtacaggtggctgtgagtaaatactgtttctttggctaaatcttagtgagcaaaatgacacatatatgtatttttataagt

SEQ ID NO: 394908 - DNA, 380 bp, Homo sapiens
gagccacgttgttacggaagggctgggacccagacacagggtccagagtgtcctcgaggtatcagaagaactcctggagagcaagctgagggctgtgtcgtcgccacaccctccgtgggtccctgctcctgagttaggctgtgcccagccgcccagtgactcagaagctgtgcacacaagggtcctgctgaaggacagcggcttctgcttcctctgatcctggcagcctggaacttcctgagaggactgggcatgtggatagccatggggggggacgtcctttaaactggggaatgggctcccctagacacagtcgcttccacaggaatcttctagagcctcacccagggcagagcagacacccgcagcagcctggagtt

SEQ ID NO: 394909 - DNA, 305 bp, Homo sapiens
ttaggttagcgtagagtgtagagcgtgcgcgtggcatcactgcctaacagatttagccacgcattccctgtattcctgtattcccatgccttctatcaacagtttaaaatttctgctgctctttgatggtaatgtcaggtccaggtctcctcagatcatgagtgccttttggtaaatccttgccttcccgtctgctgccatggaccttaattcctgtcattagtgttggtctctgaacccaagtggggattttcaagtgactcatcggcccactcacccatgaactgttattagtagcaaaaact

SEQ ID NO: 394910 - DNA, 291 bp, Homo sapiens
aataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctaga

SEQ ID NO: 394911 - DNA, 279 bp, Homo sapiens
cagaacactgcgtgtcctgtgcgcgcgtacgggtccggccgcgggtcccaccgcaagcgggcgtgtgcagctgcggctgcctggcgggcgagcttaggagggagctggagctgcggagcggcgggaacaggagcaggccgagggtcctctggccagaagaaatctggcctcggaacacgccattctccgcgccgcttccaataaccactaacatccctaacgagcatccgagccgagggctctgctcggaaatcgtcctggcccaactcggcccttcga

SEQ ID NO: 394912 - DNA, 210 bp, Homo sapiens
tttcagttgtttatttttcaaacagatgtcagggtagttaagagaatgaagtggttggactttggcaaacatttattatgcattgtttaaatagtattaagtgaaggcctgatcctgtaaaaacaagacagtttagaaaagccagcttcctcatattatcttttgagcttggatacaggagggattaattggattccattcaatacttgt

SEQ ID NO: 394913 - DNA, 340 bp, Homo sapiens
tttttgagaaggagtctcactctgtagcccaagctggagtgcagtgagtgacacgatctctgctcactgcaacctttgcctctggggctcaagcaattctcctgcctcagcctcccaagtagctgggaccagaggcatgcgccaccacacctggttaattttcttgtatgccacacttctttagttccttgtagccgggctccttgaccttctgcagggcatctgtggttgtggtatttataagcactcactgtgtcatgagtgtgttcacagagctctaagacaagggccctgtctgtggaagagcttttagggtggtgagggagaagtcatctaaata

SEQ ID NO: 394914 - DNA, 363 bp, Homo sapiens
tgaggaggttttctctctccctgaatcccatacattccttaagaccttaccagatggttgtagattattttagcagagaaagaatctgggtcttctggtccccagtctcaaaatatttctattagcatggaatttacagacattattccaggaaaattgcaaagattgattagataataatgcacaggcatatgtgcaaaggttatttgtgttaagtacctaatatatgccaaacattgtgctgagctcttcaaatacattatgtgatattaatcattattctaccctgtaaggccgttattaccgccatttaagagattgggaaagtgagttttaggataattcacttgtccacagtcccat

SEQ ID NO: 394915 - DNA, 543 bp, Homo sapiens
ttttttttgagacagagtctcgctctgtggttaaggctggagcacagtagggtggtctctgctcactgcaatctctgcctcctggattcaagcgattctcctgcctcagcctcccgagtagctgggattacaggcttgtgccaccaagcccagctaatttttgtatttttagtagagatggagtttcagggttttaccatgttggccagcctaggcaatatagcaggaccccatttgtaaacaacaagaacaacaacaaaaatttatggaataaaactaaggcagtacttaaagggaaacttgtattcgtaaatgcccaattaagaaactagcaataacctagacttctgccctaggacactggaaaatgaaacacaaactacacttaaagcaaacagaggaaggaaataatacaggcaagagcagaaattaatagagaacagaaaaacaacaaagaaaatcatgaaaccaaaaggtggttctcgtgaaagaccaacaaaattggcaaacctttagctagattgaccaaaaagaaagagtaaa

SEQ ID NO: 394916 - DNA, 227 bp, Homo sapiens
tgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttcca

SEQ ID NO: 394917 - DNA, 312 bp, Homo sapiens
attcattcagagaacaaaattaaatattcaggattgtaggtgaggcctgatttctagtgccacagattcacaccatttcactggatataaatagaggaatgatcagaggctgacagttggcttcaaaggcagagagggtaagaaggagacgccatcagcttcaagccaacttcttcgtaaggtgcactctgtcctcagctgtcagagaacaatctggaaacaatctgctgagcagctgctctcatcaacaaactgtttattgtaagaaagtggctgggtcaaaggctaaacatcaacccgagctgaaagcat

SEQ ID NO: 394918 - DNA, 340 bp, Homo sapiens
tacttttcatttgtggaaaaaatatactgagactattccacttggaaaatgagagttttaaagtatattgttgccatgtataattgaaaaagtggcatgcacatgttgggaatgagttcattgcttccaaagcacactgtggatgtggaactcttctgggtgaaggggattccatggtttcaggctgggtgtctttgctggaggacttgtcagagctttaaaaatgctaattctcattgtgaatttctaggaaggggatatagttctccaaatttatttgaccataaaccttttcatggaatcttaacccaggatcaaaaataaatactaaccccttacc

SEQ ID NO: 394919 - DNA, 347 bp, Homo sapiens
aagtggtggttgcatcagttcagggtttcttcatagtcccaggggagagacaacatgagagaaatgctgggccaatgggacactcctttgagaagaacaaataatcctgtatcctggatgtaaatttcaccacaaccatcacaacaagccggatagtcccataaaagcagacaaaggaaggtcaatgttcaatgtatctgtgccccttttggaaaattttttaaattaaaaaaatttttgaccggggtcttgctatgttgcccaggctagtctccaactcctgggctcaagtgacccccctgcctcagcctccagagcagctaggatttcagttgctcgccaccaca

SEQ ID NO: 394920 - DNA, 592 bp, Homo sapiens
caggaaatgaaagaggcctatagacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatggttatggggacagctccagggacttagcttcagctgtttcaaataaaggagaaagaagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatccattaagacaggcatggatatttccatgttcttcctgaatcacaggtattgagaggaagtgtgggaaatgggagaacagctgccttatgaatcgtgaggttcacctaaaccttgggggctagaattgagatggagcagtgttctgaggggtcccaagaagcctagt

SEQ ID NO: 394921 - DNA, 528 bp, Homo sapiens
caagctgagggctcattgttcttccatacacacattcattctctctctcccatatttgggactaggtttgcacagacaaacacagctctttttgggagagaagagagaagatgggggaagggagggtgcttttctgttacagctttcttccacccatctcatgcctgggcgtttttgcaaccttgtgaggcagaagagtgcattggaaactaaaggacactcaaaaacatgttcagagacttctcttctctctgcctccctttattccttttgcagccgtggtttctgctgctctttctttgttgtatatgtaaagataaaatccctctttatatgttgtggccttacgttcagctctcattgcttttgtatttctcattgaccctgattttgtcggggacagtgatttgttcacttgagtcttagtagtgaatgtgagcagagtctttctagatagaaatagattttattgattaatattataaaggttgtattgaggttaatatttagcaagatgatgtttgcatg

SEQ ID NO: 394922 - DNA, 204 bp, Homo sapiens
tgttcccagggctggtcacaaacccctgggctcaagcagtcttctcacctcagcctctcaaagtgctggcgttataggcgtgagccaccacaccagggcctattcccagtttttaaaaactgggcatcattacgtatgcttcgattttgtagtacaaattactggaatttttattctgtttcccaagttgggctagatttctac

SEQ ID NO: 394923 - DNA, 623 bp, Homo sapiens
atgataatctgacctgggtggtagcagtggtgatagtaaaatggagcccaattctgagtccactgtgaaaggtgggtcagcacgatgtcccaaagaggaggagaagaatcaaggatgacagcaaaagatttatggtacgaacacctacaaagagttctatttcgtgacatgggaaaaactgcagaaagaaggtcattgtttggcaagatgtggtaggtggggagaggaagagggctgaaatcagtagttcaattttaacatattgagattgggttgtctataagaaattaactatagatgttaggttggcagctgtacattcaagtccggaactcagaagagaggtcagggctagagctattaagcagggaatcatcagcacaaagtcgattatttcaagtcaggataatgtatgaatgcatctaaggaatgagtgtagacagagatgatgtttaaagactatgacctagggtatctaacatttagctggggagatgaggacaaaccagcaaagacagtgagatgcagtggccagtgaggtctgagaaaaacaagacgaccgagatgtccctgaaacaagtatgtcaaatgttacttataggtcaaataaaacaaagactgag

SEQ ID NO: 394924 - DNA, 406 bp, Homo sapiens
ctgatgacactgtacatcttctgtgtgtttattggccaactgtagatcttgtttggataatgtgcattcaaatccttggcccatttttaaattggtttgtttgtctttatattattgagttgtaggtgtcctttatatattctacaaacacgtctcttatcatatatatgatttgcacaaattttctcctaaactgtaggttgtcttttcacacttttgatagtgtcctttgaagcataatttttaaatcaagcccaatttctgtttttcttgtttgttttgtttttgtcacttacgtttttgtcatgatatcaaagaaaccattgtctaacccaaggtcacaaagtgatgcctatgttatcctcaaagagtttcatcattttagctcttaaatttaggtctttgc

SEQ ID NO: 394925 - DNA, 421 bp, Homo sapiens
ataaatttctaggtcctctgtctctcccaatttggccaacaccggtagagaagccactaactatttggttagtttcattttacttttagacttctaaaggtacctggctatttacatttaaggggacccatcaagtgctaaatttgttgactctttaataaaagaaaattttaagaaaagaaaaaggaactgatatatttcacaactggtaaattacagtaagctaaagtcccatgacattccagagtgcctcaaccacccacagcactcttagagataataaggaaatttcagactaaccaaacttgtcctgtgtattttcttcctgtggtacatattagactacaaagcttgcagtagaagaagaaaagacaatcactgtgtactgctgggttgtgggttctgaagcaaacttgaaatt

SEQ ID NO: 394926 - DNA, 1121 bp, Homo sapiens
cgccgtggctcacgcctataatcccagcactttgggaggccaaggcaggcagatcacgaggtcaggagatcgagaccatcgtggctaacacggtgaaaccccgtctccactaaaaaatacaaaaaaattgaccgggtgtagtggcgggcgcctgtagtcccagctacttcggaggctgaggcaggagaatggcgtgaacctgggaggtggagcttgcagtgagccgagattgcgccattgcactccagcctgggcgacagagcgagactccgtctcaaacaaaacaaaacaaaacaaaacctagaaaaagatgagcaaactaaaccaaaagcaaacaatggatataataaagatgagagccgatataagtgaactagagaataaaaaaatgagaaatactttttaaagtttattatctaaaaagataaagagattgacaaactttgagctaaactgaccaagaaaagaaaaaaaaagaaaactcaaagtactaaaaacaggaaagaaacagtacattactacaacttgtagggtaggcataacaaggatcgtaaagaaataatgtgaactgaatactaacaaattaaataactaaagggaagggacaaattcttacaaagtcacagactatcaaaattgacttaggatgaaacagacaatctgaataaacctggtaacaagtgaagagattgcattagtaatttaaaacttccattacaagaaaatctcacaaattttttaaaccggaaaagttgtgaccggaacatccaaatcatttaccggcccttttttcccgttacaccctccaaaactccagaatggaaatccgcctgggtttttttgaaaatggcccaaaatggcccggcggaagctaccccggaacccgaattctgggcgcttgccgcggcacacggccagattggacccctggtaacgtgaaaacccgtttctaaatctctatttgcacaggggctgcccggcccacttctctgacccctcgtaatatggcgccccccgcgcgcgttcgccctcatctcccttctccagtcgcacccaacatcctcccaaccgacgcttacctctcgccctgcacaccctatcctcgctcttccggcgcctcc

SEQ ID NO: 394927 - DNA, 1064 bp, Homo sapiens
cgccgtggctcacgcctataatcccagcactttgggaggccaaggcaggcagatcacgaggtcaggagatcgagaccatcgtggctaacacggtgaaaccccgtctccactaaaaaatacaaaaaaattgaccgggtgtagtggcgggcgcctgtagtcccagctacttcggaggctgaggcaggagaatggcgtgaacctgggaggtggagcttgcagtgagccgagattgcgccattgcactccagcctgggcgacagagcgagactccgtctcaaacaaaacaaaacaaaacaaaacctagaaaaagatgagcaaactaaaccaaaagcaaacaatggatataataaagatgagagccgatataagtgaactagagaataaaaaaatgagaaatactttttaaagtttattatctaaaaagataaagagattgacaaactttgagctaaactgaccaagaaaagattgtagggtaggcataacaaggatcgtaaagaaataatgtgaactgaatactaacaaattaaataactaaagggaagggacaaattcttacaaagtcacagactatcaaaattgacttaggatgaaacagacaatctgaataaacctggtaacaagtgaagagattgcattagtaatttaaaacttccattacaagaaaatctcacaaattttttaaaccggaaaagttgtgaccggaacatccaaatcatttaccggcccttttttcccgttacaccctccaaaactccagaatggaaatccgcctgggtttttttgaaaatggcccaaaatggcccggcggaagctaccccggaacccgaattctgggcgcttgccgcggcacacggccagattggacccctggtaacgtgaaaacccgtttctaaatctctatttgcacaggggctgcccggcccacttctctgacccctcgtaatatggcgccccccgcgcgcgttcgccctcatctcccttctccagtcgcacccaacatcctcccaaccgacgcttacctctcgccctgcacaccctatcctcgctcttccggcgcctcc

SEQ ID NO: 394928 - DNA, 432 bp, Homo sapiens
  misc_feature (9)..(9): n is a, c, g, or t
  misc_feature (16)..(16): n is a, c, g, or t
cgactctanaggatcncagaccgaatgcgatatagagagaaaatgtttaaaaaaaacagtaggaagcttagatttccactatgggggctcacacagaaactcaatttcatcaaaaatctataaattaagtaattaagaagactagtcaagatttgggtagacccttgatcaaagagtaaagtcttacccactttacctccactatctgaaataattagtacctctcagccaatgaattttcacaaaataagggactcttcttctaatggtatggccgtttaccaatctggcaggaacatcaattcccctctcacattttagtaaacttactcaacccatctgtttctctgcccttcagagagtcggcacacagttctgtggatgttttctgcaaaaggccctgacatctacagtttctatcgcattcggtct

SEQ ID NO: 394929 - DNA, 130 bp, Homo sapiens
caggatcaacaaaaagagaaaaagaaagaatgcagaaataaatatatctttaagaaggagctatctaaagaccagcaaaattctgataataactaaggcttaatgactgggttcatgagagttcactgta

SEQ ID NO: 394930 - DNA, 748 bp, Homo sapiens
gactcaatgataattcagtcagcagcaaatagggaacctctttgatttgagaagtgcaaagagattgaggatatcttcagaagctatgcctccctaaagttagcctcctggtaagataagactgtatttctacatctcttgcaagaacccaggaaggacagaggagggaagaaaccaaaaagtcagcttggtggtactgaagatatcggcttgtggccaaccactcatttactgcagggaacattaaactacaacaatcccagatccctgcaattggtgcttcttggcagatccttagaaatgatcgaattcaattttcttattttacaaataaggacattgaggccaaagaacttgggagatgactaatttagaaaatattgttttgggaagtaattgtattaaaaaaataactccacagcttagcaaaagtggtttctatgttcaagttcagtgtttgtgtgaaacccttgaaattaagttataacagcagaacacaacaatgtatttctgtggctgagacctctaactatcctccaaagatttcttctttccttccatgtcacagggttgtttctaggaagtggatgctcagctagggacattttttttctagctgtcttcgcatttactttggacctagtatctagcctggaccatgagatgcaggtaaaattcttatatttcacctgcagaattcacctccaggaagtcacaccatcctccacaatctctttcctgcatggtc

SEQ ID NO: 394931 - DNA, 535 bp, Homo sapiens
gatattttcaaaattttctctaaagaccttagttggaattattttacaatcagcagtctatgagagtgcttgtttctccattatctttacaacttagatgtgttatcaaacattttggtctttgccaatctgataggtaaaaaaaatggtatcacttcgtagattcatttgcattgctctcatgcatgaggttgaagaacttttcatctatatgaaaatcatgtatctttttttgtgagctggctgtccatgttagactttgattcttttttcattgattacacattttttcttttttcaaattttaattcctgtttaacaacatcctaacagttttttttcttatgaatttgtaggagccgtttatgtaatggaattagcttatgtgttgcaaatttattttcccagtttgttagtcatttgacttggtttgcttattttgatgtagagcttagttgtggttacacgggattgtaaattctgttgctaagttgtgtggattgagatctcgaataatggtataagtatgcttacc

SEQ ID NO: 394932 - DNA, 152 bp, Homo sapiens
actcttatgaatcccccacccctacccggaagatgttctagcgagtgatgcatcctccagtgacgaggaagagggagcttcaaaggaaggatcaatttttaacagtggtggatagaagagtgatgtaaagtgtaggaagtggaaacagcaag

SEQ ID NO: 394933 - DNA, 188 bp, Homo sapiens
gtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctct

SEQ ID NO: 394934 - DNA, 235 bp, Homo sapiens
gagatcacgccattgcactccagcctgggcagcagagtaagactctgtctcaaaaaacacacaaacaacaaaacaacaacaaaaaccaaaatgtgacctatgtgatttgtctttgttagaatttatggagattttgtttcctatagtttatttcttacttgtctattagtcatgtgggaaagcatattatagtctcctagtcctttggcttattaaattctgattgtgtctaata

SEQ ID NO: 394935 - DNA, 517 bp, Homo sapiens
ttccatggccatgaactatagacgttgtcttacaaaaatatgccactgacttaaaagtggtctagatgaagggagcacaagttatcaccccagaaagaacatgttcaacaggcaaggagtaagaacatcttaagcatcactctaaagacaagttatctctgaggctgctttgatccaactaggagtgacatgattattatggtcctaaatgttatatgcattcattcagcaaatacttacctagtttcccggcagtgtagcttgttagttgtaatctttgctttgacaacacatgggaaactagaaacaaatgtttaagaaggaggacaatctgtcacttttcacaagttattcatctaacagtaggggcttttaagtgtcagtccagataaagcagttcttattctctttaatgcaatttatgactcagtttttacaaccattttaagactacgagccaaaagggagagagaaggaaactttcagacattaactactcatggaatcctaaaaccac

SEQ ID NO: 394936 - DNA, 530 bp, Homo sapiens
atcaaggagggaagacaagttgggagaccagagttaagtatccgaactgcccacccccgttacaacagcagtgtgtaaaaatcacgccccgggcctctgctcctgaggacggtactcgtgcctctgtccctgtaactacggctcaccttctttctatgtgcagactgctcctaaagccactctgtgcgctgagctctttttctccctgctgcttgactcctgaaccttccattctcctagtttccttctcttgcaaaatggaagccgtagttgggcctgcacattgatcatctgtatcctctatttttatactagagcaatcgggatttctatgcctttcaaccctctcttcatcctctagcaggaccagtcctattctaatcctatcccttgcttgtgactctaccaaaaaatatttttgcaaacacttaagtttgtgtttttctaagaaaactccccttgtggccagtgtggatggtcaaatggagcagggaaaaactggaggcaataaattaaatatttattgatag

SEQ ID NO: 394937 - DNA, 273 bp, Homo sapiens
agaagtgcaaaacacatctttcattcccttgtccgataactagcagtcatctcagaacaggagatggcttctctctgctgaagcttttttctccagcttcagaccaggggaaaaaatatgttatcagaccaatgaatgggtattagccatcactgggaacccaccaaatacagcactggaggagaaaaggaggtagcagataaaactgtgttttcagagactatacagcctagttttgcagacaagacagagatgtgagggacccagaaccaa

SEQ ID NO: 394938 - DNA, 332 bp, Homo sapiens
ggacgctgcaaaccacactgaagacaagagccaaattcataacctggaggcacaaaactgggccatttgcaccatcttctagcagcgctgattaattatagactcagtttttaaatagcacacggacctcacaaaagctaaggtgaaaccctcaacatatgaagagccagcaaagggaattccccgaagtgaatgcctaattcattcaatcacttctgcttcctatagttacagccttgttccatgaaggactgcccaatattttaatactgaataaagaaagccaaaaattgaaactgctgacacatttttatgattattccacaaacata

SEQ ID NO: 394939 - DNA, 702 bp, Homo sapiens
gtttttcattaacaccaacctacggagggagaagacatgacaattctcgtttccccaaatccaggcgagcctagcgccctgcttctctggcgtgttttattccagcagtgctgcgtttcaggccggggcctggcgtgggcccaggagccttggagccccgccgggcgtctggtgccagaggattccagcccggattaggggtggccgccgagctccatggaggcatcgcacggcaaggtcctttggcccgaaccacccggtcaacggagactcaccaagagccatctgcagccagggtcactcatcaggaatgtccggtggatctgggagaagcccagtgtgttactgtggatttgctcccctggagacccccatcctcacaccaccagaaccagccgcttctgtctgttcgcggagtgcctgggatgggccccgccctgaaagcagacaggcaggggcggccgggggtctgagtggcagctggcagcagtagagaccaccaggttccaagcaccagtctaacccttcggaatcgtgttaaaacccacttctgatcgtggccccgccaggcctcctgtcttgctcaaagtataaacccaaggccatcccttaccccgcaagccccacatgacagccacctgtccagtaccttttttattttattttttaagacagtgtctggccggtgcaatggctcacacc

SEQ ID NO: 394940 - DNA, 467 bp, Homo sapiens
ctcacacattagctagggttagggtttgggtacttccctctctctctaaacaattcggaaactttgaggatgggggttatagcttgtatagctttatttcccatatttgggttatatattaaaaatgttcttaaatacttgctaaagaaataagaaatcactggtgttaaaattttatatttaggctgggcacagtggcttatgcctataatcccagcactttgggaggttgaggtgggtggatcacttgaggtcaggagtttgagacccacgtggccaacatggtgaaaccttgactctactaaaaatacaaaaattagccaggtgtggtggtgggcgccaataatcccagcaactcgggagtctgaagcaggagaatcacttgaacccaggagacagagtttgcagtgagccacgatcacaccactgtgctccagcttgggtaacagagtgagactctatctcaa

SEQ ID NO: 394941 - DNA, 417 bp, Homo sapiens
tggacggatggatggatggatggatggatggatggatggatggatggatggatggatggacgagtgaacagctgtgtagatgactgagtgggtgggttagtgagtagatgggtgggtaagtgggtggatgaatgatcagtcatgtcgaatttattgggaaaataaatacatttcattcacactctgctagcaaaaggagactcacacgcttgcaggtctcatactccccccatcttagccatccagctatgtcaccacttacattctcaacagccccagctgtggaaaagctgtgatagggtctgaagcacaaggccagggacctatataagacataatgtgtgcttgctagtgagacccttccagccctcttgcaacttcaagcctgttacccagtccctgcacagtagccccatc

SEQ ID NO: 394942 - DNA, 431 bp, Homo sapiens
ctgaggtgatgggcagggcagagccggagacagggagaaagagagggaggacgggaatgccccaggattgatccgggaagtgacccagaatgagccagaaggttcacaagccagagtcacagatgtcaccccctggagaatcaccatggggtcaacatccccacccctgagggtgtgcaggctgcctgtgcccttcccctcactgcaccaggtgcctctgggcagagaaacccagcccatgactcatgtgcaccccacctgaggtggcattgcaccagcgacaggagcccatatgctcaagtcacagatcacagagccacaggtctgagggttggaagggcctttcaggggccctgcgtgcttttctggctcagcgtcttatggagaaaaaccctcgtgtgggtcccactggtttcccagggacactggag

SEQ ID NO: 394943 - DNA, 1622 bp, Homo sapiens
  misc_feature (1545)..(1545): n is a, c, g, or t
ggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtataggcaaagcctcctgcggcgaccctggctgctaggccattctctaggnacagctgcgactcataaagaccaaagcttaatcaggttcaacattactggtctagtaaaactggaattaaaaaacaa

SEQ ID NO: 394944 - DNA, 1589 bp, Homo sapiens
  misc_feature (1512)..(1512): n is a, c, g, or t
ggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtataggcaaagcctcctgcggcgaccctggctgctaggccattctctaggnacagctgcgactcataaagaccaaagcttaatcaggttcaacattactggtctagtaaaactggaattaaaaaacaa

SEQ ID NO: 394945 - DNA, 847 bp, Homo sapiens
ggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttgtaagttaaacgaagctgagttttactgaatcatgttccacaacttgtgaaaagatgaggcgggatctgctcattgtttgattattgggaaaacctgcagataagtagctctggcaggggtggcagaggagcagctttggttcgtgttggggctaagcggcattgcttttcaaaacgtgaggtacctcagctttacttcctttgctttttttttttttttttttttttttttagaacacggtctcacactg

SEQ ID NO: 394946 - DNA, 1157 bp, Homo sapiens
ggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggag

SEQ ID NO: 394947 - DNA, 841 bp, Homo sapiens
ggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggag

SEQ ID NO: 394948 - DNA, 618 bp, Homo sapiens
gttctgggtttggatactggctcagttgagccacttcctggctgtgtgacacaggacaaatgaatctcctccctaagcctcagtttccccaggtatgaacaggttgaccagaacattatcagcagaagcagcaaccagtacttaaccgtgtgcattaattcataaattctccacctctctagaggtggagagcattatcatgccacttcacagatagggacgtttagggctagagaggtgatgttgctcaccagtatcacacagcatgagtttgaacgcacctggcagagcctccctgaccatgtttccagaagaacagctgtcattattattgttgagacacagtttcactctgttgcccaggctggagtgcagtggcacaatctcagctcactgcaacctccggctcccaagttcaagcgattcttgtgcttcagtctcccaagtagctgggattacaggtgccggccaccacgcccggctaatttttgtatttttagtagagacagggtttcaccatgttggccaggctggtcttgaactcctggcctcaagtgatctgcctgcctctgcctcccaaagtgctgggattacaggcgtgagccaccgtgcccagcc

SEQ ID NO: 394949 - DNA, 342 bp, Homo sapiens
caaagtcctgtgcagggctccagggccaaccagaataacctgagagtctaatgctggcctgtccttccgcagatactgcctaactcagcaccacactccaggaggccatgaaggattaatttcctattcacagctccatggggtaaagcttggctgtgctgaggaagggatggcgaaggaggttcccaaagactctgtccctttcctccttcccaaaggaaaagatttgtgagctttagactagagaatgtaaaagcaaggaatgtgcttagggaacatctcatccatccgcttcatcctacagattaaagagaacaactaccattcattgagcacttactg

SEQ ID NO: 394950 - DNA, 240 bp, Homo sapiens
cccccatcttccccaggggaacctgtgattcataggattcaggctgttgacaaaggtacacacagacattttttataaaacaaaagggaaccaaaggaaactcagcttttaagccagttttactgatcactaacagaattaaaatagaatgtgttcatcttccaaatttattttcttatttttattttttaaatatgttgttgtcgttgtttaaaatagagacagggtctcactgtgttg

SEQ ID NO: 394951 - DNA, 486 bp, Homo sapiens
catggcgaaaccctgtctctactaaaaatacaaaaattggctgggtgtggtggcgggtgcctgtggtctcagcctccgaagtagctgggactacaggcacatgccaccatgcccggctaatttttgtatttttagtgtagatggggtttcaccatattggccaagctggtcccgaactcctgaccttgtgatccgcccgccccagccttccaaagtgctgggattacaggtgtgaaccactgcaccagctgtttaaatggtttccgattaaatggtactaggaatggcagaagttgctttcatgaatcagcattttttttttttttttgagatggagtttctcttattgcccagactggagtgcaatggcgcaatcttggctcactgcgacctctgcctccggggttcaagagattctcctgcctcagcctcccaagtagttggaattacaggtgtccatcaccaagcctggctaatttttttttt

SEQ ID NO: 394952 - DNA, 391 bp, Homo sapiens
gtgagataggagtctcactccattcgcccaggcatggagtgcatgtggcatgatctcgtgctcacgtgcaaccatctgcttcactgggttcaagtgattcacttgcctcaccttccaaagtgctgggattacaggtgtgaaccactgcaccagctgtttaaatggtttccgattaaatggtactaggaatggcagaagttgctttcatgaatcagcattttttttttttttttgagatggagtttctcttattgcccagactggagtgcaatggcgcaatcttggctcactgcgacctctgcctccggggttcaagagattctcctgcctcagcctcccaagtagttggaattacaggtgtccatcaccaagcctggctaatttttttttt

SEQ ID NO: 394953 - DNA, 354 bp, Homo sapiens
ctttcgggtgaggtggaaggagagagcatacctgttggtgaggtaagagtgttttccttcagagaaccaaagaaacaaaggctccctttctgaattttgtgttctgcctctttgcatttctgaggctccttgtgtctggcagggctgtgagtgaggagatgagggtgtgctcctctgcaggcagaagtcagctgtaggtcagatgtggctttggaacacaatggaatccagggggaatgttggcgagcacagcaaggctggggtgatgatcctctaatcttttgcagcgtgctgtaagagtatctttaactttcgccgagacaggcagggcaatgagcaaaaggacctcggtgt

SEQ ID NO: 394954 - DNA, 360 bp, Homo sapiens
gaggaataggacagacttctgaaacagcatcctatcatttgctaaattgaccttataaataatgttttgcttttgtgacattattattctttttagcattatttttaaaattagattattgttcatattttatttgtactccataatctaatgtactgtatagtgtcacttgtgtggaaactgttttgcagacataaattactaaataaatgttctgttttcagatagtttagtctttgtgacattaagtattgggacagattgttttgactccaattaatattctgaaatttttctcctttcattacctacctctccattatgcctcagttgtaacggtgagtaaaactatttttgtgt

SEQ ID NO: 394955 - DNA, 372 bp, Homo sapiens
tactgtttacaagagacaagctttagactcaaagacacaaataggttaaaaataaaaagatggaaaaaaaagttaccatgcaagcaatatccaaaagcaagctagagaataccagataaaacaataattactaattattactaatatcaggtaaaataaagaccaaacttgttcctagggacaaagaaggccatcttataatgacaaaagggccaatccatcaagaagacataacaatttaaaatatacataaatgtgtgtctaagaacagagcccaaaaaaacattgagcaaaaaaactttttttttgagatggagtttcgcactgtcacccagactggagtgcagtggcgagacctcggctcattgcaac

SEQ ID NO: 394956 - DNA, 352 bp, Homo sapiens
gacagcccaatttttaaaagttgggaaaagaacaggcacttcacgaaagaggacgttcaactagccaacaagcacattgaaaggtgctcaacatcaggaaaaatgcaaataaataccttaatgagataccacattcagccagaacggctacaattaagaagactgacaacaaaactcttgtgttgacaaggataagaggcacctagaactctctcatattgctggcaaaggcgtaaattggtacaatcattttgaaaaactggcaatgtctactatcactgatcatgtgcataccctccctacacactagcaattcctctcctagaaatgtgtgcaagtgtctacaaaaaga

SEQ ID NO: 394957 - DNA, 300 bp, Homo sapiens
gggcgaggaaaagggaggagtcaagggcagctcccaggtttctgggcaactggatggattgactgggctggaaaagatgggggtggagagtggagaaggggtttgatggtaagaaatcacatggcctggcaagtattgtgcaaagtgcccatgggacctgcaaatgaagccactgagcagggtgggggtgccgggctgtggctgggagagacgctgggcttgggaatggccatcagcagatggacctagtttaaaggcacggcagaggtgacatccttgagggaggtgtgcagggagagg

SEQ ID NO: 394958 - DNA, 379 bp, Homo sapiens
tcttttttttaaatgtacacatttacaactgtgcatttcccttctaggcactgctttaactgcatgcacattttggtacattgtgtttttattttcattcatcccaaattatgctttaatttcttttgatgtattgttttacttactgtttatttaaagtgtgttgacatatttgtgaatttcccaaatttctttcagttactgatgtttagtttcattccattttggtcagagaacatatactttatgttttcaacccttttagttttattgagacttgttttatgctgtaaaatatcatctatactggagactgctccaaagtacttaaaaagagtttgtattgttctgttgtagggtagtgatatagatatccatg

SEQ ID NO: 394959 - DNA, 352 bp, Homo sapiens
tgcagctggtgcacttgactctgggcagcgcgttcccaggaacccgcaggacactgaggaccgtgcgtgatgtaacccagatctgccagatgtgggagccagcatgagtcacaatgccgggccgttcattaagaaatgctttctgggtcatctgggtgcagggcactgctgcttccctgctgtccagggttggaggcatcaagtctgcccaccaggaatccccaagttcatgaacatctgtctaaaattatagcctggttttctgagccgatgtggcacagagtacacgcacgctgatggtctctggcttgtaatttgttaaaggatctcaccactttggttagtggtggga

SEQ ID NO: 394960 - DNA, 144 bp, Homo sapiens
  misc_feature (101)..(101): n is a, c, g, or t
tgcgttgttcaacggtcaatggtacataaaaagcatgtcaatctcttttcttgaccaaggataatcaatccctccatctgtggccttgatcccatctattnctagaaatatgctcctttaaattattttggttctttcccaaat

SEQ ID NO: 394961 - DNA, 308 bp, Homo sapiens
tgcacaccacagctgcctgctccccactgcacagcctggctagcttttgatgccgctgccgcgatgttgcaccatgtacactccaaggttgcgtcagcctaggacctttgcattgcttgctttcttggcctgaatcttgctgctctttgatcttctgttgactggctccttcttgtcactcagatctcagcttaaacattatcttctcagagacttccctgattcccaagtcatagcacagcagatcaccttaccttaactcttggtatagcactcatcaccatctgatacttgtcttgtttatacct

SEQ ID NO: 394962 - DNA, 258 bp, Homo sapiens
ggcgtcatcctcatgctcaacaatagagctgtgtttctgtgcaccaaccgcagatgctgggtctggcccccacagaaggagtgcctcagtagggcatcccaaatggggctgtgcatagcgtcactccagaggctggggacagtgcagatccagacctttcccagcctgttgagttagaactgggggactgtgctccagggcgtgaggaggtgggttgggaaatggtattttaaacaagcgaagtgattgtcatataac

SEQ ID NO: 394963 - DNA, 291 bp, Homo sapiens
cgaaagtgaggggcgcggcggggagggggcgacagccctggcttggtgctgagccgtggcgctggggaacctctaggagccgggtggccggtcagtgcgggcgttcccggaaccgccaaactttctccgccaaccgaagttagggactccgaggacagtgacgaggaggacaccgcggaggggggtctcccgtcacctcccgcctccagtagccgagggagaaggcgaccctgagtactaggtggccccgagcgcgccaccccggccccggggcgcctccctcgcggccgc

SEQ ID NO: 394964 - DNA, 609 bp, Homo sapiens
cctggtgtcccctgttatttctgctgaaacatacagtcccaggccaggctgctcagtatcctcagggtttaaggacaataggaagtcccatcatcacccatctctaggatgtcctcagacagggaagctgcagagaaaacacacctagtggggcaaagtaggactgtgaagctggaagggacccagcacctgtatgttccaggtgaggacccacaggtgggtcaggcaggcatcagccagtcagggaaggaccagaagtgcctggggctgtgactcccagtcctcggtctgtccacgacccaacactgctgctcagttcacacttgagaaagtctgtgcttctctcacacagagcaggcggcctcacggtctctgagccctcagatcattgcacatctgtcttgtgaaacacacacttgccatgggcttttagggacttgggttggctgagaggtggggagatgccaactctgattgaaaaatgcccggacggaatcccagcactttgggaggccgaggcgggcagatcacgaggtcaggaggtcgagaccatcctggctaacagtgaccatcctggctaaaatacaaaaaactagccgggcatggtgg

SEQ ID NO: 394965 - DNA, 498 bp, Homo sapiens
cctctgtgagtcacctttctcatgcttaaaacggcagtaaattacctctacctgccagggttgttgcaatgatctgaggaggtgccttatgcaaagcacagttcatgtgctcggggcaaacagtggaaaaacaaaccaggaaatgcttctctgtctgtctgtgcctcctacctgccacaggagaactgagggtagaatctgtgtacccttctcagcacaccacaaatcctagtcacttagagagacacagactgcctacaaggctagtcaactcccaaccacctttgcagaagggggagagagtgggagtttgtgaagagcaaaagcaggaattggatgggaaaatggtctagggctcacgtggagtgacccaggacccagagtctcacctcccaaggctaggccttgtagggcagcagggccaagcatgctgcaggaaagaacacagagtctggagccagactgttcaggtttaaattttggctctgctactactag

SEQ ID NO: 394966 - DNA, 313 bp, Homo sapiens
cctctgtgagtcacctttctcatgcttaaaacggcagtaaattacctctacctgccagggttgttgcaatgatctgaggaggtgccttatgcaaagcacagttcatgtgctcggggcaaacagtggaaaaacaaaccaggaaatgcttctctgtctgtctgtgcctcctacctgccacaggagaactgagggtagaatctgtgtacccttctcagcacaccacaaatcctagtcacttagagagacacagactgcctacaagccacggtcaacccacaagccacggtcaacccacaagccacggtcaacccac

SEQ ID NO: 394967 - DNA, 296 bp, Homo sapiens
ctgaatatatattggtctatggatatattttcacaattatttctttgttaccaatttagagaaaataaaattaaccatttgactatggaaagaacaactgcatatatgtattttaaaaggaaacgaactcaataagaagtctcagcttgatgttctcggacaaatcctttgtaaccaggcctcaccagcaataagaaaaatcaagggcccagatcataattgaaagagaatttgggaagctttgaaatccagctctccctcactgttggcatagaaaatatctgggggtaccgagc

SEQ ID NO: 394968 - DNA, 587 bp, Homo sapiens
gagatggagcacagcttcagcttgcctttcaccaccaccacgtcgttcttgcgcctcttcttggctttccgcttgcgcttgggtatctggcttggggggcggagtggatcctgctttctggcggaaatccttagcaggccgccggtggcgatcatggcgagctcctggagtgcaggactagcctctgggatggaggcttgcacagggagggcgccaactgcccactagctgctcagccacctcctcctgccagggagaccgagggaggtcggggccggcgaacgggcgctcgggcgacacaaaggaaccatggagaaactttttcagcccgagccgacggcggagcgcagggacagcgccccggggccccgcatccgagcgcggctcagcagccccgcgggggcgagcgcccgccccaggctcgcagtccccgccggcgctgtggcgggagccatttccaagagtttccaagaagtgtcaggtcctccgcatcccgcatcccgcctcggagccctcctctctgccgctcatcctccagctcccggcgtcccctagcgcggcgctcccgggcgggcccctgcggccgc

SEQ ID NO: 394969 - DNA, 432 bp, Homo sapiens
acctacctcttgggttactcatcagttttactttttttcccattaaatgttgcttttagtgttatgttttctttatactcattttgctaatctctttcaaacacctggaaatgacatctgaattttttaaacatttaattgaaatatatattcacaaaagagtagaattacaaaggtataatgcatcattaatttctacaccttgatgcacacatgacacatctaaatcattgcccctcttcgcaaatggaaactattctcacttctaacggtataggttaattttgtctgtttttaaactttataaatgaaatcatctattcatttatgtctagcttttttgattcaacattatgtttatgagtcatccatactgttacacatatagttcttttccttttaccgaaaagcactccataatacaggttgaat

SEQ ID NO: 394970 - DNA, 537 bp, Homo sapiens
caccgctcacactgatctctttccagcctcggctggccctcaaatccctgtccagactggcctcttccatgcccatgtccatacccacatccatgagggatgctgccagcaaatcagcctttttctcaagccttctattagcctccctctttgcctcctgatcttggttaatgtacaccttcgtggccacttcaataagctgagtagcattcatccctttaaaaccttccattttctgcaattttcactggatatccccctgggcctgctctacaaatgccatgttcatcatgcactggcctcaccaagtcttttataaaaatggctggggctttcatctgcaccctgatgcccctctgagatttttcctatattgattgcctgtctcccgccttcccttaaattttgcaggagtgcctcttggtatcttggcagctgctatagttgggctgcctcattcctttgggttctagtgggggtcctctagtttccaggagaggcatttgcatagccctaacacaacctgactggaggtgg

SEQ ID NO: 394971 - DNA, 391 bp, Homo sapiens
agggtggataaacaatgtttggcttctcttaagtaagacttaattttttttaggtaatgaaaatattagtacttttgtatattgattgccagaacaaagccagaactctgatgcaagtttgtatacctgagaaggtactcaagtgggagggatagaagcttccttttgatgctggggtgggttgttctgaggtaacaatgatttatttctgtatttctttttctttttggagacagggtctcactccgttgcccaggctagagtgcagtggtgtgatcattcctctttgtagcctcaaccgcctggctcaagtggtcctcccatctcagcatgtagctgggactacaggcatgcatgtgccaccatgcctggctaatttttaattttttct

SEQ ID NO: 394972 - DNA, 374 bp, Homo sapiens
aaacgctaagtaatattatactatggaatatgaaacaagacaacaaagaaaaaaagagaagtttatacagtaatagaaagttagaagagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgaaaaaaaaaaaac

SEQ ID NO: 394973 - DNA, 300 bp, Homo sapiens
ttttttcatccctcccctcccccttcctccccggaaaccagagactttgccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgaaaaaaaaaaaac

SEQ ID NO: 394974 - DNA, 1292 bp, Homo sapiens
ttttttcatccctcccctcccccttcctccccggaaaccagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgaaaaaaaaaaaac

SEQ ID NO: 394975 - DNA, 976 bp, Homo sapiens
gagagttctctcttaccgagaagtccccactcatcccctaaactctgcgttgcagctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgaaaaaaaaaaaac

SEQ ID NO: 394976 - DNA, 1156 bp, Homo sapiens
ttttttcatccctcccctcccccttcctccccggaaaccagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactggctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgaaaaaaaaaaaac

SEQ ID NO: 394977 - DNA, 373 bp, Homo sapiens
atgttttcttatcaaatcaaacgtctcgatcattcgcattagggctttcttcattgaagagcctcttgtatgttcatgctgcttctggcatcattcaagaacattgtgcaaacattcactgagcacctttgagcatttacagtgtaacagagccccatgctagctgctggaaatacaaagatatcaagacaaaatccctgctgctctgtgacttaacagtcccatgaaacacggggggcagacaagttacaaaacagtgtgacagatgtggtgatagtgatgggcatacaatgtcagtgggcccacaccaccaactacagcacatataagctgagtttttgtttttgttttttttggccggtggggagggggg

SEQ ID NO: 394978 - DNA, 453 bp, Homo sapiens
atccttatttacaggtcgggcatgccaggttcttaggcccatttctgctttccttctccattatcttgctttaccaggtagactttctcttctgccttcacccatgtctatgccttctaaacaatgtctcccatttcatctcttttccctttcagagctcccccttctttcatggccaggcttctgtgagaaatgttctattgtcactgcttctgcttcctcatttccaccttcatcgtttcatctagtctccctcaggtctccgttgtcaaatccactggtgtctatttaatgttaatcctacttaacttccctggcatttgacactgttgcccacccttcctagcaattcctccttcctgcccgcatcctctgtctcgctaccctgctttctctctggtatttatcgctttgtagcatactatgtaattgtgtgacctattatctgtctct

SEQ ID NO: 394979 - DNA, 108 bp, Homo sapiens
aagaatgggcacagaagttaggaagggctgtcactggtcctcagctgctcctggccacctggctcatcttccttccacatccctcccactgcaaaacctcacccatgt

SEQ ID NO: 394980 - DNA, 582 bp, Homo sapiens
gagaagggctggtatgggggtggagggaggtggagggaagagaaagtcaggcctcctctgggtcttggggctcagccagggatggggcagaggcacagatggcccttacctgggacccttcccctatacctgtccctatagctggtctgccagccagtggagcagccagtcgccccccgacccccaccccggaaccctccctcatgtcctgagtgtgggtggcaggaccagtgagaacacaattgaccttgccctgagaggctcccagctcaatgaagcagatgcagtctacctccagagaggaggtgagcctgtttccacctgtctacacatgcaagatcccctgttctggggaaagaccattaccccaacctgcctcatcattgacatgtcacaagagtccagccaaatgggctactgatttccaggtcatccagtgcaccacaattctagtgaaacctcatatccttgcattgccattggtgtggtagtgaagaacgtggcttctggtttcagactgcaaggggtcaccttttggctctgccactgatttgctatgtcacattgggcaagctggctaac

SEQ ID NO: 394981 - DNA, 453 bp, Homo sapiens
tctcagtctttcctttcctgcctccctccttggtctcccccacagcatcccagccccattctgcatttcccatggaaatccaagtctcagagactgttccagctccatcctggtggggccccaggttttactgaggagtatctagaccagtatttctcaccttttaatatgcaacacgcagcagggcacaatggctcatttctgtaatcccagcacttttggaggctgagactggaagattgcttgaggccagtagtttgagaccagcctgaccccttttctacaaaaaatttagaaaaaaaaattagccaggtatggtgctgtgtgcctatagtcccagcaactcaggaggctgaggggggaggattgcttgagctcaggagttccaggctgcagtgagttataatcatatcactgcattccagcctgggtgacagagcgagaccctatctc

SEQ ID NO: 394982 - DNA, 259 bp, Homo sapiens
ctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttct

SEQ ID NO: 394983 - DNA, 570 bp, Homo sapiens
aatcacaatccccaacgtgctgggtaaaggaggcagaatggtgtctacagagctgactgcaaatttcagtgaataatgacatgtatgatattcttgatctataatttaccctagtaatctccaaatcaaagatagattttaaaggaacagaaagataaccatttgtgttactccgtgaatttaacaaaattcagaaatttttccaaaaaggaattaggagtcaaaatgaatatggtataatttcttaaaaactcagctacagaagactgttaacagctctttgaaaacccaatttttttttatccagattttactatttggaggggttaagtgtgagaggccagatatgaccagggtgtagcagccaccgggagtcctgggttctaaggggtcttgaatgtctcagcatcaagggtgaggaaggtgacggtgcgttggcattaaagaaatgggaagggtggttgagtgtagagaagtggaggagaagaaaccctagccttccctttgttctggtattttatccccaatggatcctgagaactaacttccctgtaacaattttcatttaac

SEQ ID NO: 394984 - DNA, 370 bp, Homo sapiens
actttctctaaccataaaatggagatgacatcgcatcttgtgaacagttgttacaggaggaaatgagattacatgtgtcacatgcttcgctcgttctctggaccgtaactcgtacctgtaagtgtccttccttcctttctccccaccacttactctcatctccctcttactcagtgttgtgttttctaagatttaaaaaacagacaacagaaaacaatattttaatccctttttatgttaggatctgaaaatctttagatatttcctttctccctttcattccttcattcatttttggctttgcaccaggacttatttcttgagggtcagataagccctctgacctcagggaggcacccaggttaatcca

SEQ ID NO: 394985 - DNA, 614 bp, Homo sapiens
aggcttctgtctctccatcccgctgtttcagggttctgcatcctgctgtttcggggttctgcatcccgctgtttcagggttctgcatcccgctgtttcagggtgcacgtttccttctcgggcttggctccttgggtcatgtctccagcctgacgttccagctgagaggtggtgaggcaggaaggggtgtctctgcatcaggaaagcgatagggagttcaggaaacccagtgtctctcattggctggaagagtattacacggctacctctggttgcccagatgcctggggcagggtctgtgctcgagaaaataaggctctgtgagtaagggtctcccacagccagatcaacaaggagctgtaggctgtaagtcctggttcctgactgagggaggcctaaaaagtggggctgttggggctttatatttagcacccactttttaccctctcaaattccagaccagttgagagagccgcacacactgtagataggcaagtggagatcagatacaggctctgttttagataaaagcaactggagaaagtggctgactggccaagcgggtttgctaatcctttatcccaaattagacaaacttcccacctagtaacgagc

SEQ ID NO: 394986 - DNA, 130 bp, Homo sapiens
taccaacaataatctaacttgtcctgcacctgctgttggacctcctccatattattacttctgccactgactcccaaaagccaggttattaatctgaagacaactcaagacccaagccacatcattactg

SEQ ID NO: 394987 - DNA, 250 bp, Homo sapiens
actccccccttcttctcccccattaagtaacctctcccctattaggtatataaacccccatctttagttgtttagagtcacatttttctgtgtgctcctgcgtgaataaaaatctatgttttgtctaagtttaattcccaggccctcaagaactgaacctaagagagtagaggaaaagattttcctctccaacaaacattacttacaaaggtaagtaatttcatcttcattaaaaacatgagaaaactta

SEQ ID NO: 394988 - DNA, 392 bp, Homo sapiens
accgcacccggccaatgtatgtatttttaaacataaccacatactgttatatttaatgcttctgaccatgtcttaagaaaaaaacaaaaactccctttggcttccttgacatcacagtctctctgtttctctgactcttcttcctcatctcctatggctaaattctctccctctgtccactgcttacacatgggcatttcacaatgtcctttttccctgaaggaacttaccccctcccctcagccttaagtaccccatctgtggggatgatgcccatgcctgtagtcctgactcactcaccacgctctatcgcagttatttactgatgcatctctctcccctatcagacgctgaggtctttgatggagcaaccttgtatttgtccgtgtatc

SEQ ID NO: 394989 - DNA, 458 bp, Homo sapiens
tcatcatcaccatcatcacagtcattactatatcaccatcaccataattatcaccatcatcaccattaccactgtcatcatcattgccatcatcactaccaccatcatcacaaccatcatcaccatcagaatcaccattatcatcaacatcatcattgtggcagctgtcattcatgagatcccacaatgcacaaaatattttcctgtattttattcctttggccagtactttttatatcccagtgatgttccatggaccatcatggggctggggaaatcagtgacacaattaaacaaccaacgatacaatgtgtgaggttggcgatagaagggattaagtgtcccaagggagcagggagttgtaaggcacctggcttcaggacaactgctttacagcatgctataaaagctgagaagactagcatgaaagggacttggatggtcaggaggcagaggag

SEQ ID NO: 394990 - DNA, 650 bp, Homo sapiens
gtattgttactctttcctggctgggaggaaatttattgaaaaagcttctcaaatctttttttttaatctaagtttcctatatgttttttttccatgaaaaggagtaatagatatatcagaaataaaggctaactctccagcccctgctagaaattgtgttgcttaggcaaagattcaaagatttcattgtagaagctctggctttttagaaatttgttttttagtctccacatttattatgcttctgtgggagggtgtaacttctgtagattgaggggaacagacagaatctgatgagtacaagttgcctctacaagagcattcacagtcttctcaggaacatctagggaaagagttcctcacaaggcaccacttctgaggggttacattatatcttggtcaaaaaggaggatccaatatggttttgtgtagaatatgaccttctaacagaagtggacttaaatttttttttctcattttggcatcttatcccttccaatggaattaaaattctgaattcctttttttcttaataaaactattttttaaatcctattacaaatatatattcattgtagaaaacttgaaaacatttttaaaagaacaaggacaacaataaagaaaattcactacctacagttaatattggt

SEQ ID NO: 394991 - DNA, 229 bp, Homo sapiens
aatttaacaattctttaataattgtctttttattttacaatcaataccaagaaaaacctcagcctaacctcatttcaactcaaaattcaaaatcaaataagtcaattcacataataccttctactaaccagaaatttcaaagaacaatttaatactgtagatggaattcaggggcttagataactgattacattctcatttttgtgcagaaaaccatatattcttctaa

SEQ ID NO: 394992 - DNA, 201 bp, Homo sapiens
cttgctgtggagtgactatctggagtgtaacacatcccctggtacccaattagtcaagtagaagaaaatccaccacttactttccttgaaagtcaagtcactctctgattctttaattcattaatctgtcagtgaatggcaggtttcctgatttaatgagatccaaaagtttcaatagcctgtctgcgaaagtaattcaac

SEQ ID NO: 394993 - DNA, 1357 bp, Homo sapiens
gaggaaaacccttggcccaggagagatcacggaaggctggtcacaaaccaagccagatgttgactttcttaagaccagcgaatagagacaggagtttcttttatacttagagaaaccagagagtttcacggtagcgtaacaacacgagtggtaagagttgtctatcagaaatacaaagccagacccattgctctctgaagaagccacacatttcctagaagatccagccttggctactcttccacttagtatccacagctactagatacgctacctcacacctgtaacccagatgtcataggtctcaggctgggtactcagtctttgccttgcaccttaagactgaactttgatgcattgctgaaataaatttaactccacaatgagaaataaaatgtttaatcaaatttaatggggaattattgaagagaggtgcatgtacatcacagaggagaagcctatctggccacctccgtgatccccccattatccattaatgttcttctcctagtctcagctccccacttctctcctttctcctggaaattcccatctatgcagcctctggccactctggatccactctgcctcctgcctctcagccacacagtatgcccattcttctgtggcatcatttatctccctccggttttctccactgtgaatcctcacacatatcacttaacttagtaagcaagtctccatctgtcttgaaaaaaagaagaaaatgatgatggaatggaagaaagagaactaaaggagagccatcaaatcagacaaaagctatctgtctctttggagagacaacctctggcctcatccactgcattacattcttagagcttgtagaagagcggttattaaatattttcaaggctacagactccttcaagaattgataaaagctatagaacttctttccacaaaaatgcatgtattgcacactgaatgtctgcatgcagtccttgaggggaggacctctgaggcctatctctgagtctgcagtgtccatgagcccatgtcaggaattcctgcaacacacattatgtgattttaaaatacttaaatgaaagttttttccagtgtcctccagaagcaaattccattaaacaagccaatgtgtataatattaccctagaaattcgagagttggtgtaatgcaaatgggagatatgagcatgtgtgtgcatgtgtgtgtgcttgtgtataccttcacatcttatctataaacacatgctaagaagtcatctttagtttcagccttattcctataataaaaatgtcaagtcttatgaggtggatagattcataggattattataacccccattcaatcaacaaagaagctaaagtcaga

SEQ ID NO: 394994 - DNA, 112 bp, Homo sapiens
aaggtctggtgacacagcccacatccctagcctcttttaaaactttgtattccacctgctgatagaatgctctgcactcaggagcaccttaaaacatttatttcatggcaca

SEQ ID NO: 394995 - DNA, 241 bp, Homo sapiens
ttgattcaaagtgccaaggacattcacatattttcgctattcataaccacttacccaagagggattaaaaagagagagagagagagcgcgctacataaaaatcagaggcttataaacaaatctgctctttgctgaacacatcatcctacagataaagcatcatgcgatacagcacaatgaaatggatctatggaacttgctagttcatcagcactctgcaaccaaagctacagttattatt

SEQ ID NO: 394996 - DNA, 225 bp, Homo sapiens
aggagggctacttttataagggaaaacgcatatactattgtcaagaataaaaacttttttcagactgatcattttagaagaaatttgaaaaagaatatacttgtaaaaaaagacaactgaggccgggtgcaatggctcatgcctgtaatcccagcactttgggaggctgagatgggcggatcacgaggtcaggagtttgagaccagcttggccaacatggtgaaa

SEQ ID NO: 394997 - DNA, 306 bp, Homo sapiens
tataggcgctaggtcaaaaggcgaaagctccatggtaaacccctactttgccctatattcctttgagatttcacttcaggtcaaggaaaaaattatgttgaatgctgcctgggcttcatcccagtttggttctatttttgcatggaggcatgacttgtatctagctcccctttttagctctgaatctgttctgtcctgttaaatcagataaccactacctcccaggttatagcaaagttgaggtatgattctgtagagaaaacagcaaacccaggccctcactgctgatacatggcagttttcaac

SEQ ID NO: 394998 - DNA, 409 bp, Homo sapiens
cttagtttcatcatctgtaacatgaagagaataacagtaacatctatcttacagggttgtggtaaggactgaatgagggattcatgcaaagtttttagaacagggcctgatatatagtattgctaaataaatattaacatttgctatcactgcttgaagcctcatattgggtgttattcccctttaagccttctctaatccttcaagtctagattagcccccatcttggatgcttctatagtacctcatcagttatgcctaaggtggcactcatcatacttgtccatgctcctgccctctgcatcaccttctctcccttccaattatattttctgtattcacctttagatctgcagtgtctagtgcaattttatttttagtctctaaacttgtggcaactttctcatca

SEQ ID NO: 394999 - DNA, 359 bp, Homo sapiens
ccataaatttactttgggaggcatgagaatgtaacatagagccgtggatcactaaagtctaacaactactgatatactcaaaaggcagacaaatctattgtcatatcagacagacaaaggttatggtggaagaggctgttacaacaataatgagatggtgaccatccggcatggagcaacaggtgccaaccaggatacccagtattccaactcctagtccaataaactttccaccctgcgtgaagatgcattcatcccgtgcacacttagaacacgttacagcatttactagcttatatccagaaggaaggtaaacttttcaaggcaaagctaaaatacaatagtcttgagtcagtttc

SEQ ID NO: 395000 - DNA, 275 bp, Homo sapiens
ggcaagaagggaggagtaaaccagtatagcagtctagaaagttatccccaagagccaaaatgccagagcaacagacatgaagttactcttcataacatcaatactcattaagtttataagccagaaggctgagagactagtggaaacagggtatcacagtttttttttgagacagggtgtctctgtcacccaggctagagggcagtggtgtgataatggctcactgcagcctcaacctcctgggctcaagcaatcccgagtagctgggactatgg

SEQ ID NO: 395001 - DNA, 256 bp, Homo sapiens
gagaggcagtgggggccagaggcaaaggcccttcaatgccaggccagggagctggacttcatccgggggcagggaaggttttaagcaagggataccctggtcccctccagtgcctttcaggggacaagggaggtcggtaccgcataccttctgtccccaagttttctgtgcctgagctagccaggcatgctttccccacctgggttccctcagttgctcatggggtgcccctgactcagcttcatgcctgtggggg

SEQ ID NO: 395002 - DNA, 708 bp, Homo sapiens
actctgcctcagttacacaaataggaaatagaaaaacctctctttatgctcagtgtgtatcactcgaacttttcaagttaaatgttatcaagcagtaagtgtctgttcttcactctgacaatttctttgctgttccttgtaaaaagttctactgcgcattttgttgtggtaaaatatacataatgtaaaatttatcatcttaactatttttaactgtataattgagtggcattaagtccattcacagtattttgtcactatcaccaaaactttttcattaccccaaacagaaatctgtaaccattaagcaataattccccattttcccagcccctttctgtttgtgtgaatatgcgtattctagatacctcatataagcagaattgtacggtatttatcctgttgtgtaaactgattaatcagtttacacaaattacattgtcatgaaaaacagaagaaaaagccccaaagtctttttcggacctcccctccttacccaaaatacagacacacaggcaagaactctcataaattcaaattcatcatttgagaggttgaagcctccaaggattcttctagctccagggtacatccactgtatgcttccagatgttttttccagatttcaatgtagtgtggctcttctttttcttttagggctggggggcatcttctgcaggcagctggggcctgtgtgggtagctgaga

SEQ ID NO: 395003 - DNA, 542 bp, Homo sapiens
tctagcagaattagctttctgatcttggactatgatctaacctcattgtgtctcctatctacaaccagtcaatgcctctaaaatatgcaagaagaatgagacatagtaggtgtaattgtctagggtgccctgaaataaggatacactttctatagtgaatggacagtgagtaactggatcatgccagcagtggaacatctccattgctctctttccttggctgattcaatcatagcaacccagcagcgttttcagagtatcttccagaatgatacaattttcaccttaatcctactctgaactgatttgcaaggcaaattagtgttaatctcctgcttatttgaatagctggtttctggcctatatacaagaaaaagcatattataaaaacacactcaggccggcgtggtggctcatgcctgtaatcctagcactttgggaggccaaggctggcagatgacgaggtcaggagttcaagaccagcctgaccaacatggtgaaaccctatctctactaaaaatacaaaaattagccgggggtgg

SEQ ID NO: 395004 - DNA, 291 bp, Homo sapiens
gctctattctatttcagttttaaaaaaaatgctggttttcccttaaattgatattttaaactataatggattgcagtctccagttggaaaaacatggacttaaaatttaaaaatatgaatcttaatttctgctttacttaaaaatcagtaaagatgaattttgaatgaaaatgtacaaggtaaaataaaacctaggtgtggaagaatatctttatgacgttagaagaaaaaagatttcttgagcaagatgacagcataaataagaaaggaaacaattgacaaattaaactt

SEQ ID NO: 395005 - DNA, 427 bp, Homo sapiens
acgtgaacatttttatatacatacacatacactcattaaatatgctgagtacttttatgtcataggcaaggaaattggcactcagagaggttcattgtttatagccaattggtgctagaaagggtcagtttaaatccaatactgtctgaccacaaatcttatgccattaatctcccagtactaatcttaaattctgggcactttaggaatgctcttagcattctatactgttctcagcgtacttcagtttagcctagttagtctagaaaagttcttgacctgtattatcttaaaaacagatcgggcacttttcttcaagttgcctgcttggatctcttggaagtgttctttcctttctttcctgttctaaagtctttttaataaatttccactcctgctcctgctctgggaaacaaacaaacaaaca

SEQ ID NO: 395006 - DNA, 332 bp, Homo sapiens
ctctgtgcctttgtctccatgtaaatgaacagcaatcataatacaccaaggtaccaacctcgtaagttggttgtgaggatttaatgcactaatacatgcaaagcaggtaacaaccactcaatcagtgtgaactattactaattttttttttctgagatggagtgtggctctctcactcaggctggagtgcagtggcacgatcttggctcactgcaacctctgcctcccaggttcaagcagttttcctgcctcagcctcccaggtagctgggattacaggcacagccaccacacctggctaatttttgtatttttagtagagacggggtttca

SEQ ID NO: 395007 - DNA, 537 bp, Homo sapiens
ttgggggacttctggaaagtaaataaggatctgagtaatttgttttctaaccatgtaaactattcttgcaaaagtagtatctctgatagctataacttcattttttatcacttcttcctatttaaagtactattataacatgctaacttgtatttctccctctgcctctcttctttttcagtattttatatacacatcacttcttcatgcagagctgcaaccatactcctcttagcttctgccaaaccagactattatgtagtctttgaacatacctaaatataccctggctttgggcttttgttcatcttgtttctcctgcttgtcaataataagcattgcttgaggaacttctatatgccaagctctatggcaggcataacatagtgaacaagaaatggcttgtgccctcatagagtatatactgtagtaggggagagagacaaaactcagaaagacacatgaaatgactgcacacaagtgccaagaaggaaacaaacatgaagcaaagagagaataatagttgttaactactta

SEQ ID NO: 395008 - DNA, 125 bp, Homo sapiens
aatggtgggtgccaggagttggggaggggatggagagtgagtgtttcatggggacagagcttcagtttgggaagataaaagagttctggggccgggcgcagtggctcatgcctgtattcccagca

SEQ ID NO: 395009 - DNA, 228 bp, Homo sapiens
attactctgcttttttggaattctgaaccatatgaatatattatctactcacaagaacttaaaaaaacttttaaaagaaaattgtttgtacaaaaatttactaacatcttaaataagaacactagttccagttcttaagctgcttttcatggggcccttttcctgccaaaaacggggctcaggaggggaaagcattgtctactctccctacagacctgaacttggatg

SEQ ID NO: 395010 - DNA, 497 bp, Homo sapiens
gtcaacacaagtctcccagccttacaggcatttaataaaacactcaatactttggattctgttgattgctatcagggtttttcctcttcttcttctgcttctaaagggctcagttctttggacctgattgagtgctataaggcagttcattctagggatccttggaatgcatatacccaaacaaaggccttgtgccaaacataaccagcacgtacaccatttttattttcctatgaccaatgacttagtttctgtggtcagttagtgacattagccatgtagaatcacattgaggaagaatgcaaagctttctatgagcccctgacagcttcagttttcctctctaataacatgtatgaatcagaagccactagtttgcatttcagaaatatttgtggtagttaggaaacatactgcacttattgtattcccatagaaatagagtgtccttgggaagaatggaaaaatggcactgagacatccaccaagatataggc

SEQ ID NO: 395011 - DNA, 340 bp, Homo sapiens
tgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctaccca

SEQ ID NO: 395012 - DNA, 335 bp, Homo sapiens
gtacaagggggcaggagggatgatccccatggggcatggccactggctgtgagaaacacaggagagaggccaggcagctgcctgggcagttaggttcaccactgcatgatggcagcattgagcaggttggcttccttcagggtccagctctcgtcagccagctctttgtttgggaaagtagtcatgaggataaagctggtggcagccatggctggccgggcatccacaatgaagagttggatgttgctgatcctgtggctgtggttaaatttctgcaccagcctcccaccgtctgcaagccgaatttggatgtttgtggtagtctctgattcgac

SEQ ID NO: 395013 - DNA, 115 bp, Homo sapiens
tcaggtaggggcttctagattcttatattttccttaaaggagtcaaattcacacaaagagtagcatggtggctgccaggggttgggaacgaggaggaaacgagtagctatttttt

SEQ ID NO: 395014 - DNA, 390 bp, Homo sapiens
aatccctatcctactggagcccctttccttgggttacttcacagattatctggtttataatactgattctagaaaagtcgagaactagcacatccaaaatagggtggtctctgaaaataatcagcgagtaaaatcccaccatgtctattgtctcaacactttggttctgaggtctgcatgctatctctgactctctgtagcgttgaattgaactcaacaactttccctccaaaaccagctcttcctcttgacatccctctgacaccattttaccactttcccatggtccaaacccaggattctttgactcattctgtcatttagaatcttatttgggcacctaataggtacaggcacatagaccctgtagcccaacagctgaaatttgag

SEQ ID NO: 395015 - DNA, 307 bp, Homo sapiens
ataatcaatgcttaatgcacatttgagttaaagtaacttaatgctaggaacgatgtaagacagttaactgagtaagtaggggccgaacaaatgatggaggtcatgagtgctgtagaattgaaggaagagaggttattggactatcacaggcttgatgggcctcagagagagcgtttcaggcagggaaagctgtgtaaacaaagacagggaagcaggcaaggacaagattgtacaagaaatagtgaaaaagactggcccacatggagtagtattggagaacttttaagtaggaagttgtgaagggaca

SEQ ID NO: 395016 - DNA, 324 bp, Homo sapiens
aggggaactgggaagctggggagagatgaaggatcactttcgtgtcatttataaatcttactcattgaaaacaatcgacttcccgatgcaatgtagtatcccagaacagaaaaagggccttagtggggaaactggtgaaagcagagaaaagtctagttggtagtgttgtaccaatgttacatttcttgttttggcaaatgtacgaaatgtagttttcgtggttgtttcccagttcataattctgtcctatacatttcttctccctcctctgtgtggaactcacacagaaaaccttgaacatcttccattgtttcctgtgcctag

SEQ ID NO: 395017 - DNA, 653 bp, Homo sapiens
ctatgatcatagactttacagatttttattttctgataatttgtattcatccattcattttccaacctgctttttccagttcaggctcttggatggtgagagcctattccagcaactcagggaaccaggctggaaccagccttgaacaggacaccgtcctgttgcaggatgcccccatgcacacacgcacactcactcagacatggacaatttagacatgcctgtgaacctcttacgcacatctttgcaatatgggttttttttcccttatttcattaaaaccgaatcatgatgaaccaaacaacattatttgagaacctgctgtagtcttttttgacgttagtgttttttctatattataaccattctagtgtgtatgaaatggtatctggtttttgttttgttttgttttgggacagggccttgctctgttgttcaggctggagtgcagtagtgagatcttggcacactgcagctcagcctcacaggtcaagcaatcctaccacctcagcctccccaacagctgggactataggtgcatggcatcactcctggctaatttttgtagaaacgggattttgccgtgttgcccaggcttgtctcaaactcctgagctcaagggatccacccgccttggcctcccaaagtgctgg

SEQ ID NO: 395018 - DNA, 273 bp, Homo sapiens
atacatatacgaatcgagctgttaccagatatgcagagaaccccagagtaaaaggggaaagagacccggaggagacagggacggagaccggagaaacagacagagacccagagagacggagacagagacccagagagggaaacagggacccagagagagggagacagacagggagacagaggtgagaaagagacagagactgggagaaggggagacacagagacggagatagatagacagatgagatccaagaaaggacagagacctggagat

SEQ ID NO: 395019 - DNA, 667 bp, Homo sapiens
gtgggcgcctgtaatctcagctactcgggaagctggggcaggagaatcacttgaaccccaggaggtggaggttgcagtgagccgagatcacgccattgcactccaggctgggcgacaagagcaagactgttgtctcaaaaaaaaaaaaaaagcctttaataaaactatgggaaaaaaaaaattttattacatactgttttaaccaggaatgtatctgaaacaaaaggctacagaaatattgaaaattgaaggtaaaataatggaaaaagatattacatgcaaatactaacaaaaagaaagctaacataaattattaattttagacaaagtagactttaagataaatgacattactaaccatgaaaaatactacataatgataaaaggtttaatttaccattatcaattattgtatgagaagatataataattctaaatttgtatacacttaataatatagttccaaaatacataaagcaaaaaatgaaaaatctaaaaggaagaatagacaaatctgcaatcttagtgaaattttatgacaccttttagaaactgatagaatatgttaatggaaaaaattagtaaagatatagaaataccatgtttaacaaacttgacctaatatacattcctagaacactgtactcaataactgcagagtgaatat

SEQ ID NO: 395020 - DNA, 260 bp, Homo sapiens
cttgaggaaggaaccttttggtaagatgtgtgcatagtgtgacagcgcattctatgaatgactgaggaactaaaagaagtcaagacagctggagtttcttgagcaaggaggcaagtggagggagatgatgcagaaccaagcactggctcccatcacaagggccttggatgccataataaggatctggtactttattctaaaggtcttgatgtctattaaaaagatctcaagtacagattttggaaaagactgtgccagcc

SEQ ID NO: 395021 - DNA, 431 bp, Homo sapiens
tgactccagagcatggcctcttcaccatgctgctgtctttcctcagtttctctctcatgaaaacacagaaggaaaagtcacctgcctgctctccagcccttgtttgagccaccccaccgggggcttctccaagcccagaagcagccaccaagaggggtccagggagcagtgtgtgcaccaaaccctactctgggtgcttcttgacctttccctcctttaaccctcatagcaaatgctggaggtcggtgttattatttgcattttacagagaagttcagggacttgttcaaggtcacctggtgcacaggagttgggactcccaccgaggcagccgtgcccacctctgcagtcagcacctcccaccaccacaccagcccgcctggttaagtgaaccaagctgaacaccctcacagacactaaatttatatttc

SEQ ID NO: 395022 - DNA, 569 bp, Homo sapiens
ggtttttggaaatatttcattttgctttggaagccactcgagcaaacagttatttaaatgtacacatttggcagtacaattccatttttgtttttaaaactgttcatacatattcatagactaaagactgggaggttatataccaaatgttaacagattctcaggaaagaagggtaatgaaaagtaattatttttcaataaagggaatgtaggtgatcttaatacatttttttctgcttatttctattgtccaaattttctgcagtcaacatgagaaaaatctattataatagtgaccggtaagaatgattgatatcattttcctcaagaaatgtctactgttgaggttaaaatcgatattccacctattttaaatggcatgctgttatttcccaatgttatttttctttggagtgagaagtttgttttttgttgataatttgatttatttctttttaaaatttctttaactaggtaatgttttcatggcacaaaacttaaaatgataaacatttctacttctttttctgttgatttcttttataacactttgttgcgtggctgtggta

SEQ ID NO: 395023 - DNA, 672 bp, Homo sapiens
aacagaatatagagcttcagaacaaacccacacgtatggactttagcatatttcagaagcagcaaatcattgtggaaaggatggactattcaaatccttgtaacaaggatggatgatacatgatggaaaaagatgcaactgaaaactgtattacatcagtacttataatttttactcatcaaagattccatcaacaaagcaaaaagagaagctacaaacagagtatatttgcaacccatgcgaacaacacgtttaatattaaaaccaaaatgtagtgtgtatactcataagtgtgtatatatgtgcacacaaatatgtacgtatacataaatcaagacaaaataagtagaaaaatgggcaaaggatattcaggggcatttcacagaaaagaaacaggactggtcaaaaaacatgaaatgatgttcaatctcattggtaattgcaaatacaaattaagagttcagtaaggtgtcatttcacgcacacttggatgacagaaatttaaaggctgacattaccgagtcgcgaagaagatgtgcaacaaataatgccaactctgtgctgctggcaaagtcaaaccaaagaagtgcaagcacctggaaaacgaacttggcattatttttctttctttttttttttcttttgagacagagtctcgctctgacgccaggc

SEQ ID NO: 395024 - DNA, 501 bp, Homo sapiens
gatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataa

SEQ ID NO: 395025 - DNA, 371 bp, Homo sapiens
gaaagacaagatggaggggaacagcgctctcagctgagattagaggggtaggcaagggccacaccacttagggccttgcaggtcgcagtaagcagcctggattttatgccccctcagtgatatgagaattcaccaaagcacagaagagttaactgtctgacttatgttttcaacagatgagtctggtctgacagatcagaaagtaaataatacactcctgcagttctctattaaaatgtctcattttagttgatctttccaccgaaacccaagagaggtcttggcttaattggtattaaagtgtataccagtaacatttcagcaggaatccaccaggatgaaagaagcatggaggaccaggagacaggaaa

SEQ ID NO: 395026 - DNA, 248 bp, Homo sapiens
accagcctaaatttgattaaaatattatattaccaaggaggaacagaacactatgtagttatgggaaaagtggggttctaccagctcttgactaactggcactgacagtatcacagacagctaaaacagtgactacacacacatagtaaagggattcatctattaaatttgcctagggaaagttacagtgaccaactttttttttttttttttttgagacagagttttgttcttgttgcccaggctgg

SEQ ID NO: 395027 - DNA, 337 bp, Homo sapiens
ttttcacccattctggtgtagggtagatcaatcaattaaaagaaattgcaaaggctatatgctatggtttgggtgtttgtcctctccaaacctcatgttgaaatatgattcccagtattgaaggtggggcctaatgggaggtgtttggatcatgagatgaggacagatccctcatgaataaattaattgtgtctcttggaggtgagttcttactcagttcccatgagagctggttgtcacaaagagctggtatctccccaccttcttgcttcctctctctccatgtgatctctgcacatgccagctctccttcaccttctaccatgagtggacacag

SEQ ID NO: 395028 - DNA, 167 bp, Homo sapiens
taaaaccccagaacagagaggaacgaacccaaacaggcaggaacaaccctgaacaggcagtaacaaccctgaacagagagtaacaacccttggtggagcacttagtaaatggcagctggatatagctgttatgagctgggtatgaggaagaacttccaaccatcgga

SEQ ID NO: 395029 - DNA, 284 bp, Homo sapiens
ttgcaccatcagacacacatgccagtccagaagctgtggtcaggaggagcagggacacccttcacctttgcagttcagtccctgggcccttctccagaccccaaatgtgcagtcacgtggcaggaagccccagggagaggggctggagcagcgctctgagtggagccacctggtacactcagggctaagtgtgtggctgggtctcagcaggaaactcggccttggggagccaacgcagcctcacaagcaagctggggatgaaggagcacctctggggcctcaga

SEQ ID NO: 395030 - DNA, 430 bp, Homo sapiens
ctgctgtgaggaccttcttttgcctcttcttcactttggtgaccactcccacaaacacagcttggatctggtcactaccaagaataggtccatctccaaaacttggattttgcactctataaccactacctctcctattctgcaatcttccctcatctaactttcactaactgttttcttttgttgttgtttttaaatatatattttcctctttttaaaccctgtttcttgaacccaaactttctgctcctcaatcttcctattgggactgacttagctcagctttaactatccagacggtttctttgctgccttccagaattaccctcttcaaggtgataggagaccctcttcaagtcccagactgaacatggcacttctaaacttaaacatgcaatctggttcccctttgtgcaaacccacagggccc

SEQ ID NO: 395031 - DNA, 402 bp, Homo sapiens
cttctgtaggcaactccacagctacaaccagaaggccattttgttacaggcctgaaagccccgttttctttttattcttctttgaaacctttagaaggaacaaagtattggctactttttaccgctgatgtcagtgttaagaatcttgtgataacatagatttactctccctgctgaaaatcactatgtggctcatcagtaacacaactagacatgatgacttaatgcaaaggaagtcctatgtaaatgagcaatgaaattgcaactgtgtataaggaacaaaatagaatatgaaactccagaatcttttgttttcatttctgtttctcccaaggctctatcattcaaaactccagaatctttcagcatgcaattgtctcctgatatcagcccctctcttgt

SEQ ID NO: 395032 - DNA, 676 bp, Homo sapiens
tcaggcctttaaaaaaagaaatgttatactcttctaatggttagatttgcagtaattctcaactctgcatgttagaatctcctggagaacttttaaaaacacacgtgtccatgccccaccccagaccaattaaatcaggaactctggagtggggatcaggcatgattgtttgcttgtttgtttttgtcttgttttaagctttccaggtggttctgatgtgtggccagggttgagaactactgctgtttaaactttagaaaagcgtaacacttttaaaaggttctattccatgtgatacctcttatcctttcacatcaacaaataacccctactttccatttcttcttcatgaaagatagtgttctcatttctcaaaattagaaggcatgaaacaaacatggttaaaagagaacacaatatagtagctatacaaaatatatctctaggccctaaaaatttgcttttggggcactgaaaagatatgcagataaaattgcgtagccataagttcttaaagcttatgataaatgagagtggccaaaagacaggaattgaggaaatgtcaacccagtagtccaaaaggtgactcatggacaataaataccagctgataaaatcgaagctgtttcctgggaaaaaattatagaatgcttaattaaaaagataatttgtgaga

SEQ ID NO: 395033 - DNA, 584 bp, Homo sapiens
aggcagaggttgcagtgagccaagatcgtgccactgcactgcagccagggccacagagcgagactctgtctcaaaaaaggaaaaaaaataaaaagaaaagacctaatgagtgctgacagtggatcccagctccagagattctgaattaatctggttggggtacagcctcgtcattggagttttgtgatgctctctagtggatttcagcatttagtcactgctaaacattgaggagcacttctcaaaccttcatgtttaggaaatcacctgggcaccctgtgaaatgcaggttctgactcagaaaataggggcggggcctgaaattctgcataatctgctgctggcttgtggactccaccctgggtgacagagcaagactctgtcttaaacaaacaaataaacacaacctggcacctctttcttctctctctcttgttctctcaccatgtaacatgctggctcctttcctcttgccatgattgtaaacttcctgaggccctcaccagaagcagataccagcattatactccttgtacactctacggaactgtgagccaaaataaaactcttttctttataaattg

SEQ ID NO: 395034 - DNA, 476 bp, Homo sapiens
ctaggcatggtggctcatgcctgtaatctcagcactttgggaggctgaggctggcagatcacaatttcaggagatggagaccatcctggccaacatcttgaaaccctatctctactaaaaatacaaaaattagccaggtgtggtggcacgtatctgtagtcccagctactcaggaggctgaggcaggagaatcgcttgaacccaggaggcagatgttgcagtgagctgagatcgcgccactgcactccagcctgggtgacagagcaagactctgtcttaaacaaacaaataaacacaacctggcacctctttcttctctctctcttgttctctcaccatgtaacatgctggctcctttcctcttgccatgattgtaaacttcctgaggccctcaccagaagcagataccagcattatactccttgtacactctacggaactgtgagccaaaataaaactcttttctttataaattg

SEQ ID NO: 395035 - DNA, 140 bp, Homo sapiens
tgctaggaagctcattggagaccctaacttggaatttgttgccatgcctgctctcgccccaccagaagttgtcatggacccagctttggcagcacagtatgagcacgacttagaggttgctcagacaactgctctcccgg

SEQ ID NO: 395036 - DNA, 313 bp, Homo sapiens
agccagcaggggaggggaggaggaggaaagacaggagggactcaggcgacgaaggtaggacttagacacgtgggttctggggccagtttgggattgccttggacgtgacaccacaccaacaccttggaccttctggcactcctggccctccacatccccactggcatgggggggcagggtccagggatcagcgaggatccttccagcaattcctctcctctactgaatcttgagccaaggcgtggggaatgaacatgccttcccctctgccttggtggctccttccttgaccactaaccactggggttccttg

SEQ ID NO: 395037 - DNA, 496 bp, Homo sapiens
gtattctctctatgcgttctgcctcctggacttaaataatcaaaaaagtaattctagattcccttccactaaccaaggctagatacccgaatttactgtgttttttgagaaacctttgaaaggtctgacctagccatacatcagagctgaagaatctcagcgaaccatgtccatttctggggtaaggtggtttaggataggcagagcagcctcagcgccccaaattcatttcagtgttcccacgcttgagcagacttggtcttaattttctcgtttttcatcagatttgcgtttatatataggagcagaaggagttgaaagtgaactcttaagagcatatttgacatggaattagattgatgttatagcaactataggtaaaaaaggattttatagttgaaaaatttgaaaagctcagtattaagtatctgttatgatgtagtactgtgttaatgtagactttgggcagtttggggatcaatactattttaaaaga

SEQ ID NO: 395038 - DNA, 356 bp, Homo sapiens
ctaggattacaggcatgagccacaacacccagcctcatgtaatttcttaacatgacaattcccaaatatgctcaaacatgaaatatggttctctagagaagttgattatatgtctttaattcacttatatcaaataactcccttaatcattaaattttttaaatacagcctaatcttttgtgttgttcttcacccaacttttctttctcttttcagcaggataggaaaagtaccatataattattaaagccatcttttgattacaaagtactgacaaatgtgtttctttaccatcttttcttctaatttggtaatgtcagtcctaagtgcacattagaaccatctggagaagtttt

SEQ ID NO: 395039 - DNA, 290 bp, Homo sapiens
tcgagaccagcctggcgagcatggtgaaaccctgtctctgctaaaaatacaaataattagctgggcgtggtggcgcatgcctgtaatcccagctacttgggaggctgaggttcgagaatcacttgaacctgggaggctgaggttgcagtgagctatgattatgccactgccttccactgcgttccatcctgggtgacagagtgagattgtctcaaaagaaaaaaaaataataatcctgcactttgcactaatttatattgttcttaatgtctcctccaaaatgttaaata

SEQ ID NO: 395040 - DNA, 402 bp, Homo sapiens
aggatccccgccgctctctctgtggcgggactgctctccctgtggggtctggtccttttcttcccaggtcctcagcgctgcctgtacgctctctctgtggtgggacgctctctctgtgggggacgctctctctgtggtggttcggcgccttgcctctttctctgcacctccagcagcctgaactatgcccacttgggaaggacgagatcgtcggacgctgggagaggctccctccatgtcaggcctgctctcgggctccacgtggataatcagctccacacctcatccctcatggcaattctgcttggctttggtttctactgaggtaaaattcatgtaacataaaattaaccactttaaagtgtccaattccgcagcacttcatctgctcacagtgctgtg

SEQ ID NO: 395041 - DNA, 260 bp, Homo sapiens
cagtgctcctcctcccgtcccctccttgggacttggattttgcttcggcttctgtgagcatcgcttccagtacctcggatactctttcagtgaagcagcaaccgggaatcggctggcccttctgcactctcctcccagaccccgccctggctggcagcccgacgctaccacttgggcctggctcatctctgtcccatgacagaccccaggcgcccctcctgagcccccggcctctgtggaaaagattcacatcctccagc

SEQ ID NO: 395042 - DNA, 271 bp, Homo sapiens
ataatatgccacgcaatagtcaacgtcctgcttctatccaaacccacggtcagagtcaccaacctcagcctgtgtccttgcccatcatctctcaccaacctcagcctgtgtaattgcccataatctctcaccaacctcagcctgcgtccttgcccatcatctgtccaggcatctggggtagctccatgattactgcagttccaatggcttcatgatagtaagagcaacacttactgaactttcagttctaagccagagcctcctgtaagca

SEQ ID NO: 395043 - DNA, 284 bp, Homo sapiens
tgaaataaatgtgagctatgtacacatttaagagagattaataaaaacaagtaagataagtaattacctgtttattctagttcagggtcacaggtggctggaacctatcctggcaactcagggtacaaggagggaaccagccctagacagacaccattccattgcagagtgtactcacacactcccactcacacagactggggcaacttcaacacactagttcacctaacgtgcacatatttaggatgtgggaggaaaccggactacctggaaaaaacccatgc

SEQ ID NO: 395044 - DNA, 778 bp, Homo sapiens
tctcttgctccacacactctacccagaccatttactatgccaccccactttacaaatttccagcattccctctagcactgatgaaaggaagaataagaagggtcttcccaaaattgggaaaagctggatttggcggggggtggggaaggaaacgaagagtaatctcgaaatatactttggggctttgagaaagatctgaaatgttccaaaaagtgacagaccggggagagcagagaacagaaacctcctacctcatctctaccactgcagtaattcatgcactaattatgtgtaacatcttttaaaactggaagaatcacattaaggaaaatgaaaacatgaactcataaaattgcttcccagataatttatctaccaaactggctgaaagcttatgatactacaaatgtttcctagcaaagtggctattagaatcttagtgataatcagcaaattggtggctacttggaaggactggagtggcttaagtccacctggtggtatgggggaaaggcactgacagtgagaaaggagcaattcccttcattccccaaaagcagagaagagtattataatgggtttcctgaaaactgtattagaaaaaggatcctaggccaggtgtggtggctcacgcctgtaatcccagcactttgggaagcttaggcaggcggatcacgagctcgggagttcgagaccagcctggccaatatggtgaaactccgtctctactaaaaatacaaaaattagccgggcatggtgccgtgcacctgtagtccca

SEQ ID NO: 395045 - DNA, 400 bp, Homo sapiens
accccatctcagacagacagacatcttattgtaccacggtgctataacgcgttatagcaccgtgataatcagcaaattggtggctacttggaaggactggagtggcttaagtccacctggtggtatgggggaaaggcactgacagtgagaaaggagcaattcccttcattccccaaaagcagagaagagtattataatgggtttcctgaaaactgtattagaaaaaggatcctaggccaggtgtggtggctcacgcctgtaatcccagcactttgggaagcttaggcaggcggatcacgagctcgggagttcgagaccagcctggccaatatggtgaaactccgtctctactaaaaatacaaaaattagccgggcatggtgccgtgcacctgtagtccca

SEQ ID NO: 395046 - DNA, 334 bp, Homo sapiens
gccactaaatcccagggatccttcccagcttttcttctctttgatctccatggcatttggttttttcaatggcttttatttttggaaacactctcttgcttagcctcagtgacatttcccattggttttttttttcttctcattcttgaccatttctttttgttttccttcctggttcccactcccagtcctgccctttaaaggctgctgtcccacaagggctggctgtgtcgtcttcctctctcatcttgtctctgggcagcctcatccatctgtgtccatggttttaactaaccctacctctccttctaccttcccccaaccccactgccca

SEQ ID NO: 395047 - DNA, 744 bp, Homo sapiens
gtattcaaaaaggtcagtataatgtttaagaagagtttattcaactgcaaagctaaggtccctgcaaacacagattccatagaaaggaagttagttttccaaagtgtagaagtttggagtcacttatacagacaaagctttctatataaggcttattgcagagttaacaaaaatctgatttgttgaggtagtctttttgtttcaggaaaggtatactcaacatttcacactaaagatgtaactgtcatggggtcttcggcaccatccagtctgaattaggccaataaaaggacaattaatcccaaagatcagtgattggaatggggaatgtctggtgtctcctagttatttactgaacaagatcaatgagcaggagctattatctaagaaactgtaagaaagagaattgcacacattctgtgtgattcagtttctagggtttaacttcccccttggcatgataaatttagagggtcctgaagttttattttctttctgtgagtaactcaggagtgtacaatatgggctgccgtgagatgtaaccaaaggaacagtaaatttatagagaaatgacaagacaaagggaaggacttgaagttgccatgggaagcaaattgtggaaaggtaaatatttggcagaagttatatagattaattctgtgctgcctttaggcttgtaagaatatagagttgtcttcagaaattaagaatcaccctgtcctttcaagtagaaaggaggatagg

SEQ ID NO: 395048 - DNA, 444 bp, Homo sapiens
aacaaaaaacggataaatccaggcataacagagtagcctttagcatactaaatcctttcactggaattaattacaaaatttaacagactttactggtaaggggactttccatgacaaaatagtggaaacccaagcagaaaacagcaggagacagttagaagtactggattctaaagtagctggaactcaagaggcacaatctgggagaggagggaactacagaaaaataatatgcatagaaatctcccctcctccaagtcattggcggactcctaaactgcacatttacagagtgagacttcaaaaacttaacagaacacagcagttaaacgtcaaagagctaataagattatagcagctatgctgagttgagagttgaaatttaagaccagcaagatagaggggttttggtaaagacctggatttcgggttgagactcaagga

SEQ ID NO: 395049 - DNA, 750 bp, Homo sapiens
tgttctaaatgcatgttacattgctttcttaatctaactatactgagcagagtttacactttatactgagcagagtttacactttatttgaagtttcagaaatagcattcagaacatcttcttttgtacaacacagcaacttcaggggctcttcaagatttcccaggttactaggttcttaaggttcactcttttaagagagtttctttctttcccattgtctaagtctagactaagatccaagtttacttccagcatttctttatctttatccttcttcatttgcagcttcttcttgtttatgctttgggaaaccagatgaagaaactggtccaaattacagtatacctaaaaggagaatttacagggtctctgtggcagaatggagttcccgcttgtaaataaatataaaagttttagtgcaaaaagatatgcaatcaatttttactgtcatcatatctgttaaaattattgttgatttctctcagcaatgttcaatacagttgaggtttctggataagttatctaagtatatacggagtatggtcatacattaaaaaaatacaaaaggtttcagacagcatttaatgtcattcttcaaattcttattaaaattgcatcgtatttatctatagacaataattatccacctaacttgtttgaatgttctataataatgcaaaatgtctatgattgcaagaaaagtgagtttttaaaatttttggtcttttggtgtgtttttttctcatt

SEQ ID NO: 395050 - DNA, 343 bp, Homo sapiens
agctaccattttttcctcagatctgggctatatttagcttgtgtgttttttcctcattttcctcaaaccccagaatgtccccaggaattcaaggagtctggaggttaatgcccagtcttaagtatttagtcatgaaaattaaatttgaaaatattctttcaggaaccatctcactgactaaaaccatgactgatttaaaatgctacttaggaatatacaaggcagaaattttaaagatgatgcagagtgttatgactagaaagttctgatggaatcttttacccactcacgcattcattaattcataaaataaacgtcttttaagaacctgtgctgggccaga

SEQ ID NO: 395051 - DNA, 185 bp, Homo sapiens
tgagccggaccgacacatagaatgaggagggtccatatattaacaataactttctaaaaatttttaggactactaatgcctgatacttatgagtacttatatgtgtcaggcagtgtgctaaaggccttatttgcatcagctcacgtaatcctcataaccacagtaaggcataggtattattattc

SEQ ID NO: 395052 - DNA, 151 bp, Homo sapiens
tcctgtcctctgtggctagagaaagccctcttctgggtgatcacagcggttccttaggatctccccttcaacattccttcatcgttagttggttcttcccagaaggtaagcccaatcccttctactgcagtccctagcatcctctccgttg

SEQ ID NO: 395053 - DNA, 318 bp, Homo sapiens
tgagcactcatcactgctggggcattacacttacatcacttttcaggacttttcctcttctctagttttttgtttttctttcatttaattttggagtacggaaggcctcccatatttatatagaagaaaagactgaacacataagaaatgtgaacgtctgtgtacacagtgtccacggctactttcgtgctccaatggcacaaacagatggtactgagatggcacggctctcaaagcctaaaatatttattatctgattctttctagaaaaaggttttggctgggcgtaatggctcacacctgtaatcccaatacttt

SEQ ID NO: 395054 - DNA, 231 bp, Homo sapiens
gtttggactgctataaaaaacataccataaactaggcagcctataaacaacaaatatttacttctcacagttctggaagctggaagtccaagatcatggtgctggaagattctgtgtctggagagggcccacttccacgtgatggaaagggcgaggttcctcttgggtctctttatgagggcactaatcccatttattagggctctgccctcatagcctaaccatctccca

SEQ ID NO: 395055 - DNA, 416 bp, Homo sapiens
tgtaagtcagaagtgcccacaagttggagccattaggttttaaatgacagaaacccaattcaagctagtaagcaaaaagagaatttattgtcttacacatctgggaagtccggggctacaacaaacttcggtactcctgtttacggagttctctgtctccctcatcatctctggccctgcctccctgtttctttcctcaacttctcctgtgagaaatcactttctttggccaccagtagcccagcttctcatcctgagtttgcctgctccatggcaaaaagtgcatttctcctaacaacaattaatccaaccctaggaacattctgattgactggcttgggttgtaagcctttggcaaggggaaggtggtgaagatgttgtgattgacaggtttgcctggaccacatggaaagaga

SEQ ID NO: 395056 - DNA, 409 bp, Homo sapiens
ccaggctggttgctactgtgttgcccaggctggtcccaaactcctggtcttaagcaatcctcctgcctcggcttcctaaagtgctgggattacaggtgtgagccaccttaccaggcctaaacccaattcttaaaagcaggattgaaaagaaggaatgtcctacagcagtggtcccccacccctggggtgcgaaccagtactggtcagtggcctgttaggaaccaggctgcacaggaggaggccagtgagtgagcattactgcctgagctccacctcctgtcagatcagcagcagcattagatctcatagggcacaaaccctattgtaaattgtgcatgtgagggatctaggttgtgcgcttcttatgagaatctaactgatgcctgaggatctgaggtgaaagtttcat

SEQ ID NO: 395057 - DNA, 215 bp, Homo sapiens
aatggcactggaggaggagctgggtgaaggcacggggaggggtgagggcctgcaaggtgtgggcgacaggaaagcccggctgcacaccatcgccctctgcagagccaccgtcgtgctcctaaacatctggccacggcagcctggctcccaaagctcaccaagcgaaggaccgactgtgaagtgaacttcgtacccagagctggcaaatgtggctt

SEQ ID NO: 395058 - DNA, 310 bp, Homo sapiens
taaagtgactgcaaggtaagaattccataaatattaactcccctccccaccatatcagagaaccctaaagttgagaactgcatttctgtacatatcactatattaaaaacctaaaggggaaaaaaatggactattctagtgactacttgttcatctcccactcaaatgccaaaaaatgttttttcaagggaaacaaaatagtaggaaaaggaaggatgctttaaaaaaaaaaaaaaaagtctctcttctcccttgccctaaaaaaaaaaaaaaatggtttctagaacatcaaaagctcctcaaaggatca

SEQ ID NO: 395059 - DNA, 317 bp, Homo sapiens
ttggtaaaaggctatcagtaaaatggatttttaacacttggttgctcaatggaaccttaaaaattcctatgatctgcattccagggtatctgtcgtactagatttgctattgtcctgtttgttgaagcttcgtctatatgaaaccagttagatatattgttgggtatgtacagctattcaaatgtgtttggaataccatcatgcaaaaatatacataaaatgttagtcattagaatcatttaacagatcagcaaactgcaactcacagggtagtgattcccaaatccaggttacataagcttcctgggtcccatttt

SEQ ID NO: 395060 - DNA, 687 bp, Homo sapiens
ggattaggacaaacccgtgcaggaacaatggcaagtctttagcccgatcaggagcggcaatgggcgcctccctggatggggagcacagcggacaccctgtcggatccggaggtatggaagtcagcagcgggtctgcgacggtggcaaagggcggcaaacagcagctagtcctgcctctcactatgactcccggagctgcacctacaacatgtaccggcaataccggtacctgaccaccgcaggcgctgtcacccagtgctaccgcgccagggcccactccatccagatcactccaccagatgaaggtggaggtgatcgcagccagcaagtgccgccggccggctgtcaagcagttccacgactccaagatcaagttcctgctgccccaccgggtcctgagccgtcagcacaagccacgcctcaccaccaagaggcccaacaccttcttctaggtgcagggcccttgcctgggtgggccccaaataaactcaggaacgccccggtgaaaaaaaaaagacataaactgtaaatgcttagacaattggtcatgcctgttggcagagaacacagccccgcctccatgatgtaaaccaaaaataaaatcctaagtccccccaccaactgaatggaccctctcttggccaagaagacctcagagaaacctgaaaaactgtgttcttggccatg

SEQ ID NO: 395061 - DNA, 177 bp, Homo sapiens
tcatacttgtttaaaatatttttagaagttatatcatgaaattgttgcctgtccctgaaaagtaaaaacaatctactctcaaccaaaacatctatgcaatttcataaaacaaacaaagaaaaagggactaaacaatatggagagagaaatcaaaagaaggtactcagattgctggtg

SEQ ID NO: 395062 - DNA, 384 bp, Homo sapiens
agcaattcacccgccttggcctcccaaagtgctgggatgatagacatgagccaccatgctcggcagtgttcatctttcgtagctattgctagaccatttcctgaatgaaatgcttataccagtatccactttaccagcagtgtcctgtgtcttgcagctccacagtcttaccaacatttgctgttggccaagtgaatgggtagaaaatggaatctttgggaacttggtttctaggtccctgagccctgctgctgaatatctcctcttatgtttattggcatatgtgtttcctgtgaaatattcatgtcttttgccagtttttcattagggttcttggtgctttattttttgttgatctatagggctctttatatattgctgatt

SEQ ID NO: 395063 - DNA, 447 bp, Homo sapiens
gttctccatgaccctctctgggaacagacaatgttctcaatgtctggtgttgccatctgtccactcctaacaaggtcagaagttatgaggaaactgctgcatagaaactattctcttgggagttaatatcaattctagaagaaaatgtgtagagaaaataattcaaagttgtatttaaatgttcagagggggaataataccaggatcctttctcaaactgaaatgagccggctcatttcagtttcagggaacaaaggacttcaagcctgtgtatactcactcttctcagctccttcctgtgcgccggttaagggtctgcttgataggaaatgctacagccttggctctaaggataggacctcgtggggcctttctgtcttggagcattttacagtttctcttagaatactcagatccaatcagaaacaggggtaccgagctcgcaat

SEQ ID NO: 395064 - DNA, 226 bp, Homo sapiens
aaatcgagctcggcccatattaacgtggactgcgacaacagacgtgggggtcggggtgacatcacagctgggaggggccacaggccagggaagctagagaaggcagggacgcagatcctcctggagtgtctccggaaggaaccaggcttgctgctgacccctgaccccttgacctccgaccttcagaaccattagataaaagactggtgttgcttgtgtgttttgt

SEQ ID NO: 395065 - DNA, 683 bp, Homo sapiens
  misc_feature (24)..(24): n is a, c, g, or t
  misc_feature (33)..(33): n is a, c, g, or t
gtgacgatcgggtcggccccggancacactgcncatagcgagaccctgtctctatgaaagataaaaaataaaattagccaggtgtactggtgtgcacctgtagtcccgggtactcaggaggctgagatggacggatcactcaagcccaggaggtcgaggctgcagtgagccaggatggcaccatggcactccagcccggacaacagagtgagaatctgtctcaaacaaacaaaaacaaaaacaaacaaaaaaaagaaaacctaatgaatagaaaacttggtgaagtgactagagtaagtccttgtggtcgtctgactctcagcccctcaaagatgtccccatcctaactgctggagcctgtgactgtgttatgttacctgaggcgctgcaggggtgatgaggtgacaggccttgagatgggagatgattctggacaatctgggccagccagcaagggtccccataaaagggagggtcagaggaggactgcgacaacagacgtgggggtcggggtgacatcacagctgggaggggccacaggccagggaagctagagaaggcagggacgcagatcctcctggagtgtctccggaaggaaccaggcttgctgctgacccctgaccccttgacctccgaccttcagaaccattagataaaagactggtgttgcttgtgtgttttgt

SEQ ID NO: 395066 - DNA, 326 bp, Homo sapiens
tagcaatggtacctacagcttaaggttgataccaggttaaatgagttatccgtctaaagcacttataagagtgtatttgccattgttactgtgtaggctgaaaaaggacagccatgatctcactggattgtcacagcagcactacgagatgggtttttactgcctttcccatttttacagaggcctccaggcaaagcgctttgtccaaggtcactaggctggcaaatgccaagccagttcacacagcctgggaatctgaatgccggcaggctagctcagaagcccacgatctttgtgggtttgtttgtttgtttgtttgttttgag

SEQ ID NO: 395067 - DNA, 522 bp, Homo sapiens
tgaggctggctgactgtgtggacacttgcctgatcacttcaagtcaagccacctgggccaggctgattccaacctgactagggataaggtgaaaaggggaacggctctcaaagtttagcgtgcttactattttgtcattattaagcacttaccatgtgccaggcactgtgctaaattctttttttttttttttttgagacggagtctcactctgtcaaccaggctggggtgcaatggtgcagtctcggttcactgcaagctccgcctcccagattcaagcgaatctcccgcctcagcctcccgagtagctgggactacaggcgcccgccaccatgcttggctaatttttgtacttttagtagagaccggggtttcaccatgttggccaggttggtcttgaactcctgacctcaagtaatctgcccgcctcggcctcctaaagtgctgggattacaggtgtgagccaccgcacaggccgctaaattcttttatcatgtatcatcgctttaaagcttcacaaca

SEQ ID NO: 395068 - DNA, 321 bp, Homo sapiens
gctttagctaattgccactatactccacaaacttacttgagaaagaagtgtccagtggaaggtaagtggaaatcactgggggttccagaaaaactctttaaaggagtctgattcaacaagaggcatgcccttttccccttggttcttcctctttctgtaatctggtgtgcaggtgtgatggctggaaccacagtggctatagtgtgaccatgagggaatcctgaagatgtaggctatatactaaggatgatgggagcagaatgagaggaagagctagggtccctgatgatcttggagctctcaatccagccctgggctgat

SEQ ID NO: 395069 - DNA, 280 bp, Homo sapiens
gaacccaccgggcagcgagcctcctaacatgcagacccccgccagcaagcagaagctccgggggagttgagtgggggagcagcttctggctggagactaggaagtgctttccaacaattgtctgaaaatagaacggccggctcacgaggaaatgagtccccatcacggggagcgggaggcgggagcaggaagactgtggcgcagggagggggcccgtggcctctgaccccgagagacctgagtccttccgttcctcacccctgacatcccagacatccag

SEQ ID NO: 395070 - DNA, 539 bp, Homo sapiens
cagcttccctacctggggtggggtgacgactggccagaagatgtgccaaaggcctctctgtacatgagtgtagctgtctggagtggggtctctgctcttctgtatgccgtcgttcttgtcagatgtgtcacaggatgcctctgggttcagatgtggcgtggttggttgtggcacatggctctgcttcaggtcacaggatgactgtttctaggtcttggattttaggtgtctggtattggttttcctttttctggtacatgcccacctccttatgttaacatcctcactgtctaactactcttgttcttaacccgtgatgtattttcactcctgccagagaaattcagtctagtttggctttgtgtcttgacaggtccacagagagattgaacaggatcctaggggagatactctttggccattggtggttggaggtgatgaactgtttgcagaagtggatgcgtttaagagacagggtcgtcattgctgccctgatttctcctcacaaatggaaaactattaatgtatacaaaacaacg

SEQ ID NO: 395071 - DNA, 280 bp, Homo sapiens
aagtgattctcctgcctcagcctcctgagtagctgggactacaggcgtccacaaccacgcccagctaatctttgtattactttattgtataaaatgggaaggcaaaagctagcaaatttcatgtggaagcccaaaagatacattctgaatgcatctcacactcctaagatgccctcctgcaaatcatttatacataggaagtgtttacatttggtgtagttacggagaccagtaattggagagttcccagaaaatccagaggaagtcaagatgcccaaaa

SEQ ID NO: 395072 - DNA, 407 bp, Homo sapiens
atttctgcttctattattacattgataaatctcacatttaaccagactttgagggatatgctgttgaactgatgtaaatcttgaatcgaaaactgcggtgcaatcctcattggtcataatgtgtgggctgttttgcgcataataactgatggaggcatctcagttttaaagtttgagaatgaagcattgttcagttttgtcaccctgaatcaatcattttattttgtgcattgttttatcgtgatgtttttggaataaagattggttctaggaaaggggtgggtcatttcatttggtgataacggaaatgcccttctactttttaagtgtctttggtatgaggtggggccctaggtagggcctggatgtctgactgtcctgtcattttgaaaagctcccttttaaga

SEQ ID NO: 395073 - DNA, 308 bp, Homo sapiens
gtaaaccctccaccctcgtccatcattccaacaaccaacaataaaaataaataacaaaacctacttagcatagttttcttgctctttcttaagaaggggttactatttagatctaattatttaagattctctattggcccaggagcagctttcagtatcttccaagcctctttttagaacagatgtgcttttcctgtactgaacactaaaatactatgaactatcagagttctaaaatgtgtgtttttttaattcacaaattttgaacacatttaaaaaggggcaaaaggtatgtgataaatgaattc

SEQ ID NO: 395074 - DNA, 419 bp, Homo sapiens
aggggcaggcagagttcattatactattgagtctacttacatatatttgaactttactataataactttttttaattgggctagtaggatgagaggaagggcgtcacagaggaggtgccatctgaaccgcatcttacagggcatgaaggccggacgatgctcccaccgagacagtgcggggaggagccacgcggggaagaaccgacagccagtccccgtagggcaaaggcaaaaaatagttgaggctggagagaggtgggaagaagccagggctccagggagataaggaaccagccatacttgtgcttctggccctacagggactctggtgaccctgcagatggtggcactgatgggactataaaagagaggggcctcccaggaaggcaccacaacagatgtggctgctatgtgtgact

SEQ ID NO: 395075 - DNA, 637 bp, Homo sapiens
gggcggatggacggtcacaccgacaccatcagctctgacctctccccttcagagaggtctcctttacactggtctcacatgctacagatttcacttcacttggattgcaagcattttccttgaattcagcacctcaacattgaaaaccaaagtttgttcaaaataggcttcttttccccccaacccattttactcagtggccttcctgttactctctcctctcaaagcctggaagcctttacttattatgcttctctcactttctgtccagtatctcagtccttcaaatattttgtttgattattttaatcaaattatttttattattttgtatttattatattttgtattattataatcatgtctcttggggttcatctgatttctaagacgtcaggaatttgggcctgattttttagaactgtctcgctgcctccattttccccctctctagtttttttttttttttttgtatcattgtcatattaatcttctcaaaactccatgttcatcaagctgcagcacctactgaggcttccgatgccctgactggcagtagggcctaaatcacttcttttctgctgatctccaaactgcactctattttgccaagcaggtcttccccactcttcctgct

SEQ ID NO: 395076 - DNA, 122 bp, Homo sapiens
caactaggtgagaatcaattgctagcagcttagggagggaagaaacttattaccatactgtgttcaattccaaaatgttatgttaaataaatatttatattgttaatgaggacagggactat

SEQ ID NO: 395077 - DNA, 215 bp, Homo sapiens
atgaagaattttagaaaggggtccgcaaagagcttttcaatttaatgatcatattttcagggctattgatgggccaggccctgcgctgagcaatggggaagtccacatagagaggcctggtccctgccctttataagccctgaagtaatgaaagatgagtccttaccacagccctgtggattaggtcccatgaaatgaaagcccagagaaggtta

SEQ ID NO: 395078 - DNA, 155 bp, Homo sapiens
gaggatagtcagtattaatcatctatctttctatctatctataattagtaaggagctagtctaactcacatcataataaggctttgtctgcctctttaaatggtgtgtctctagtacctaggacaaatgtcctgccttcattattctatctgaaa

SEQ ID NO: 395079 - DNA, 342 bp, Homo sapiens
gagctcggcccacttatgaccgagttcccaatgaatagatcttcccaagaacacttcagtcagctctggcttccctggaggcccctttcctctttctttgctcaactatgcctctgtcgccacgctgctgctctgggcagtgaagctctctgctcctgcaccactgaaaagcaatgtcaggaaagccagcaatgtcacgaaagcccgcaatgcctggcgagtaaagttccaagattttgggagccttggaaagggccttggaagatcatttctcccattcaatccctccacctcccagagaccttaccctgactcactactcctgggacgaggtctgtggcc

SEQ ID NO: 395080 - DNA, 413 bp, Homo sapiens
ataaaaaaaagatatgtaacattaggcattgatggaaaaggactagatcctagtataagcatcctaataaaaggagaggttcaaagacgctctccagaaccagtatttcagactttctatgataaactaaatgtgccagtacctgagattccaggaaaaactaaaaatttgtttttgcaattagccgaacacgtagcccagtctctacaagtcacctcatgttatgtttgcggaggaaccgtaacaggagatcaatggccataggaagcccgagaattagttcccacagacccagttcctgatgaattcccagcccaaaagaaccaccctgacaatttttaggttctaaaagtctcaattattagacagtattgcacagctattgaaggaaaacaattcactcattctatagg

SEQ ID NO: 395081 - DNA, 369 bp, Homo sapiens
aggagacagtagcaagcaccttacccctggttgggtggtgaggagcaaccttagacaggaaaagggtacaggggcctactctgctaagtatctcctgatctttcatccctccagatcagaaagagtccccacagctcatcttccctttctgcctccctgaatctacctctgggtaggaggtacttttcatttctgtaggaaatatcagacaccgctggacctcaaggcctcagtaaaatgggtttcaaccccatctcagaacctctcccaattctgtaactgtggaagcttcagatcactgacttgtaagagtcaaacaggccaggtgggatgttaagaatctcccttcagggctgcaggggagtctgc

SEQ ID NO: 395082 - DNA, 293 bp, Homo sapiens
cttggtctgtgccctgaatgggggagctcagtccagcccagctcccaattgctgcagcgtgtgtgtgggcttctccaggaggagagtgggttctgaagaaaggggtcagaaactcacttattgatcttcccataggagcttcttgtccctgcattgccctggtgcagtgggcagctgagaccatctttccacagggtgaggtcttccctgtgtgtgtgtgtgattgtggcataggaaggggatgtgttgattctgagcaataaacagcacattttggatattcaatatagact

SEQ ID NO: 395083 - DNA, 110 bp, Homo sapiens
aatacttcttagcttctcctctaaccgtcttaggtgagtcagtaaggctggagaggctggagttaggtatttccctctcctagcgatgaaggttagaagaggctgaagtt

SEQ ID NO: 395084 - DNA, 384 bp, Homo sapiens
gttttcaccaagggaaagcagccagaaagattcattcaaaaccagcgcgatcatcgtcttactctgctcatcgtcttactctactcatcgtctctcctgcaatggcgcccatctcactcagagcaaaagacaaagttctagcctgtatgaggccctaggcaaggtgacctctccaatctcatgtccagctacacagccttagttccctccactccacccactggcctccttgcagttcctccacaggccagacgtgctcctgcttcaggattttgcattgctgttccctacacctggaacactcttctctctgttttccacatggctaaaccattcacttttgggttgttgttcaaatgtctccttctcaatgaggcctcctct

SEQ ID NO: 395085 - DNA, 494 bp, Homo sapiens
tcacatataagaagctccaaaatgtactaagcttattatattaacattggccacactgaactcttgggaatactacaattttaaagtaagagagaaagtagggaaacagaaacatgagtctggggggtatgttgtctaatgttagagataccaaaaattttccatgtggttgtttttagcagagctactatatgcaaactgcacgtgaaggatataagttataaaggaatagagcttctagaaggagaaatgtgagttaacttttttctaccatttaatcattctttcctcacctcttagtgtgtgtttcaataatgttagagatacgtatctctaacattatcttaaaacaactagacaacacacacacacacaaaaccttaaaaaagagagagaaacatacacactctctgaagaatctctgaaactgtttacaaggaatctcgaaaaacagggatgtctaactgatgccggctctgtttttctgtaaataa

SEQ ID NO: 395086 - DNA, 228 bp, Homo sapiens
agggaaacagcaactgacttgataacatacaaatgtaaaacttccattcaccaaatagaaacgcgaacaaaaaaatcataacagatataactttttaagtaacataaaatgcaagtgccctatttggccacgtttctttacatttgaaagagtagttgatacctttaaaacagaaagggggctgtgtgcagtggcgcacacctgtaatcccagcactttgggaggctg

SEQ ID NO: 395087 - DNA, 109 bp, Homo sapiens
aactatttctgtgcagcacagcgtggaacctggcccagtgtcttacttagggaagtcactccatggagtcacttgctaatcattccaatattaaatgaaatctaatatt

SEQ ID NO: 395088 - DNA, 846 bp, Homo sapiens
cagatatggagggtaaactctagagagagagagagtgtgtgtgtgtgtgtgtttgtatgtgtatggtgttggtggtggagtaaaatatatataacataaaattcataaagttgacaatttttaagttcagcataccttcaccttcacattgttcaaccaacaccaccaccatttcccgaactttcttatcttcccaaactatacacattaaatggtaactcagctgtttagctgttagtccagcccagctctgcctcagtgaactatgctgtgctctgctccactgaggtgcagggctgactgtatcatcaccagcaggggggatggctggccccaacctgaggaggagaaaaagaaggaggtacgcaggtccctggggtttctggttgtattcttgtccctaggcccctgcgttgtcccttagtgagggagaaaccttatgatcctggcccagccttgcaggctcccccggcatagagacacgtgctctgtgctgtcttctaggggctgctgctgccctatgtctcctggccagttgacattttggcaaccatgaagtgacctgaagcgagcctccatttactgatattataattggagccttggtaccattcacccaatctcgctgagccagcaggggtctctggtgagtctcctctcagatttcaaatcttcctaattttggtttgagattcatactttgttcaagcaaccaattccacacttgatggagctggaattaaagttctgcttctaaggacacaatcatagacactggttattttacctaggctttgattggaatggcaaattttcagatatgaccagactgctttaaaacattga

SEQ ID NO: 395089 - DNA, 528 bp, Homo sapiens
ttactagtaaaatgcatagaaaaaattcttctcaccttgaagcactattcttgaaacctgaacataatggtatatttctgattctttgttcatacttcttcttggtaaggaagacgtagcacaaatatgctgcataatagaaaggtcatactcttcctgcatcactgtcatctggcttggtccaaaaacttttttacccccaaaatacttatactatatgtaacaaatctattcttgttactataattgcctaatataagggcaacaatttttcttgaacctttaaaaatattagaattctaacaaatacccttaaaaattattgaacaaactatgcctttctacaaacatatgttttcctcacactgtaactaataacaacctttgaaatttctttatgattcaatcaaaatgtgctatgagtagttaagaagactcttaaggcctaaaatattcttaatgactctaccaggttattttagtttagtatacagacattggagggagtactcttaaattaatttgtaa

SEQ ID NO: 395090 - DNA, 824 bp, Homo sapiens
  misc_feature (49)..(49): n is a, c, g, or t
aggacaacaacactgcacgcacaagcaagaaaacacttgcattgactanggccggtgggtttcactggcacgaaggctttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaacaaaaaaaaaaaccttaaaggaaaaaaaatatataataaaaggaaactttgtggcccgcttggcccaattgaattttgacatgagcgcctattcattggggcccaatttgggctaacttggccttcccctttatggagagcgttttt

SEQ ID NO: 395091 - DNA, 843 bp, Homo sapiens
  misc_feature (7)..(7): n is a, c, g, or t
  misc_feature (9)..(9): n is a, c, g, or t
  misc_feature (12)..(12): n is a, c, g, or t
  misc_feature (93)..(93): n is a, c, g, or t
gcaaagncngcntcccacagcgctggtccacctgatcgtggagcacgacaggttgtaccatggaagagccgctcgttggtctcggaatgcagntgctggggccgacccacccgcaaatgcgccggcctcgtgccgaattcggcacgagcggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaacctcttccgctttcgccactcgaccgcgtcccacataaacaaaaacttcgggggggggcccgtacccaaactgcctcatatggggccgtttaacaattagtggccgcgttttc

SEQ ID NO: 395092 - DNA, 2666 bp, Homo sapiens
agagcttcaggccagaagataatccaacatgaggcctgaaagaaacttgggccagaaaatctccagggtacctgcccgccgaagtcccttccgaggactctcctgagccagtggctgagacatgcacatccatggtggaagctccaggtctgggcagccctctccctgcagtcacagactatgcccactaggaacacccacctgggacaaagcctggccacagtcagagagcaggacggctctcaccaagcccctcaggtggctccccgccgctgaccctgtgctgcgtggcacaggcttccccaacgccctgccacatttggcttcctccaagcaggctatgtgcttaggatgagatgtggctacttttagcaaacaacactagagtggcttcagcccagccacggtgacttctcgctcccataagagctcaagagggagaggtgatctccctccccagccactggggaccccagttcctgttgcctattctgccactgtcatcttcctgcaccacctcatggtcctggatggctgcacaggctctagccgtcatgcccctattccagctaggagaaagggggaagcataagtggcaaggagaagcaccctccccttcttcttttttttttaattgctctatacatttattattagctattattaatgcagaaccaggggacaaaaagctcacaaacactctacacaatttcacaagacacattgcaggggaaaaagtgactgagatggatcaacagtatgctagggtcttggtggactcattcctaggggaggtggacctctaattcctggtggagggggtctcattcctggagggggcatgcctactggtgtccctcgagcagagggaagcccaattggtgggcccgtgggtggcctcataccaggttcagaagctccaagtttaactgtggacattggatctgggggaacggcagtcgtgaccgtgggcaagagtagcaagatgctgccacacacggaccacagaatgagacgtatcctacaagatggccgagtcttcattggcaccttcaaggcttttgacaagcatatgaatatgatcccctgtgattgtgatgagttcagaaagatgaaactaaagaatgcgaagcaaccagcacgtgaagaaaagcgggtttcgggcccctccgcttctaaagaagcttgctgggggcgccacactcactgccattgctcagagcttggttacacggcccggccacaccaggccacacagagacaagaagcgcaatgtgctggcaaagactcttaccggaggagaaggggagaatggctgtctttgccaaatagcccgtcacgaacgtacccctgctgggcccccgcaagtgcaccaaccgactcgaaagtcccagagagggctggcgggcaaggacctgagtctccagccacccctgcaggaggagcccagggaccctcgcatccctgataaggaagcaggtggcgtgccctgctgtgaccccgaaacagcctgtagtctcaccctccatttccacgagactctaagtctgccgcttttgcagcaaaagcccagtgctgggggtgagcgtgtggggagtgtgggagacgggctctgacccggccaccctgggcagctgtgctcacgcagcacccccgccgttcccagctggacttcacctggcaggacagccaacaggcctcaccgtggcctccgtcccgggggtcgtgcatgggggactgggccagcccgagcagtgggacatgctgccttcctaccctgctccacctgccacaaacacaaactggaatgttctcagccacctccagacttcacaccctttgggctttggggcacagaggtcgggctgccctggggagaggagggagagaaggaggcttcgagagagcacggacatgagtcagacctgaaataaagcaaagccacaccgccccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaccccggggcctccttattgtgggggggggggaaaaaggggggtcttcgaaaaggggccccgggcccaaaggtggtttcccgtgccccccccttttcttgtgtcccccgggggggaaaacccggggggggtccca

SEQ ID NO: 395093 - DNA, 991 bp, Homo sapiens
  misc_feature (185)..(185): n is a, c, g, or t
  misc_feature (187)..(188): n is a, c, g, or t
  misc_feature (725)..(725): n is a, c, g, or t
ctgagattactgccagtgcactccagcctggacgacagagcgagacggtctcaaaacatggtgctggagaaactggatatgtacatgcaaatgaaatgaaagttggaccactactacatgcaaaaattaactcaaaacacatcaaagacctctacataagaatgaaaactagctgtccagccccngnnccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagncaaagaaacaaaaaaaaaaacttcgagaaataagttctctcgacctcggggaagttcgacatcgtcttttaaaaccctgtcggtgtggaaatcccttgaggcaaccggccgttgtatgcccgagggaaagcacggggcgaccgtggaaggtcaattacttcccgttaagatccatccacctatggactgattatccgaagagtgttcacctggtggagcacgcacagatgtgcgtccaagggaattccgaaaatcggaatgtaccg

SEQ ID NO: 395094 - DNA, 801 bp, Homo sapiens
ggcggggggcgggtccacgccagcccggaagagacgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaactccgggggttcttttcggggggggggacaaaaggggtatgaaagtgggcctgggcaacgtttccccggacccgttttttttccaaaggggaattgcgggccccaagggggcggtaatcaaaaaccgttcctat

SEQ ID NO: 395095 - DNA, 3381 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3234)..(3234): n is a, c, g, or t
  misc_feature (3241)..(3241): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaanggggggnattaagggggggggggaaaaaggggtaggaaggggccaggggccaataggtgtccgggaccacgtttctgggcaccagggggaaaactccgcaggaccccataaaggagacgaataattccgaaaacccggtacccggta

SEQ ID NO: 395096 - DNA, 3525 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395097 - DNA, 3724 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaaaaaaaaaaaaaaaaaaaaaaaaaaaaaagagagcgagggggggcgcgcggcgcgcccagaataatatctcccccgcggggggcgccccacagttgagcgggccgccccccgcttttttgggtacagggggggcccccatgaggggggcgcgtttataaaaacagcgggggggtgggggcgcgccgggtaaaaccagcgctccggaggcggcgaaaaacccgcgggccggcgggcaatcgtggggggagaaggaccccccactcgttgcggggcgcgcggccttgtggggcgaccacccccccccaaagcgaatataaggacgcgggagaaaaacaaaacagaagggcgtctcgggcgacacccccgaggcaatgtgtgcggccggccaaaaaatgggacaaggaaataataataaaaacaaatttgagcggcccgcactctaaacataacaggcagaagaaaacgccagccaataaac

SEQ ID NO: 395098 - DNA, 3444 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaacaaaaaacacgaagacacaacaacaaaaacacaaaaaaggctccgagggcacatttatcggcggggggcggaacaaaagcctgcgtatacgaaagggcgccaggtggcgcaaaagatatgactacggcacccaacgatattgtttactacacacagtgggaacactcagagggcgccaccaaaatgagagagcgcatatattctcgacaacccgcgtacacccgtttatagt

SEQ ID NO: 395099 - DNA, 3361 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaacaaaaaaaaaaaccttaaaggaaaaaaaatatataataaaaggaaactttgtggcccgcttggcccaattgaattttgacatgagcgcctattcattggggcccaatttgggctaacttggccttcccctttatggagagcgttttt

SEQ ID NO: 395100 - DNA, 3350 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3229)..(3229): n is a, c, g, or t
  misc_feature (3239)..(3240): n is a, c, g, or t
  misc_feature (3246)..(3246): n is a, c, g, or t
  misc_feature (3251)..(3251): n is a, c, g, or t
  misc_feature (3265)..(3265): n is a, c, g, or t
  misc_feature (3273)..(3273): n is a, c, g, or t
  misc_feature (3277)..(3279): n is a, c, g, or t
  misc_feature (3290)..(3290): n is a, c, g, or t
  misc_feature (3292)..(3292): n is a, c, g, or t
  misc_feature (3299)..(3300): n is a, c, g, or t
  misc_feature (3308)..(3309): n is a, c, g, or t
  misc_feature (3323)..(3324): n is a, c, g, or t
  misc_feature (3329)..(3329): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaatnggggttttanntggggnggggnaaaaggggtggaanggcctggncaannnggttcggaccnantttttgnncaaggggnnattgggggtcctannggggngataattgaaagcagtaagtg

SEQ ID NO: 395101 - DNA, 3357 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaactccgggggttcttttcggggggggggacaaaaggggtatgaaagtgggcctgggcaacgtttccccggacccgttttttttccaaaggggaattgcgggccccaagggggcggtaatcaaaaaccgttcctat

SEQ ID NO: 395102 - DNA, 3325 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaacctcttccgctttcgccactcgaccgcgtcccacataaacaaaaacttcgggggggggcccgtacccaaactgcctcatatggggccgtttaacaattagtggccgcgttttc

SEQ ID NO: 395103 - DNA, 844 bp, Homo sapiens
  misc_feature (49)..(49): n is a, c, g, or t
  misc_feature (697)..(697): n is a, c, g, or t
  misc_feature (704)..(704): n is a, c, g, or t
aggacaacaacactgcacgcacaagcaagaaaacacttgcattgactanggccggtgggtttcactggcacgaaggctttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaanggggggnattaagggggggggggaaaaaggggtaggaaggggccaggggccaataggtgtccgggaccacgtttctgggcaccagggggaaaactccgcaggaccccataaaggagacgaataattccgaaaacccggtacccggta

SEQ ID NO: 395104 - DNA, 788 bp, Homo sapiens
  misc_feature (26)..(26): n is a, c, g, or t
  misc_feature (641)..(641): n is a, c, g, or t
  misc_feature (648)..(648): n is a, c, g, or t
aataggctagtacgaggctggtgtanatcggccgaggcggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaanggggggnattaagggggggggggaaaaaggggtaggaaggggccaggggccaataggtgtccgggaccacgtttctgggcaccagggggaaaactccgcaggaccccataaaggagacgaataattccgaaaacccggtacccggta

SEQ ID NO: 395105 - DNA, 3328 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaacaacacaaaacctccaaggcaacatcaatgacgggtgcgggcaccatagcgtactcacattgcgccctggcccacacctgtacctagacccacttttctgttcaaagtggcgatctgccggctccccaaaga

SEQ ID NO: 395106 - DNA, 3274 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagcaaaaaaaaaaaattccgcgctgatccggaaagggcgacctcgaggggccgggacacatttgcctaagggggaaaaagcagggacagg

SEQ ID NO: 395107 - DNA, 3307 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagcaaaaacttaaaaaaaaaaaaattcggggttagtgggtgggaaaaggggtatgatggcatggtctagtgttctgaccagttttgtaagggagttggggcccaagggggttatgaagcgacg

SEQ ID NO: 395108 - DNA, 3645 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaccttaaaaaaagataactccaacgtgtcactgaagctcaagcggctagagtacggggtcctgagaagcagcgttaccaaggtgacatgtggcacaagctgctcaatatgcaaattcttggtccccgaggggtgaaattcggcgaggtgcccattagtcggggcgcgatacgactaagagaagagcgcaggttactctggtagatagcgcgctgaacacaacacaggaggacccgtcccaaataaagaattttggggatacacatacataggatcgggagccatcaaaaaccaaggatcacaaaaaaaacagcaggggacgaaacagaggtgagcccacaagacgagtgcagcgatggcacagtggcaacagagactcaacgagaccgatgatgtgcagaagggaagaacaacgaacccaaagaagggagataccaaaacagaagaaagc

SEQ ID NO: 395109 - DNA, 3374 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3296)..(3296): n is a, c, g, or t
  misc_feature (3301)..(3301): n is a, c, g, or t
  misc_feature (3304)..(3304): n is a, c, g, or t
  misc_feature (3308)..(3309): n is a, c, g, or t
  misc_feature (3315)..(3315): n is a, c, g, or t
  misc_feature (3320)..(3320): n is a, c, g, or t
  misc_feature (3322)..(3322): n is a, c, g, or t
  misc_feature (3326)..(3326): n is a, c, g, or t
  misc_feature (3333)..(3333): n is a, c, g, or t
  misc_feature (3353)..(3353): n is a, c, g, or t
  misc_feature (3357)..(3357): n is a, c, g, or t
  misc_feature (3360)..(3360): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaacaaaaaaaacaaaacaaacaaaaaaaaaaccccggggcgttcttttgggggggggggaaaaaggggtttcaaagggccggnggcangtnttcnnggcccnttttngnccangggggancgcgggcccccaaggggggntaantcnaaccggggacggta

SEQ ID NO: 395110 - DNA, 3268 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaccttaaaaaaaaaaaacaaaaaaaaaaacaccaacaccgaaaaaccaggggggcccaatctcccgggggcac

SEQ ID NO: 395111 - DNA, 3237 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3196)..(3196): n is a, c, g, or t
  misc_feature (3198)..(3198): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttggatgcgcgcagancnggggatccgagtccaaccatttctcaattctcagcaacc

SEQ ID NO: 395112 - DNA, 3824 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaaacttcaataaatacgtgtctaactgaaatcactaaaaactaaaaaatcatggtgcgggccgaccgtcccactctatcaagatgttttcacatactcaactgagtgtggggcggctaggctctcctagtggtaagtctacacctaggaatactctgcgctgtgtctttactagagcagtatcaccaggggccacagcaaccataaggtgcagtagtgtttactacatcctactaacgaaaaaccgccgcgcgtgtgagtacacaccagcgcgttgtgttcttattacaatacaaacccgcaatggaaggggccatatctccaagagcgaggcaaactgccggtggaaatcgtctttcgacagcagtgacggtttcccatgagtgtgcttaccgaccacattatgcttagatgtcattcccctctcccgccattggtgttgcgaatccggcaccatataactatttagctacatcaaccaatacaacgccataaggactccaacttataaagcagttgcttaacatagcttcaaccttcctgcattcttggcccataacgaaacttaattcagaaaagcttactcttgaaagacctatacccaaacccttttaagtagtaggaccta

SEQ ID NO: 395113 - DNA, 3920 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3212)..(3213): n is a, c, g, or t
  misc_feature (3216)..(3216): n is a, c, g, or t
  misc_feature (3838)..(3838): n is a, c, g, or t
  misc_feature (3918)..(3920): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaagcannganatttcggggcattttgggagggggggggaaacaggggtgaggaacggggcctgggccgatacctggtgtctctgacccagcttttccttggtcgcaaacgtggcgcaaaaatcaggcggggagtaccctataaggggaggccgcatcaaatttcgcgaaaaagccgaggtgtacctgcgtagagattggacagaaaaaacaaaaaaacacaaacacgggacttatccgggggggtgggaaccacaagggggaggagccaccaacaccccagcggtcggctcacacaacagagcccggcgtccaacaacacacactttctacaaacaaaaggggagcacaatcagagaggcaccatccaacaacagcaaagcaagccaactaattattccacacaacgaagagggagggatacgtgtaaaacacagactaagggacgagctagggcggtgtgttgagggcgcacacatcgctccccgcggcgagatagcaaggagtaagaaaacactaagtcagtcagatcagcggtaataatagagtactctaacaacaacacacaagaagatagtacgacagcagcagaagcacagctaagaatagtgacagacgaaaacagtcagagcancgacataaaatgcaacgtagctcgaggaagtcaagtacacatagcagagtattaggtcgcagcacaagattgagtatacnnn

SEQ ID NO: 395114 - DNA, 3241 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttcgatagcgacaaggatcgctcatgtttgttgcaacctcaagggacatgtttgtagtatg

SEQ ID NO: 395115 - DNA, 781 bp, Homo sapiens
  misc_feature (26)..(26): n is a, c, g, or t
  misc_feature (703)..(703): n is a, c, g, or t
  misc_feature (708)..(708): n is a, c, g, or t
  misc_feature (711)..(711): n is a, c, g, or t
  misc_feature (715)..(716): n is a, c, g, or t
  misc_feature (722)..(722): n is a, c, g, or t
  misc_feature (727)..(727): n is a, c, g, or t
  misc_feature (729)..(729): n is a, c, g, or t
  misc_feature (733)..(733): n is a, c, g, or t
  misc_feature (740)..(740): n is a, c, g, or t
  misc_feature (760)..(760): n is a, c, g, or t
  misc_feature (764)..(764): n is a, c, g, or t
  misc_feature (767)..(767): n is a, c, g, or t
aataggctagtacgaggctggtgtanatcggccgaggcggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaacaaaaaaaacaaaacaaacaaaaaaaaaaccccggggcgttcttttgggggggggggaaaaaggggtttcaaagggccggnggcangtnttcnnggcccnttttngnccangggggancgcgggcccccaaggggggntaantcnaaccggggacggta

SEQ ID NO: 395116 - DNA, 922 bp, Homo sapiens
aattcgcggccgcgtcgacgacagaagggtcctttccagccccggtaccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395117 - DNA, 3504 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395118 - DNA, 1063 bp, Homo sapiens
  misc_feature (185)..(185): n is a, c, g, or t
  misc_feature (187)..(188): n is a, c, g, or t
ctgagattactgccagtgcactccagcctggacgacagagcgagacggtctcaaaacatggtgctggagaaactggatatgtacatgcaaatgaaatgaaagttggaccactactacatgcaaaaattaactcaaaacacatcaaagacctctacataagaatgaaaactagctgtccagccccngnnccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395119 - DNA, 955 bp, Homo sapiens
  misc_feature (7)..(7): n is a, c, g, or t
  misc_feature (9)..(9): n is a, c, g, or t
  misc_feature (12)..(12): n is a, c, g, or t
  misc_feature (93)..(93): n is a, c, g, or t
gcaaagncngcntcccacagcgctggtccacctgatcgtggagcacgacaggttgtaccatggaagagccgctcgttggtctcggaatgcagntgctggggccgacccacccgcaaatgcgccggcctcgtgccgaattcggcacgagtaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395120 - DNA, 917 bp, Homo sapiens
tccgtgattaccttcatctgcccccggagatacctggataccctcattggtaaggtaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaaaaaaaaaaaaaaaaaaaaaaaaaaaaaagagagcgagggggggcgcgcggcgcgcccagaataatatctcccccgcggggggcgccccacagttgagcgggccgccccccgcttttttgggtacagggggggcccccatgaggggggcgcgtttataaaaacagcgggggggtgggggcgcgccgggtaaaaccagcgctccggaggcggcgaaaaacccgcgggccggcgggcaatcgtggggggagaaggaccccccactcgttgcggggcgcgcggccttgtggggcgaccacccccccccaaagcgaatataaggacgcgggagaaaaacaaaacagaagggcgtctcgggcgacacccccgaggcaatgtgtgcggccggccaaaaaatgggacaaggaaataataataaaaacaaatttgagcggcccgcactctaaacataacaggcagaagaaaacgccagccaataaac

SEQ ID NO: 395121 - DNA, 909 bp, Homo sapiens
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaacctcgaaactagttctcttctctccccggtagggggtggaggctcacacctgtaatccagccatttagggaggcccaaggctgcaggatgcgtgagatcgggagtccaagaaccaagcgtgggcaacatagttgagaccttgtctctattcttacaaacttttaacaagccacggttggcacaggtcttaaggtcacagctgctcaggaggctgaagggcagggtcctttggaacacaaaagttggagggttgcgcaagccatgataccccatgatcccactggtggaagaataaacctgtccaacttcttaatggagacc

SEQ ID NO: 395122 - DNA, 802 bp, Homo sapiens
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaacaaaaaaaacaaaacaaacaaaaaaaaaagaaaaaaaaaaaaaaaaaaaaaaacctgcgggggtatatatttggggtgggagaaaagaggtgtaaaaggggcgaagggacaacaaggccacagagcacgggatgtgtaaacacaagggagaaaccaggggccaccaaaaagagagggcgaaaacacgagagagcgggcgagacacgcgata

SEQ ID NO: 395123 - DNA, 1242 bp, Homo sapiens
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaacaaaacaaaaaacaaaaacaacccacaccacccaacaaaacacaaacgaagacaaacgaaaaacacacgcgaccaacaccgcggcgaacacaacagccacacagagcagagctacacgaaccccgaccacatacacagagagcgacacggccacccacagaagggaacacaccacgcagcgcccagtaccacaccgcagaaaccacaaaacacacgagcgaacacacagcacacacacacagcagatgacgagccaaaaccgagcgcagcacagacaaacacagccacaacacaacgaacaacacctcccgccgccgccgtcgctagccgcagcacagaaaaaaaaacacaacacaaaagaaagaaaagaagcacacaaaaacagcaagaaacaaaaacgagaaagagaggcacacgggagagacagcgtgagaaagaaaagacaaggcaagaaacgagagaaccagcaacacgaacacgacacaccagaacaaccacgacgaaggacaccagagaaggaacaccaacacgacggaagaaagaacgaagaaagaaaccaaacacgaggaagcaggacaacaaaaagcccccaaaaagaccacgaaaacacaacaccaacaacaaccaaagaaaagacacacacgacacaca

SEQ ID NO: 395124 - DNA, 829 bp, Homo sapiens
  misc_feature (563)..(563): n is a, c, g, or t
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagncaaagaaacaaaaaaaaaaacttcgagaaataagttctctcgacctcggggaagttcgacatcgtcttttaaaaccctgtcggtgtggaaatcccttgaggcaaccggccgttgtatgcccgagggaaagcacggggcgaccgtggaaggtcaattacttcccgttaagatccatccacctatggactgattatccgaagagtgttcacctggtggagcacgcacagatgtgcgtccaagggaattccgaaaatcggaatgtaccg

SEQ ID NO: 395125 - DNA, 3685 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaaaaaaaaaaaaaaaaaaaaaaaaaaaaaagagagcgagggggggcgcgcggcgcgcccagaataatatctcccccgcggggggcgccccacagttgagcgggccgccccccgcttttttgggtacagggggggcccccatgaggggggcgcgtttataaaaacagcgggggggtgggggcgcgccgggtaaaaccagcgctccggaggcggcgaaaaacccgcgggccggcgggcaatcgtggggggagaaggaccccccactcgttgcggggcgcgcggccttgtggggcgaccacccccccccaaagcgaatataaggacgcgggagaaaaacaaaacagaagggcgtctcgggcgacacccccgaggcaatgtgtgcggccggccaaaaaatgggacaaggaaataataataaaaacaaatttgagcggcccgcactctaaacataacaggcagaagaaaacgccagccaataaac

SEQ ID NO: 395126 - DNA, 887 bp, Homo sapiens
ttttaatgtcttttgttcagggtggtatggccgtagacggcagaagcaggaagcgcttcctgcttctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaaaaaaaaaaaaaaaaaaaaaaaaaaaaaagagagcgagggggggcgcgcggcgcgcccagaataatatctcccccgcggggggcgccccacagttgagcgggccgccccccgcttttttgggtacagggggggcccccatgaggggggcgcgtttataaaaacagcgggggggtgggggcgcgccgggtaaaaccagcgctccggaggcggcgaaaaacccgcgggccggcgggcaatcgtggggggagaaggaccccccactcgttgcggggcgcgcggccttgtggggcgaccacccccccccaaagcgaatataaggacgcgggagaaaaacaaaacagaagggcgtctcgggcgacacccccgaggcaatgtgtgcggccggccaaaaaatgggacaaggaaataataataaaaacaaatttgagcggcccgcactctaaacataacaggcagaagaaaacgccagccaataaac

SEQ ID NO: 395127 - DNA, 921 bp, Homo sapiens
cctcgctattcatcggcacctcgctattcatcggcacctcgctattcatcggcacctcgctattcatcggcaccccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaaaaaaaaaaaaaaaaaaaaaaaaaaaaaagagagcgagggggggcgcgcggcgcgcccagaataatatctcccccgcggggggcgccccacagttgagcgggccgccccccgcttttttgggtacagggggggcccccatgaggggggcgcgtttataaaaacagcgggggggtgggggcgcgccgggtaaaaccagcgctccggaggcggcgaaaaacccgcgggccggcgggcaatcgtggggggagaaggaccccccactcgttgcggggcgcgcggccttgtggggcgaccacccccccccaaagcgaatataaggacgcgggagaaaaacaaaacagaagggcgtctcgggcgacacccccgaggcaatgtgtgcggccggccaaaaaatgggacaaggaaataataataaaaacaaatttgagcggcccgcactctaaacataacaggcagaagaaaacgccagccaataaac

SEQ ID NO: 395128 - DNA, 980 bp, Homo sapiens
ggcccccaccccggccctgaagaggacactggattccatgaacagcaagggctgcaaggtgggacgtggcccagcccagggcagaagcgggtggacagcctgccatcggggtgggagccacagacggaaagggtgcagggtggacagccccagccagagagcgaggcaggcttggacacaggaaggaggcgtgataggacacccagaactatggacctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaaaaaaaaaaaaaaaaaaaaaaaaaaaaaagagagcgagggggggcgcgcggcgcgcccagaataatatctcccccgcggggggcgccccacagttgagcgggccgccccccgcttttttgggtacagggggggcccccatgaggggggcgcgtttataaaaacagcgggggggtgggggcgcgccgggtaaaaccagcgctccggaggcggcgaaaaacccgcgggccggcgggcaatcgtggggggagaaggaccccccactcgttgcggggcgcgcggccttgtggggcgaccacccccccccaaagcgaatataaggacgcgggagaaaaacaaaacagaagggcgtctcgggcgacacccccgaggcaatgtgtgcggccggccaaaaaatgggacaaggaaataataataaaaacaaatttgagcggcccgcactctaaacataacaggcagaagaaaacgccagccaataaac

SEQ ID NO: 395129 - DNA, 3873 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttcctcatagcacacgattgctctcagataatgtcatttgtaaaaaggaagcatgtacagtagaaacggtccaatcctggtgctggatgctttcataggagtatgtatgaacacactctgggtgggtggccatactcccactttaccaatgaagaaatgggcctagatgttagatatggccccacatccagtaaggggcagtgctgggatttatagcctgtactcagctctctcccagctgtttacatttgggggcctctggagttataatgaggcctgaaagttagcaaaacctccaaagatcaaaccagagtgccgctcatgctgatgtgatgtgctttctcttacagagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395130 - DNA, 3472 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3394)..(3394): n is a, c, g, or t
  misc_feature (3399)..(3399): n is a, c, g, or t
  misc_feature (3402)..(3402): n is a, c, g, or t
  misc_feature (3406)..(3407): n is a, c, g, or t
  misc_feature (3413)..(3413): n is a, c, g, or t
  misc_feature (3418)..(3418): n is a, c, g, or t
  misc_feature (3420)..(3420): n is a, c, g, or t
  misc_feature (3424)..(3424): n is a, c, g, or t
  misc_feature (3431)..(3431): n is a, c, g, or t
  misc_feature (3451)..(3451): n is a, c, g, or t
  misc_feature (3455)..(3455): n is a, c, g, or t
  misc_feature (3458)..(3458): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttcctcatagcacacgattgctctcagataatgtcatttgtaaaaaggaagcatgtacagtagaaacggtccaatcctggtgctggatgctttcataggaagaggcggatttggtcgtggacgtggtcagccacctcagtaaaattggagaggattcttttgcattgaataaacttacagccaaaaaaccttaaaaaaaaaaaaaaaaacaaaaaaaacaaaacaaacaaaaaaaaaaccccggggcgttcttttgggggggggggaaaaaggggtttcaaagggccggnggcangtnttcnnggcccnttttngnccangggggancgcgggcccccaaggggggntaantcnaaccggggacggta

SEQ ID NO: 395131 - DNA, 3662 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagatgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaaacttcaataaatacgtgtctaactgaaatcactaaaaactaaaaaatcatggtgcgggccgaccgtcccactctatcaagatgttttcacatactcaactgagtgtggggcggctaggctctcctagtggtaagtctacacctaggaatactctgcgctgtgtctttactagagcagtatcaccaggggccacagcaaccataaggtgcagtagtgtttactacatcctactaacgaaaaaccgccgcgcgtgtgagtacacaccagcgcgttgtgttcttattacaatacaaacccgcaatggaaggggccatatctccaagagcgaggcaaactgccggtggaaatcgtctttcgacagcagtgacggtttcccatgagtgtgcttaccgaccacattatgcttagatgtcattcccctctcccgccattggtgttgcgaatccggcaccatataactatttagctacatcaaccaatacaacgccataaggactccaacttataaagcagttgcttaacatagcttcaaccttcctgcattcttggcccataacgaaacttaattcagaaaagcttactcttgaaagacctatacccaaacccttttaagtagtaggaccta

SEQ ID NO: 395132 - DNA, 3451 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (3373)..(3373): n is a, c, g, or t
  misc_feature (3378)..(3378): n is a, c, g, or t
  misc_feature (3381)..(3381): n is a, c, g, or t
  misc_feature (3385)..(3386): n is a, c, g, or t
  misc_feature (3392)..(3392): n is a, c, g, or t
  misc_feature (3397)..(3397): n is a, c, g, or t
  misc_feature (3399)..(3399): n is a, c, g, or t
  misc_feature (3403)..(3403): n is a, c, g, or t
  misc_feature (3410)..(3410): n is a, c, g, or t
  misc_feature (3430)..(3430): n is a, c, g, or t
  misc_feature (3434)..(3434): n is a, c, g, or t
  misc_feature (3437)..(3437): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttcctcatagcacacgattgctctcagataatgtcatttgtaaaaaggaagcatgtacagtagaaacggtccaatcctggtgctggatgctttcataggaagaggcggatttggtcgtggacgtggtcagccacctcagtaaaattggagaggattcttttgcattgaataaacttacagccaaaaaaccttaaaaaaaaaaaaaaaaacaaaaaaaacaaaacaaacaaaaaaaaaaccccggggcgttcttttgggggggggggaaaaaggggtttcaaagggccggnggcangtnttcnnggcccnttttngnccangggggancgcgggcccccaaggggggntaantcnaaccggggacggta

SEQ ID NO: 395133 - DNA, 2902 bp, Homo sapiens
  misc_feature (2381)..(2381): n is a, c, g, or t
  misc_feature (2384)..(2384): n is a, c, g, or t
  misc_feature (2389)..(2389): n is a, c, g, or t
  misc_feature (2391)..(2391): n is a, c, g, or t
  misc_feature (2841)..(2841): n is a, c, g, or t
  misc_feature (2888)..(2888): n is a, c, g, or t
ttttcatttaaatattcttcttttgcttctcttaagcagaagctggtctctgcttttcaccacctggaatcccagtcccaacagctgctcttctaacccttccggcctaattgtggaataatcgtttaaatcattaagagacagaatctgatgttggtagctctgacagacctctctagcttctttcataagccagggctcttgcccagctcctgcacacagcctgccagttctccatcttagcacagttccacttttccatagtagccagaaacatctggctgaagacaaacagttacaaagcagaagccaaggtgatgggatctgttgtcacatatggggctggcagctcaaggaatgtggttctctgctgaggagatgtggcaatccagtcagcccctggctgtcctgccaagggtctcaaggcagctagccagcagctgcatgcttggtgactggagctactactactgccaggctgcctggtgaaccttttttgattctcagtaggtaccatctgccaccaagcactaagaaagggagctgaagtacctagaaagttcccatttgggaagtgttcctgtcacccaagagacaggatcaaggcatctcaacaaggtttaggtcaaccaagtgtccacccagtctgactttaaacccccatgctacagaaaggtttctggttttccaggtcttggttgccccttacgtccaaaggcaccagatcactcagcaaatgtccctgaattcagtgattggtggaagggaagacaccagcttttttggatagctgtgctgtatcaccgtttaaggcaagaagtgaatttttgtctgagaacagggagcaagggtttaatgggacagtacagcatctccctctttgcacaggtaagtataggtgggtgtctccatctctaatgtcaagctctgaccataaaggaatgctttagtgggtaatgggcctgtcctagagctttgctacccagaattccccttctgtctggtgttacctcttggaattcactgtggtaatgttcagagaggcaaatgtgttgggccaatagacattcccaggagaacatcctccagagcattgatttattttaagatggcactaagtgacatctctccccaagagatgatctctgacacaatcccatatgaaaactcttctgaaaatgaattgctaattgctattagccttgatgcacttactctaagcagttcttcagacttctggatcagtgcttctcaaactgtggttcttggacaacttacagtagaactacatgggtccttattaaaatacagatccatttcagacctaaaatcagaataagaatgggagtcagagggacccaggattagtatttttaaaacaagatttcttcattttaggtgtctgccctcagcctcctcagcaaggcagagtcagtctcaggtctacttgccattgtggttttgtgcatggtgctttgattctttgctaattatgttgcaggcacagtggtgtttgtcttctgtttcctaccaaactcagcttttttggctgtctgcgcctcacctcccatcttttctaggctgttgctgctttccaggtttctcccttgaatagctgtatgtgctggagtcttttctttatgttgaatcattttaatttttgtccttatttctaggatctagggtccttttgatctttcccttctctgtttatcgtgctagtcctcccagttttaatgatgggtaagtcaggaaagtaagactgggcacatattttctctctcccttcccactgtccatttgcgattcctccagactggatatgctactctctatgactcagaatcttattttctgtctgattcccttctgcttgagccagagagggctttttgttaatttttgttttgtttttaggttaagcttttagagactgctgagctgaagttttgctgaattctcaaaacactaaactgcctgtgttccctctcggctttcattttctaattggaacaaggcacagtattgtaacagagaactgcaattaattttctaaaatagtggcaacttgcacagtataataactttggttgtaaccaagtgaaagcataataacaaaaatacaaaattactaatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttactnagncgagncncagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgccatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtacctacccctgacgggctcccgcngcccccggatccccctctcgccgccccgcgatcggccccgccccccncccgcccccggccc

SEQ ID NO: 395134 - DNA, 572 bp, Homo sapiens
catcttaaccaagtggttgctgagagtgacaacaggagagcaatgccagttttcttggctttaagggacagagttctcacattgccctgtgttcacagtgtggtttgatttacatcctcggcctaaaggtctggagggtgagcgacctgcgagactcacaagaggggaagctgacagagatacctacagacggagtgctgtgccacgtgagtaaatgcatcacctatattaggggtgttggggtgaaatgtctggattctcacagctggctctggctgggtggggctcagcccttgatgatgacaaaatgaccaggaaagattcttggtttcactctgcagagcatcagaacagctggagtcctttgtgcttctttcttcatgcagtgatttcatagatgagaattaggaggaggctgggattttttaaaaaacaaaactcaggccgggctcagtggctcatgtctgtaatcccagcactttggttggagggggggggtcgaagtgggcagattacttgaggtcaggagttcgagaccagcctggccaacatgacgaaaccctgtctctatt

SEQ ID NO: 395135 - DNA, 936 bp, Homo sapiens
  misc_feature (26)..(26): n is a, c, g, or t
aataggctagtacgaggctggtgtanatcggccgaggggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagcaaaaacttaaaaaaaaaaaaattcggggttagtgggtgggaaaaggggtatgatggcatggtctagtgttctgaccagttttgtaagggagttggggcccaagggggttatgaagcgacg

SEQ ID NO: 395136 - DNA, 613 bp, Homo sapiens
gatgtctgccagctccgggtgcttaggcatgtggacatccttcttggccaccatgactccctccttaaaaaggagttcataaatggcaatccggttcttcttaggcaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaccttaaaaaaaaaaaacaaaaaaaaaaacaccaacaccgaaaaaccaggggggcccaatctcccgggggcac

SEQ ID NO: 395137 - DNA, 842 bp, Homo sapiens
gagacggtgtcccaccgacacgcttttttcttgggaacaggactcccccgactgcctccttgcctggcactggagctctagtttgggggagaagtggtaggtaggagacgagggtgcgaaggccttagccctttggtttggggtctgccgccttcaagaagccggggctttacccctccgggccttccctgcgtaccttatggtacagccgcgagattccgcgctggatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagcaaaaaaaaaaataagagagaaaaaaaaggagaaaaaacgggggcattaagaggggggaaaaaggttataaaaagggcatgggtaaaaggttttgggcga

SEQ ID NO: 395138 - DNA, 795 bp, Homo sapiens
  misc_feature (648)..(648): n is a, c, g, or t
  misc_feature (655)..(655): n is a, c, g, or t
ggagagaactagtctcgagctttttttttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaanggggggnattaagggggggggggaaaaaggggtaggaaggggccaggggccaataggtgtccgggaccacgtttctgggcaccagggggaaaactccgcaggaccccataaaggagacgaataattccgaaaacccggtacccggta

SEQ ID NO: 395139 - DNA, 899 bp, Homo sapiens
  misc_feature (7)..(7): n is a, c, g, or t
  misc_feature (9)..(9): n is a, c, g, or t
  misc_feature (12)..(12): n is a, c, g, or t
  misc_feature (93)..(93): n is a, c, g, or t
  misc_feature (752)..(752): n is a, c, g, or t
  misc_feature (759)..(759): n is a, c, g, or t
gcaaagncngcntcccacagcgctggtccacctgatcgtggagcacgacaggttgtaccatggaagagccgctcgttggtctcggaatgcagntgctggggccgacccacccgcaaatgcgccggcctcgtgccgaattcggcacgagcggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaanggggggnattaagggggggggggaaaaaggggtaggaaggggccaggggccaataggtgtccgggaccacgtttctgggcaccagggggaaaactccgcaggaccccataaaggagacgaataattccgaaaacccggtacccggta

SEQ ID NO: 395140 - DNA, 901 bp, Homo sapiens
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395141 - DNA, 1115 bp, Homo sapiens
ccacaaaatgatgtatagtacgatactctggtgtatttcagtacggggctgagtcttcttctatttgactgtacctggcgtcataagtgacagcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgccatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395142 - DNA, 921 bp, Homo sapiens
attctagaggccgaggcggttgacatgttcccgtttctctgtttctcttgtttttctgttgggccgtaaaaaaaataggcattatatctgtatttgttttttaatgaactcctttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaaaaaaaaaaaaaaaaaaaaaaaaaaaaaaaaccccggggcctaaatggggggggggaaaaaggggaaaaaaaggggccggggcacaaaaggaggtgcacagacccaccgtattttttgcacaacaagggggaaaaaatcagcggcgggccaccccataaaaggagggggcggaaataaaatttgcgaaacaccccagggtaaccagcgatataaaagacagccgagaagaacacgcggagtagagcccacccagacacacagaggagagcataatggacgaagacacaccagaacgagaacatcctcacac

SEQ ID NO: 395143 - DNA, 1296 bp, Homo sapiens
  misc_feature (588)..(589): n is a, c, g, or t
  misc_feature (592)..(592): n is a, c, g, or t
  misc_feature (1214)..(1214): n is a, c, g, or t
  misc_feature (1294)..(1296): n is a, c, g, or t
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaagcannganatttcggggcattttgggagggggggggaaacaggggtgaggaacggggcctgggccgatacctggtgtctctgacccagcttttccttggtcgcaaacgtggcgcaaaaatcaggcggggagtaccctataaggggaggccgcatcaaatttcgcgaaaaagccgaggtgtacctgcgtagagattggacagaaaaaacaaaaaaacacaaacacgggacttatccgggggggtgggaaccacaagggggaggagccaccaacaccccagcggtcggctcacacaacagagcccggcgtccaacaacacacactttctacaaacaaaaggggagcacaatcagagaggcaccatccaacaacagcaaagcaagccaactaattattccacacaacgaagagggagggatacgtgtaaaacacagactaagggacgagctagggcggtgtgttgagggcgcacacatcgctccccgcggcgagatagcaaggagtaagaaaacactaagtcagtcagatcagcggtaataatagagtactctaacaacaacacacaagaagatagtacgacagcagcagaagcacagctaagaatagtgacagacgaaaacagtcagagcancgacataaaatgcaacgtagctcgaggaagtcaagtacacatagcagagtattaggtcgcagcacaagattgagtatacnnn

SEQ ID NO: 395144 - DNA, 630 bp, Homo sapiens
ggacgcgtgggtcgacccacgcgtcgccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaacattatttttctattcttctctattcttactctattatatttatagatatatccttcttatt

SEQ ID NO: 395145 - DNA, 1009 bp, Homo sapiens
  misc_feature (48)..(48): n is a, c, g, or t
  misc_feature (119)..(120): n is a, c, g, or t
caggcttctcattacggactccactattagggaaagcctgttacgccntgccaggtacccgttcccgaatttccccggttccgcctactacttactagcccgctctcttcctatccagnnccggtaccggaccctgcagccgcagagatgttgatgcctaagaagaaccggattgccatttatgaactcctttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaacctcgaaactagttctcttctctccccggtagggggtggaggctcacacctgtaatccagccatttagggaggcccaaggctgcaggatgcgtgagatcgggagtccaagaaccaagcgtgggcaacatagttgagaccttgtctctattcttacaaacttttaacaagccacggttggcacaggtcttaaggtcacagctgctcaggaggctgaagggcagggtcctttggaacacaaaagttggagggttgcgcaagccatgataccccatgatcccactggtggaagaataaacctgtccaacttcttaatggagacc

SEQ ID NO: 395146 - DNA, 1201 bp, Homo sapiens
  misc_feature (23)..(23): n is a, c, g, or t
  misc_feature (25)..(25): n is a, c, g, or t
tcaaaggggtctcgggtggaccncntgagattagcgcacacacgcggggtttttaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaacaaaacaaaaaacaaaaacaacccacaccacccaacaaaacacaaacgaagacaaacgaaaaacacacgcgaccaacaccgcggcgaacacaacagccacacagagcagagctacacgaaccccgaccacatacacagagagcgacacggccacccacagaagggaacacaccacgcagcgcccagtaccacaccgcagaaaccacaaaacacacgagcgaacacacagcacacacacacagcagatgacgagccaaaaccgagcgcagcacagacaaacacagccacaacacaacgaacaacacctcccgccgccgccgtcgctagccgcagcacagaaaaaaaaacacaacacaaaagaaagaaaagaagcacacaaaaacagcaagaaacaaaaacgagaaagagaggcacacgggagagacagcgtgagaaagaaaagacaaggcaagaaacgagagaaccagcaacacgaacacgacacaccagaacaaccacgacgaaggacaccagagaaggaacaccaacacgacggaagaaagaacgaagaaagaaaccaaacacgaggaagcaggacaacaaaaagcccccaaaaagaccacgaaaacacaacaccaacaacaaccaaagaaaagacacacacgacacaca

SEQ ID NO: 395147 - DNA, 804 bp, Homo sapiens
  misc_feature (7)..(7): n is a, c, g, or t
  misc_feature (9)..(9): n is a, c, g, or t
  misc_feature (12)..(12): n is a, c, g, or t
  misc_feature (93)..(93): n is a, c, g, or t
  misc_feature (726)..(726): n is a, c, g, or t
  misc_feature (731)..(731): n is a, c, g, or t
  misc_feature (734)..(734): n is a, c, g, or t
  misc_feature (738)..(739): n is a, c, g, or t
  misc_feature (745)..(745): n is a, c, g, or t
  misc_feature (750)..(750): n is a, c, g, or t
  misc_feature (752)..(752): n is a, c, g, or t
  misc_feature (756)..(756): n is a, c, g, or t
  misc_feature (763)..(763): n is a, c, g, or t
  misc_feature (783)..(783): n is a, c, g, or t
  misc_feature (787)..(787): n is a, c, g, or t
  misc_feature (790)..(790): n is a, c, g, or t
gcaaagncngcntcccacagcgctggtccacctgatcgtggagcacgacaggttgtaccatggaagagccgctcgttggtctcggaatgcagntgctggggccgacccacccgcaaatgcgccggcctcgtgccgaattcggcacgagtaaggagggagtcatggtggccaagaaggatgtccacatgcctaagcacccggagctggcagatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaaaacaaaaaaaacaaaacaaacaaaaaaaaaaccccggggcgttcttttgggggggggggaaaaaggggtttcaaagggccggnggcangtnttcnnggcccnttttngnccangggggancgcgggcccccaaggggggntaantcnaaccggggacggta

SEQ ID NO: 395148 - DNA, 166 bp, Homo sapiens
tgcatgtactgcttccacagactctgtacatgctgcagtggactttttgctgttccccaaacatatctcagggcctctgaacgggctgttgtgttatgcatgaagcattctctcccttccccagatattcacatggctctcactctcatgcttctctgcttcttcc

SEQ ID NO: 395149 - DNA, 144 bp, Homo sapiens
atgagtcttaaccacaagaacaaagacaggggtggtatgcacacttactaattctcccaggcccagatgcacactttctccaggtagtccctctgctgtcacctaaaaccacaatgcaatgggagctgagcacagtggaagccc

SEQ ID NO: 395150 - DNA, 392 bp, Homo sapiens
ggagaacaggaattagggagaggtatggaagaggagttggtgaacaggaagcaggtggtcagttaggcagtcatgataggtgaggggtgtggcttctctttgtccagatggtgatctggaaagtttcagttccttgatactatctaggaggcccaatggttggtttcctgaaaaaggaactcagataagacaaatgtaactttctcaagttttaagactgggagagtcaacttctatgtttatttaaaagaaaccataaacatctgttctataggacagctgggtccatttcatagttatcagagatcatgaaggaagttttgactaactttatggagatgggaagaatggggccaggtaaaagacatttgacctgaattctgtgagatgaa

SEQ ID NO: 395151 - DNA, 254 bp, Homo sapiens
aaatggtagaatactaacagtaataataagctgacatctgccatatatatcagtactgtgcacagggttaatgggagtctgctccagagagcgggatttgggattttgctgaacctgcatagccagtccggcccgtggactagagaagtttgcctgctggcctcatgcagctggctgtgtgatggttcccaccattgtcatccaaaccaagtctgtctgagctgagttgtgtgctgggtgacttgcctcccaaa

SEQ ID NO: 395152 - DNA, 493 bp, Homo sapiens
aaactactatagatgaaagaggaaacctttttttttttcttttagacagggtctcattctgtctcctaactggagtgcaaatggcacattctcagagctcagtgcagcctcgaactcctgggctcaagcaaccctcccacctcagccttctgagtagctgagactacaggtgtgtaccaccaggcccagttaaattttttttagaggtaggggtctcactatgtttcccaggatggtctcgaggttctggcctcaagcaattctcccatcttggcctcccagagtcctggattacaggcacgagccaccatgcctagcttaggaaaaaaatttaaagcaaagatggaatcttaaaaaataaaaataaactttaaaagttaatgtgataagaattcctcttgatcttatttatcatttttaattcatttggaaaacatgttcttcccagataatgcaaagacagatggtaatctgtctagagtgtatcacacat

SEQ ID NO: 395153 - DNA, 356 bp, Homo sapiens
ggaagatgtctgttctccatggtgggcggccaatgcaataccagaacaaagtagtggtcatgagaaaaaaacccacgttagatcacatcagtgcctgagacgccgtgatgttcaaagtcaagcgtcctgactgcttctctctgtggtcaatttccttgtttctgacatcagcccagaggcacatcagctgaaacagaaccacttgaaatgacatgactcgagaaagtctgttcagaaacgctgtaattttttgaaaaacagtaggtttctccttttcctaacagaaatcagtttcgctctaatcgagagaaattttttttccccagcatttaaaacccatgcacagctcaataact

SEQ ID NO: 395154 - DNA, 435 bp, Homo sapiens
agttagcgtcccagttttacagatgaggaaactgaaatccaggaattttaagtatttctgaggtcccacaacaaatggcagagccaaaattcaaacccgatgagagtccagccctcattaccgtctcttctggggcagccaggcctgactccaagtgggccatagcttctcctcttttgagacttacacaagaagtacagtggaacaaatggcttagtgatggaagaaaatacaacccccacacccagtttctttccaaagggctcacttaaactgaatagagggtaagcacctgcagaggtgagtactgatttaatgcaaacaaatgtgcatatgatgctgtcatctgtgtttgggaggatgaatctcataatttctgacttatgggcgcgggtgtacttgtgcctcgcctagtcatacctgccattaggggac

SEQ ID NO: 395155 - DNA, 506 bp, Homo sapiens
caataaaatattcgccctttagatccaggttgttccaggaccaatgggagtgcgagccttctctcagaagtggcatttctgagtggcatttcagtatcacggcctgtccttcttgtgatccactctgatcactgatcaaaaataagtcactatggcctggcatggtggctcatgcctgtaatcccagcacttgggagaaccaggtgggcagatgacttgaggccaggagttcaagaccagcctggccaaaatagtaaaaccctctctctactaaaaaataaaaaaaaaaaaaaaaggccaggcacagtggcttacgcctgtaatcccagcactttgggaggccgaggcaggcggatcacgaggtcaggagatcaagaccatactggctaatgcggtgaaacaccgtctctactaaaaatacaaaaaattagctgggcttggtggtgggtgcctgtaatcccagctactcgggaggctgaggcaggagaatggcatgaacccgggag

SEQ ID NO: 395156 - DNA, 461 bp, Homo sapiens
catggccctgggagtgaaaagaaagaagggagacagaggacatggtgagtgggtcctgaatttctacacttgctttattcccatgaacctgttcttcccacaagaagtctaagcccttatttcccagttacagcaatagctatgttaaatgatgtatagccaaagaggtttcaacgtttctagtttttcttaaatttctttattttaggtggggttatttagtatgtgattgcactagaatgtttccttgtgataactggattccttcctgcattctcacttcccagggtgtatgatggcatttctcacaggctgatcagctgcaatttcacaactggctgcacagcagcccctgcctttgctgttagaaggcgggactttttgaagagacgtttactatccagaggacaaggctgataagtcaaagccacctcctctcggtagccctcccagtactgagg

SEQ ID NO: 395157 - DNA, 559 bp, Homo sapiens
ctgttgggaaattccgacgggaattgaaacaggttcctaatctcacggtctcacctgagggaaaagtggctaagaagatggaagcaggctgggcacggtggctcacgcctataatcccagcactttgggaggccaaggtgagtctccttttctgataacatccttcatttctgctcccttctgcttccttctctgaacatattcgaatcacaaagccccagctctgttgggaaattccgacgggaattgaaacagaaaaggtcgatcttgccttgaaagcgggcagtggctattttcttctctctgccaaagcaggacacgttattcttaacacagagggccacatcggtatccctcacaaatacttcagacagttgtcttcaacatcctgtggttcttcgtccgataccttgtttattgcgagatggagtctcgctctgtcccccaggctggagagtgagaatccgtcttaaaaagatatcactcgaggactgctagagaaagagaaccggctcaggggtgcaaccgggatgggggcgacgaagaagcatcggaggga

SEQ ID NO: 395158 - DNA, 442 bp, Homo sapiens
gacgcaaaagcagggctgcctgcggtgccgccatgggggtgagggtggagcttcagataagggcaggaacctcgttggggcactgctgaaaggtctcagaatgtggggacaattcccagagtgaatgagacaagagagggggacaggatcggttacagaatcagaaaccagtgcaaagtgaaaatgtggggtccattgttcaattacaaggattcaagactgtgatagcaaagtgttaaacaaggaatgaggccctgggggggtgatgagagggcccttctgaacctgccagccctaaaagccactgagggacattcaaggatcagatctcaccccacaccaggctggctgagttcttggatggattctagctgattcaccaacacaatgtttcactggacgtcctacacaggtccacttgcacccattgctgattcttgca

SEQ ID NO: 395159 - DNA, 157 bp, Homo sapiens
actcctttcctcctaactggtctccctggttctgcccttgccactgctttcaccactccccaaccttcaactactctcatcacagcagccaagtaattatattaaatctacattagatcatgccatcaactgcccaaaaccttccaatgaccatctg

SEQ ID NO: 395160 - DNA, 393 bp, Homo sapiens
gcactacaccacagtgatcttcctgaagcctaaatttgatgctctccctcctgtctagaaccctccaaggttctccagtgcccccaaggcagagtccaagcccttcagcaggtatttgagtttcatgatgtggcaaagcctggccgattcccagggcccacagtagagagtatctttcctcctggaggcccctccaacactctcgctccaaggcttcctcctccgcctgctctagcttcaccctagcggtgctttcctctgggactgggactgggcctacctctccatgtgcacagaacaggcccagctcagcaagtgcagacgagcagcgtgatcagacaagctgggcctgaatcctgaccccatcccatccctgccctgtgaccttgatca

SEQ ID NO: 395161 - DNA, 334 bp, Homo sapiens
aatcgtctcagctctccctggtctgagctggagataatggtatcagctctcctgagcagtaccgaagtcacgaacttcctcacgtacgtgcgtccatatgctatgatcctgtgtgtaaaacatctcctccccgagtctgcagctgcatgcccctcaatgtagaacatcagctcctctccaggtctgcagctgcacgaccctcaatgtagaacatcagctcctcttcaggtctgcagctgcaagaccctcaaactagaacatcaggtcctctccaggtctgcagctgcaagaccctcaaactagaacatcaggtcctctccaggtctgcagctgc

SEQ ID NO: 395162 - DNA, 519 bp, Homo sapiens
tttcctgggagtgcactgattacacagagaaccaaggcatttctatgttgggcctcactcccttatctgtgcctgtagcttgatttttccaagctgctctttatgtgcctgcagcttgattttttccagactgctgttttgtttgaaagaattccaccaaggacctgccctaactgtctgcctgctttttttctttctccttcctcacttgggaggctgaggcaggaggatcacctgggcttggggaggtcgaggctacagtgagctgtgattgcaccactggactccagcctgggtgacagagtgagatcctgtctcaaaaaacaaacaaacaaaaaaaaaacaacaaagaaacatacacaaaaaaaacccaaaaaaccagcaatgagaaaactggaaacaaccaggttttttccatcagtaagagaatggtgatactgactgtggtatactcttacattaggcaagcacggggtgcatcttctcttgcctgagcaactatgggaacactattcagcc

SEQ ID NO: 395163 - DNA, 414 bp, Homo sapiens
aacagaaattaaacgtgaaggaatgataaaagatatttagtggaaatggcaaccaaaatatagcaggattggctgtacctatttcagacaaaatagactttaagtccaaagctctcacaggagaaaaggacattttataaagataaaagggtcaacctactaaaaagttttaacctttataaatatatatgcacccaaaatcagaacacctaaatatataaacattgaaagaacttatgggggaaacagcaatagaataatagtaggagactccaataccctacttctaataatggacagaacattcagacagaagatccatttggaaacagaggactttaataacattatggatcaaatgaacctaatgaaacatttcattcaatgatagcagatacccattcttctcaaggg

SEQ ID NO: 395164 - DNA, 662 bp, Homo sapiens
aggtgtgctgttgggagtagacaaagaggaatcccatggatctctttacaaaaaaaaaataagactccaagaatgtgtgttcaccatccaaacttgccatgcatgcactctgctgcccactatggaacatatgcaggtcatttgggtgtgtttcctcctagaaaatgaggacagcctttgagtggctcatactaggtcggtaagactgccttctccacctcccaccatgggccgcctcaccctgatgtgcagcaccagccagattaccccaactccactggcaacagcacatgaaaaggtataagcaagtgtgctgctgtagccagccctgcagcctacagatgactgaagaagtattaggttggtgcacaagtaatggcagtttttgccattagaagttttagttaaagggttttctttcactacgtgtacagaattccttcattctcagcgaagctggccactgctcaagtgcaaacctgggcaccacaggacccatgagcactgtctccttagggtgttagccctgggactttacgttcctgttagtacaaatcagccactgaggctcttcaattcaccccctaaattctccagtcactttctatcaccactgccttatttttaaacccttatcacttgccctaattgttgctatagcc

SEQ ID NO: 395165 - DNA, 690 bp, Homo sapiens
ggagtctcactctgttgcccaggctggagtgcagtggcatgatctcggctcactgcaacctccgcttcctgagttcaagcaattctccttcctcagcctcccaagtaggtgggattacaggcatgcgccaccatgcctggctaatttttgtatatttagtagaggcggggtttcaccatgttggccaggctggtctcgaacttctggcatcaagtgatccacctgcctccgcctcccaaagtgctgggattacaggcatgagccaccgtgtccagccaacaactaaatagaatttaagttgtatttatactcaggttctctcgtccttcttcatcccttcaatatgtatcacaggtgcatttcctcattcataaaggacacttagattactatcttgcattcctaccatctgattcaccataaatatacctacattgtccctaggttttataataaagttttctacaacataatctctgtgggcatttccaaacatctcaagttttcttctataatgactcatcctgtggatgctccatcatatagattcttattgatttgcaatgtacctaaatcatctttgccttccattggtattacttttttttaattccttttgtttttgtttttgaaagagtcagcggaaagtacaaagtattaaaacatttattcttctctccactaataata

SEQ ID NO: 395166 - DNA, 501 bp, Homo sapiens
  misc_feature (400)..(400): n is a, c, g, or t
  misc_feature (404)..(404): n is a, c, g, or t
  misc_feature (430)..(430): n is a, c, g, or t
  misc_feature (432)..(432): n is a, c, g, or t
  misc_feature (435)..(435): n is a, c, g, or t
cccaaggccacgctcgcggcctgtcggcaatccaggctgtcggctcaggacagagggaagggttaagcccccagcagggccagggaggggcaaggtggcaccggctccccagctgctcccaggccctgctctgtggtgctggggacctggctttagttcctcggggtggagggggcaccgcgctgcctgcctccgagctgtctggagcagccagtcctgcagatgtgggcagctcagggcccgtgggagggagggggctttgtgcccagggcagcagctgaaggagccccgggcctcgcagcccctcctgggtgaccaggtgctgcttcgtggcagctgccccctcccgtccagcgggtatgggcctgctccccgtggtggggcggcgcaggagagtgancgancctcatgaagttacctctaccgggtntnagnccccggacagacacccccgccccgacctggttacagcgcccttccccggttcggtctccggtgtgc

SEQ ID NO: 395167 - DNA, 360 bp, Homo sapiens
ctagagcaggcatatgtgcagttggtagagagggtatcaggcattggaagggaactgatgagctgggtgatgcctccgctttcaaaatgcaggtgacacaggtagtcactcttcactcggctgcaatagcttaatagacttgcggtttgaaacattttacttctttaagtgcatcctgtgtgaaatgacaaaccccatccctgttgcagttcacatgttcatctgcagactcagcgcccttgggtggactccagcaatgtgccccacccgtctcagctgatgtccctggctgggcaggaggggtttgggaaactgcctgcaggaaggccccagggagctctgggacccggatggtgggtc

SEQ ID NO: 395168 - DNA, 355 bp, Homo sapiens
actggcagtcccaggagagggaccaagtagaacagaaatgttggccctgcaatatctcctagccgggccggcccggggtagagccagtttgcccactcaccaatgcagagagcttgctgctacagcctttgctctcttgccaatacgatgtatctgtttgcttttctaaggatttaggtttcatcgtctttcaaataaaatcactaaatacactctttaaaaaaactcctcttcctggctgggcgcaagggctcatgcccgtaatcccagcactatgggaggccatggtgggtggatcgcttaagctcaggagttcgagagcagcctgggcaacgtggcaaaaccccatgtctac

SEQ ID NO: 395169 - DNA, 429 bp, Homo sapiens
taacgtgccggggagggcttcctcctgtctaaccagtgggattctgtaaacagagtagtgaacaatcatcctatagatcctgaagtttcactgaggagaagtaggaggtggggtggctgccagccatgccttctgttctcttctctcaggggaccaccagctcttcgcctgcgagggtaaggagggctcccagtctcagccaggccctccccattcattcttcagcacgcggcagttctgatacctccacctgtcactcattctccgcagtgcaggtgtgcactgcaacaccggcccaagccggctcctcggggcctgcactgctccacacagatctttcccactgtctcgactgtctggctgcctccctgcgccccggcataccagctttgctctctggagggcctccatggtgcccagcacatctca

SEQ ID NO: 395170 - DNA, 598 bp, Homo sapiens
gcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaattaaaaaaagaaaaaagaa

SEQ ID NO: 395171 - DNA, 611 bp, Homo sapiens
ggcttatataggtataaacatggtgaaggtgatagaccatggatgcttagtcccttttaagttccatcttccgtttaacacattttgaaagaatttattgtgtcttattttcccctgatttgtgtagctgtgccaccctagataacagtttttctttttgctcttgccaccttcttgataaaggcaagtacagttagaatcgtaggtacttaataatgcttcggcatgaatatgcttcacaactttgagatgtgtaccctttattttctttctgttataaatcttaatttctttgtgccctacttttcatatctgtaaaatggatgaaatagtagtatctgcctcatataattgctgtaaagattaaatgctaatacacataaagctcttagaacaggtctggtgtatagtaaacacacaaagctgctattattattgttactggtattaactgatatattcatactttttataactgctcatcctattaattaaatgtattttttcactatatattctttttcaatgtatattccttttaatcttccttcttagcctccactatagttcagatgccttctccaatttcaaacaatttaatgaaaagaaaa

SEQ ID NO: 395172 - DNA, 212 bp, Homo sapiens
tgccattggatggatgcttttagctttctgtagctgtgatttttaccccctaattttgtagatgaagcttttaaaacactccactcatttgaaataaaaataacaaaggaaaggctgaacaaattcaagtgtctttcctcttttctgtctccttgcaggaaaaaatcatatttcttgggcagagtgtatatactgtatctttttcaatgact

SEQ ID NO: 395173 - DNA, 371 bp, Homo sapiens
ttgtgaatctccagatgagggtcaggccgaggggtagcatcagagaggagtgtttggaagggagtgtaccagtcttggtttgttgtggcaggggaccctaggaggagttagtcatctagtgcccacagtgttctaggtactcagagcttttttgcgtttcaaagattaaacaaagtcttttggatttttccttacaaatctgcagagtgaattttctgcctcttgaatttaaatgtgaagtgtcacgctgggtgaaaatatgaacatgtgaacacaaagcctttcttagcctttcttctttgagagttcgattattaaatgtcttgattagtgtcactagggttatattgtacttggccttgccatatgca

SEQ ID NO: 395174 - DNA, 355 bp, Homo sapiens
atttcctgctcctgattatataattatactctggggtgaggaatataaaggaattctgctatatttttgcaactcttctgtacatctaaaattagttcaaaagaaaagtttaaaataaaaggaaatggttaagcaaactaagatacagccatggctgggtgcagtggctcatgcctgtaatcccagcactttggtaagccaaggcgggtagatcacctgaggtcgagtttgagatcagtctggccaacatggcgaaaccccacctctactaaaaacacaaaaattagccgggcatggtggtgcatgcctgtaatcccagctattattagggggcgctgaggcaggagaattgctt

SEQ ID NO: 395175 - DNA, 1013 bp, Homo sapiens
gctgagctcgccgggccggcccctccgtggggccgcgctgggacgcacgcgggtggacgaggggaccgatcccgggcgcccatggccggggccgccatggccgagcggggccgcgtgcctccccccgcacccgcgcccagcacggaggggctgccgcgcgccttcctgcagagcctgcgcaccctgttcgacatcctggacgaccggcggcgcggctgcgtgcacctgcgcgagatcgagtcccgctggcagggcaccgacgcgcgggagctgccccgcggggtgctggagggcttgcgccaggtggccccggccagcggctacctgaccttcgagcgcttcgtggccggcctgcgcacctccctgctgagcgccgacggggcccccgggaccccacgcgcgccccggcccggcccggggatcagccgccgccgccgccgcagcgcctggtgttcgctccggccgacgagccgcggacggtcctggagaggaagcccctgcccctgggcgtgcgcgcccctctggccggtcccagcgccgccgcccgcagcccggagcagctgtgcgccccggctgaggcggcgccctgccccgcggagcccgagcggtcccagagcgcggcgctggaaccgagctccagcgcggacgcaggtgcagtggcgtgcagggccctggaggcggactcaggggatgcccggcgggctccccgtgcccgaggggaacgtcggaggcacaccatcgccagcggcgtggactgcggcctgctgaagcagatgaaggagctggagcaggagaaggaggtgctgctgcagggtttggagatgatggcgcggggccgcgactggtaccagcagcagctgcaacgagtgcaggagcgccagcgccgcctgggccagagcagagccagcgccgactttggggctgcagggagcccccgcccactggggcggctactgcccaaggtacaagaggtggcccggtgcctgggggagctgctggctgcagcctgtgcc

SEQ ID NO: 395176 - DNA, 270 bp, Homo sapiens
cagcggagcactaaaataatttacaatatgtaaattatttccttttatggtttgtgctttctgtggtctaataaactttgcatatctccaagttacaaagattttctcctatgtcttcttctggaaattttataggtataagtgtatttgtttttaagagacagggtcttgctatgttgcccaggctggagtgcagtggctattcacaggcacactaccactactgatctacatgggagttttgacctcctctgtttctgacctggacca

SEQ ID NO: 395177 - DNA, 383 bp, Homo sapiens
aatgctaaaatatatttcagttcagtatcattttcccatgttttaaggctgtacatgctctaaaatataaatctaagagctcagaggagaaggaagtttttagtttttcatgtttattctgctgcaatttcattagcattacttatttgaaatcaacctaagaattcacttgaaaaaaggaattcggtaacaaaacaatatgtgatactaacttatctagctaccgccctcatttttataagtgagatacctcaggtcaacacatttcttgaaataatttgttatagatcttataacaagttagaggtcagaacctcagtccagtgttctttcatattccccaaactacagtgaatatgtccagtaaagcttggatataacaa

SEQ ID NO: 395178 - DNA, 424 bp, Homo sapiens
tttttggaagggtctaattttcatacacagtggatttgccatggaaacaccgagtatgtgcacaagagtcctgttggatctggaaaagtgaggaactttgaaaatgcatcacactgcctgcgtactgatgctgccccaaattctatatccccctggaatcagcatggctgcaggaacatcttctctctgccggtcaaggacactcctcagcagagtggccctttccgaagctgaaacaacttctgcctctacttgcatggcttcccaaaggctggatccttgtgggaatgcatttcaaaagggaagaatcaactgatttcggggcatgcaatcaagaccctaggtatcagtatgaaggagttcttcatataatctggatatgagcctcagttaggtatatgtatagtaaagagtttctcccaat

SEQ ID NO: 395179 - DNA, 369 bp, Homo sapiens
cgtgtaagtggggtgaggaaggcaggaggcccagagcgtatcctggcagtgggttgctcttgagttgggagaggtgtctttcctttcatatacaagttaagccttctcctcaagggattgtgtggagaagcccagcttcccacagattcagcaatataaacaaagaagaggccatgtgactggaaagaattctttgctgggtgcttcatgctctgcccaccagagggcagcagaggtctgtcatagaccatttccaggcaagagactcaaaagggcaaaagggcattctaaaagataaagtgaaagcttgctatcagctgtctaagctcctggatcccgactgaactgcacttaataaattaagaccta

SEQ ID NO: 395180 - DNA, 486 bp, Homo sapiens
caaaatgataagctgatttttctaaaagataaataaaatgaataaactgctaaccaacccagccaagaaaagaattcgcaaataaacacaatcagaaatgaaaaaggcaacattacagctgataccacaagaacacagaataccatcagatactattatgaacacctatacaacagactgaaaaacatagaggaaatggatgaattcctggacatatataacctaccaacaatgaatcaggaataaatagaaaacctgagaagactaataacaaataacaagattgaatcagtaacaaaaagtctcttaacaaaaaaaagtccagaaccagatggcttcactgccaaattctaccaaacttacacagaagaattaacactaattgttatcaaaatattccaagaaattgaagaggagggaattcttcccaactcattttacaaggccagcattactctgatacacaaaccagacaagggcacaaca

SEQ ID NO: 395181 - DNA, 328 bp, Homo sapiens
atccatatatccactctgcagaatactttttctcctagaatcagagatccctgagtactaggactgagtcccccattaagagatcaataactagcctgcctccaagcaaccaaaaagcttcttcagagatatttcaatcacccacttgccctagatgtggaagttcatgttctatataaaaggagtttggacgaggcccagtggctcacacctgtaatcccagcactttggaggacaaggcaggcagatcacttgaggtcaggagttcacgaccagcctggccaacatggtgaaacccccatctctactaaaaatacaaaaattagcc

SEQ ID NO: 395182 - DNA, 231 bp, Homo sapiens
tgggaggatcacttcaggccaggagtttgagaccagcctgggcaacattgagagaccctgtctctacaaaaaataaaaatattagctgggcatggtggcatgtgcctataggcccacctgctcaaaatgaagggagtaggggcgtaaccttctaatgcatttggtctttaacattttttagctgttgagcttaaagaaaaggattttttttccctaaagggaaaaaagcta

SEQ ID NO: 395183 - DNA, 655 bp, Homo sapiens
gccagagcatctttggctgaggctggtgaggtagcaaatctcatagattatatatattttaaagagagagagaaagtgacagagaaagagagtgagaaagagagagagagagagaggagattaaggaagtggttcacatgactgtggaggccagcaagtccaaattctgcatggcagtgctgtaggctggagactcagagaatgatgttgcagctctagtctagaagccatctccaggcagaattctctcttcctatggggaggtcagttggttttctgtttagggcttcaactgattggatgagatttgctcccatgatggagcataatctgctttattcaggctactaatttaaatgttaatctcattttaaaaatgccttctcagtggcatccaaactaatgtttgaccaaatatctgtatgcagtggcccagccaagttgacctataaaattaaaccactagaaccccaaaacagagaatcagatttttccacttcccttattctctttggggcttctgcaaatccctggagtgagacagaggggagcaataaaataaactgattgtctgccttccagtgggtgcaggttcacttgatcttagccaaaaggccaagaaatgatagtgaatacaagttcaaggaaaaattaa

SEQ ID NO: 395184 - DNA, 344 bp, Homo sapiens
gttgtgccaagccaggcctattcttagctagccaacaacattctttcaaaggatattttttggttttcatcaaatgtaaatagtgtttaagagtctgtaatatcatttagaaggaacaaatggaagtattaaacctttattgactacctacagtatatagaggatctataacttatgatggttttattatagtttctcaaccttacaatgggtttattgggcattgggtacattttaaacttatgatatattctatttacaaggggttcatcaggatatgacctcactgtaagcccaggagcatccgtacgtacaagcactgtgcttagcgctggagttacagg

SEQ ID NO: 395185 - DNA, 380 bp, Homo sapiens
gggtcgttaggttagatatatggctattttattttaaatcacagcaaagttatttgtgttcacccttggggtttatttagaaaatacaaggttacaaagggcttccaaagatcattattagcagtaagaagattaccgaggaaaggaaaagtggtaaggaagtgggaagaaaaccgaagactgatgactgaataagatcttacatatttgcatagctcagaaatttgaatactatatccaggagtctatttttttttcaacttgagaaatgggcttttcctgaatatgtttaaaaatatatttcctactaactctctaaaaaattttctgctaactcaacttttcaacctttgttttattcagtaagagagttagcagga

SEQ ID NO: 395186 - DNA, 721 bp, Homo sapiens
ggacctggcgcttttactactgagacacctatgatatagtgactcacagcgaaaacctcccggcatttttacaggctgaaagtgggcagatcacttgaggtcagaagttcgagaccagcctgaccaacatggagaaaccctgtctctattaaaaatacaaaattagcaaggcatgatgacgcatgcctgtaatcccagctacttgggaggctgaggcaggagaatcgtttgaacctgggaggcaaaagttgcggtgagcttagattgtgccactgcactccagcctgggtgacagagtgagactctgtctcaaaaaaagaaaaaaaaaattatcaaatagcagaagtttttctttatgttctgcacacttactatttaagtaccttgttaattgtggtggctttgaactatcattagctaatagctgtgggcacattatatacttgatatgtttggatattttgtccccaccaaatctcatgttgaaaggtgacctccaatgttggaggtgggcctagtgggaggtgtttgagtcatgggggtggatcctcatgaatgcttggtgctgtcctccccataacaagtgagttctcactctgtgatcactcgagatctaccagatcgacttgatcgtgcagctgctgggcacgcccagtgagaacatctggccggtgggcgtcctgggcagacccgcagcccccgcccgtgcccacgccctctg

SEQ ID NO: 395187 - DNA, 975 bp, Homo sapiens
ggcttgagtggtgactgccttgttttctgtggacctggaggccctgcatgtgatctccaccatggcaggtccttggcaagtttggtttttgtgatgccaggttcacttcaagtcagatcccaactctatttttacagagcagactgtacatttttaagagggaataattttctgtttcatggttccatggtcagttgctactgactttgccacttcaagttggcatcatattttttttagagctggaactcaattcttcataagcatggtaagttctgctgctgtgcggtgctgaaatgggcctgtaacccatctcaccagagtaagcggctttcttcagctcgtgtcccttattccatttccatacaagcatttgatgaaaattccttctttaaaaggatacagggaaggctatttttaaaaaaggtatatgaaaatgaatgtgggaaatataagcaaattatgtgtcatgcaataagattcaattgaagatcaaagttaattatcaggaaatatgttttagcaatttgacagcagttaacatcatccttagacacactgcttacacgttccacatataacagaaacatcaaataggataaaaatgcctcagcacctttgatttctacaaaagtcatgaaatcagcaagatcaacatcttgaccagaccaaaaacttctagactcactttcttctcctgtgtctgtaaagttacattcacgggcatcccgtgtgactgtgcttcattagaggaccacaaatctaagaggaaggaatcaatgtagcaaggaagcagagatcctcataaaattgaaaacaggattgtggtaccatttctgtattttccaatatagagcaaatcattaattttagtgactgaaagtcattcctttttatctaactggcctaaaacagccttgctttggaaataatattaataacatgaataaagagatattttttcttactacaaat

SEQ ID NO: 395188 - DNA, 238 bp, Homo sapiens
agcctctgacagggagacggccaagagtcacaggacccaagaaaaacacaccttagaaagctggtctagtttgcttgcccattctgggtggagggccatgtccttcaccaaatattgtgggtggaccagagcaggtgttttaggatgctcacatgttttagtgggacctcccttctttgcctttggtggggaccatcaagttctctctgattcctgggttcctaaaagggactttcca

SEQ ID NO: 395189 - DNA, 350 bp, Homo sapiens
ttgttttggtggtgaggcaggagttgaaggacacatacaactcctgcgtgtccttgaattttttggttttattttgtcttgcagggtcctagaaatttcctttttgcctcttttcttcttcactcccaattgctgaagggcagatttcccttcctgtttgtcttttgtctcccccagaagctttatatagagaaaactgctcctgtaaaatatgcatacttttaggcccttttttgtagtttgtgtctatctgaaaaaatctgtagtatttttcagacttagggcagacaatttttctggtggtggttttagatcaatcttaggacccactgctagttcatttcttccat

SEQ ID NO: 395190 - DNA, 436 bp, Homo sapiens
ctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaaca

SEQ ID NO: 395191 - DNA, 438 bp, Homo sapiens
aacgggtgatgcggttgccatattgcccaggctggtctcaaactcccgggctcaagcaatccacgcacccaggcctcgttctcctgctgttcccctctcgtagcctggaatttttagggcccatgacctattccggtaggttcttctaggcagaactgacaaagtgcccaaccactactttaactttgaattctgctccaggtcttgagaatcatgcccccaggacccagcatcccctctcctggttgaatgtggggcatttcctcccaagcgtggcaggagattgcctttcccccaactctgctactgcttcaacactgctctctcctgtcatccaggcttccctgggtaggaatcagactcccctccagggtgttccccaagactctcatgctcatgcttcccctggctgaagcccctcaggagacaggagtgaaa

SEQ ID NO: 395192 - DNA, 274 bp, Homo sapiens
aatcacttgagcctgggaggcggaggctgcagtaaaccgagatcccgccaccgaactccagcctgggcgacaaagctgagctctgccttgaaagaggcaaagagaaggaagggagaaaaaggaagaaagatggggagccacagaaagcggctttgctgtagggctggttgtagggctgcattcactaaggctccatgggtctaaggccaactccgaggatggaggtcagcacagctggcgtcccctggggctggagggctgtgagccaccggca

SEQ ID NO: 395193 - DNA, 326 bp, Homo sapiens
caattgctacttaaattctctaatctttctgcctgaattctttaaataaagttaacactgcttggtataaccccagcacaacacaggataatgctcccagtactcccagtgacacaaacctgctagagaaaggaaaacgattatccatgatagtatgaggcaggaataaaattaggccatcttgccatagcaggcggtcttcttttggttctatgacacagaaggtggcttgatcacagcacaatttctttatcccaacttcctagcaatcaaagagtttttctcttggtggagcacaggggctcacacttggaatcccagcacgt

SEQ ID NO: 395194 - DNA, 761 bp, Homo sapiens
tattaataacaatgctttgttaatataatatcatttgtttgttttttttgggtttttttattgttggtaacttttttttttttcgaggcagggtctcactctgttgcccaggctgggatgcagtggtatgatcacagctcactgcagcctcgaccacccaggctcaggtgaacctcctacctcagcctcccaggtagctgggactacaggcgcttgccaccatgcctagctaatttttttgtattttttgtagagacagagttttgccatgttgcccaaggtggtctcaaactcctgggctcaagcaattttcctgcctcggcctcccagcactttgggaggctgaggtgtacagatcacctgaggtcaggcagtcccagagcagcctggcggcatgttgaagccctgtcactgctgaaactgcacaaattggccgggcatggtggtgcatgcctgtagtcccaattctgctgaggaggagcgacggcggcagcgatcgttgaacccctggaaggcggtaggtttgtcggttgtgcccgagcatccatgcacacagctgaagcattgagtgagattctcctcctaaaacacgccttctcgtgatcgtggacaactttttcacttgtcagcgccaatcttgccaacagtccccctctatcaccatcatatggggggtgggcccccatcacaaattgtggcgtctgccgcaaccaaaaaacaacacaacaaaatttcccactgctcaaacattaacaccttcg

SEQ ID NO: 395195 - DNA, 342 bp, Homo sapiens
tgcactgtcacccgggctgcagtgcaatggcacgatcttggctcactgcaacctccacttcccaggttcaggcgattctcctgcctcagcctcccgagtagctgggattacaggtgcacaccagcacacctggctaattttttgtttttttagtagagatggggtttcactatgttggccagactagtcttgaactcctgacctcgtgatccacctgctttagcctcccaaagtgctgggattacaagcatgagccaccgcatccggcctggaattgctttcttaattttacttccagattgttcactgctagggtatggaagtgcagttgatttttatata

SEQ ID NO: 395196 - DNA, 310 bp, Homo sapiens
ccagaatcctaaaccttaccattacataatatatacatgtaacgaaccgggcacggtggcctgtaatctcagcactttgggaggctgaggcaggcggatcacctgaggtagggagttcaagaccagcctgaccagcatggagaaaccctgtctctactaaaaatacaaaattagccgggcgtggtggcacatgcctgtaatcccagctatttgggaggctgaggcaggagagtcgcttgaatccggaggtggaggttgtagtgagccaagatcatgtcattacactccagcctgggcaacaagaacgaaa

SEQ ID NO: 395197 - DNA, 813 bp, Homo sapiens
gttaagtgactgaatttgggttttaactctggtgttctcgtgaccctttatgaggcagcactttcatttttctccagagtctcctggtcgtaggtgttaactttgggtccaatctgccttcccttggctctttctagatccgatttctttaccttctccaggccaacctcggggtgtggtcctgttcatcaaaacaatgaacatggagtttagagtccagtgagtcaataaagcttttttttgtgcaacctgatctaacatggagatgttttctcttgagtaaactcactgagttttccatcttaaattactcagcagtgactgagagctacctgcatggaagcaggaagttactccagtgttataaacaaacttcttagactcacgacatcactattctccatccctttttttttcctgtagagtccaaaaacctcaaccgtctcatttttaaattatccaattggagttacctttttaaaaaagttattcttaaggactttccaatacctctcctgaggaagacatgtcaggtcttctaaaagtttacattatgaccaaagaaagatgctggtcctcaggcattctacccagggggctgttctccaggccattcccacctcctgctaagaccatggggagccctctctgtaaggaggggcatatgcagggacctgcccatccccttggtaagctggatggcaaaaaggcatgttgtctgcaccactggctgcctgctaatgtcgctgtcagtggggaaggagaagtgacaacacgtttgagtgcatttgctttgactcttagaaacccaag

SEQ ID NO: 395198 - DNA, 329 bp, Homo sapiens
agcatcacgtgggaatgttacaaatgcagactcttaaggtccacctcagaggtacagaatcagaatctataaggagtgagcctagcaatctatttgtgatggggcagggagagcaatataagatgtatcactttcaccattttcaagtgtccagttctatggcattaagtacattttcattattctgcaaccatcaccaccatccacctccagaacctttcatcttccgcacctgaaatgctgtacccaccacccatgatctgtttaaacaagcccttcaggtgattctatgccaccctagtgtaagaaccactctacaatcacatgag

SEQ ID NO: 395199 - DNA, 387 bp, Homo sapiens
gtgaagagcccaggagtccctgaacacacacttctgcctctagcttttcagtatgtgtaaagcccatttccttacaaaagcttgccaggatcctgcattttggttccgaaaaatcaactcttcacaatattaattgtacaagttaaagatgggaactatttggctcatcaggagaaaaaaatatttttgggggttgtttttttcctcaaatcatagcaagtaaaatgtcagttaagtgttggttctgacagccaaggaagctcacatgatcttagaattaatcagtaagagtacagaatgaaagataagcaagaattgcttcactctgtactaatcagaatatacctaaaagattgagtcctggccaggtgcagtggctcacgcttg

SEQ ID NO: 395200 - DNA, 424 bp, Homo sapiens
ctctgatcgctggggcccggacatctgcattttgaacgaccccctgggcgtggtgtgtgggacggtgagcgttctacggcgtgcgcaagtttgggacctgtggcccctttcctgccgcgctgctccaggagcgaaatggctccccagggctggagccacgtgctctgccgcccgaggcagtctgggcggggattgagggaggaggagcccgccggtgtggcacaggctggtggacgctagcgcctgcagaatccggcctggagggaaggttgctgcacacgtgtagacactcctgcccaaccctctgccccgggggtccccaccttaaggctactctgaagttcccagtcaatacctagacttgggccagttgatgggtttggcagctggcagggatgccccgagggctggcccttgcacgagg

SEQ ID NO: 395201 - DNA, 661 bp, Homo sapiens
tttttctcatgacagtgtctaaatccctttggtttgttaggcactaatgtgatacattattgcactaactgctattttttcaatgaaaacacagcaatcctaatgactaacttagacaaataatgattgccacactttgaaaagaaagcaaagatatttaattctctctgcttcattattttactatgcctgagaaaccagcgtgaagattcattaataatgttagaaataacatgatttcatgacaacattctgcaagttgcttttaactccatccagtttcacagttctggcccacaaaaaggccaaattaaaacatgacatagagaaattatgtttataaactatggaaaagtagcaattaagaagagtactcagacccagtcatatccatgttagaatgactttgaaggaattatatgtgtatactatataggtacttttagaacatgttcaattcttgatctcattagcaagtgcactgtggcttgtaagaacaagcaagcctcttttgactcaatctctctctcttttcctcccccgccccgccgtctctctctctccctccctcccttattcccttcctccctttcccaacccctccttttgaaatgaggacaccagaagtctactttttcataggaggtctttctatgtcatt

SEQ ID NO: 395202 - DNA, 301 bp, Homo sapiens
tactaagtcctggaaatgtagctaatgggaatgagaaactgaattttcaatttacctctaattaatttaaatggaaatagccacacagggataagagctagcagcctggactgcagagcctgagaatcagaggacacatcttgtgagggaaaggcatcaagttgcaagaaaagaaaacccacgttattcatctaacaaagtacaacaacaaaaagaagtgtgtttgctctggtttgaatccttggaagaagtagtcaggatcagagctatgagaaagagaaggaaaaaaagcaatcaatct

SEQ ID NO: 395203 - DNA, 374 bp, Homo sapiens
ttctgggggtccgggtgggtagcggcgagcgctgtgcggccgaggcggggctcaggtgcgctgtcgggggtgcggggagtggacgcggcccgttcccgccacacctcaaccctgcttccacgtctcttttcagtcctcctcgggatcgctcatcacccgccccctgcattttctggtcttgtcctgcactttctctcctctcctctcctccgtctcctctcacttttcggacaaaccagtctttctgaggcccctgggttcctgggctgctcctgtgaatggcattcgagggcccttccagcgcggccgctgaggcagccacctcccccggtgctgggggcggccctaaggtccctgaagccctgtcctctccc

SEQ ID NO: 395204 - DNA, 540 bp, Homo sapiens
tttcaaggttgtgcattggcaaaacttggaattattccctcaaagttttgatcctgtaagtttagtctgtgtttagctccactgtactgtctggtgaatacaaaccaaactgaatcaaataacccagtgcaaccagctaactaaccacctccccaggtgaaaactaggaggggcagggaagcggtggaaagaaatgggtttgtggttttctggtttgtggttttctcatttatatgagtagttgttatgcttgaatgtgaagttcttacacttgagtgtgaaggtcaccccttcacattgcatagtgcaatgcagattctcaggccccgccatggaaagtctgacagtgtgtctaggctgtagccccagaatatgcatttcttttctttttcttaaagaggcaggttctcattctgtcacccaggcatgtgcagtggaatgataatggctcactgcagcctcgacctcccaggttcaagtgatcctccagcctcagcctccttagtagccacaggcacatgccaccatgcctggctaatt

SEQ ID NO: 395205 - DNA, 229 bp, Homo sapiens
catccagtgatctccagtgtggtcctaagctcactcgttcagcatcatctagcgtgtggagtcctggatctcatccttggatttgcagggatggtcctaagaagctaacggctctctgtatttgacaattattgtactgtaatgtgctgcctcctaggggaagatctagaggtgaacatactcaggttaaagggctccccggggggtacccggagctccgaattccgga

SEQ ID NO: 395206 - DNA, 412 bp, Homo sapiens
gtggcgtgcacctgtagccccagcaacttgggaggctgtggtgggaggattgcttgagcctgggagttagaggctgcattgagctgtggttgtgctcctgcaccccagcctgtatgacagagtgagaccctgtctcaaaaataaataaataaataaataaataaataaataaataaataaaaaagagtagagtgctcaattcgtcatcctctcctgggatgactgctgccatttgtgctttggactaggcattctgctaagtgctttctacacgtcatgtcagttaattcttacaaccaccttgtgaatcaggcaacactgtacccatggttcagatgagaacactgaggtgaagttacctccccaggccaagtggttgctgcatgctggtggttaggcccacacttgggcg

SEQ ID NO: 395207 - DNA, 588 bp, Homo sapiens
catggttacacttcaaaccaagcacaatccattcgctaacataccatcgtaatgatcttacaaggaaaaagggagatgagagttcttcagcccaagacctttctctagtgttgaaaccggaggcttcttcgcagtgagcagaggtatctcccttagcaccatctccaaaggatggggactccttcaaacaaaccaaacttccccaaatcaccttaaaacagtagtagtgaaggttcttacgacatatgggcaatcaggacttagtaatgtcatgcttaggttaagactgacataagattctctttgtatgcaaagacattcagcaacacctgagcagcccagacaagataagggggcacagctactgccagaggtgacaatgctcaaaaaggttccaaacatatacaggaaatggaggtttgtattccctttagttcagtgagatgaagaagctagtgaggcaggtgaagtccatcacttctcccaacccacccttcctttgacaatctgcgtgtgaacctaggtgtgacttgggcacgtgccttcataactaccatacagaaccctgtccccaatagctggaaggtc

SEQ ID NO: 395208 - DNA, 368 bp, Homo sapiens
ttagatttccaagtagcttctcatgacttacaggagaaaataattttcaattaagaattcaataaaaaacatcagaatacaattacaattgtggttgttacattaataaaaagtgcactttcctgacttgcagggacaaacatttatggagtgtctactatgcagccttgctgaagcaacagagagacatggttgtcattctggaggtcacaccttctgcaaagacagcaaatgtgtctagtttctggggcctaaaatgagagctagagagaaagagagagagagagagagagcaagagaaagctacacatttacatattcagagcctcagagccaggccttggtcctccctgccagacatatcctta

SEQ ID NO: 395209 - DNA, 467 bp, Homo sapiens
tggtggaatgtcatcagttaaggcaggaaccggccattttcacttcttttgtgattcttcacttgcttcaggccatctggatgtatacgtgcaggtcacaggggttacgatggcttagcttgggctcagaggcctgatactaaccataacagatagaatttaaaaagcagaggaaccaaaaacagcccaccactctcctgagctgggagaatttgcccagaattccagggataggtgtgtcctaagcttccgctaggtagggtcaatgcccagcagccaagccagaaggaagatttgggcagacactgtcattggtgaacacgtaagctccagagctagaatactactgatgatggtgactggctttggttcttccgtctggtctgacacccagaaagccgatcagactcaccgctatgaaccttctagtgccacagcaggccagaaaccacagccctgcctcccct

SEQ ID NO: 395210 - DNA, 343 bp, Homo sapiens
tgctatggactacacccattttaaggaggtgcagactgaagccacacagctcataagcagcagtgtccagctggacctgagctctccgattccaaagcctgtacatttttcaggagcctcatgaggctgagccacgtcacactggcagcccacactctggaatgagtcagtccccagggagcagaacagcatccgtcttaactgtttgtggaggtgaggccagatgaatttctcatgctacttttttttttctttttcttttttcactctctttttttttttttttgagacaaagtcttgctctgttgccatctcggctcactgcaacctctgcctcctgggt

SEQ ID NO: 395211 - DNA, 468 bp, Homo sapiens
aaccacccaatagaaaaaaaatggccaagtacacagacaggataattcatagggggaaaaatacaaacatcttctaacataggaaaaatcaaagcccctcctaagaagaaaagtgcattattaaaagtacactgcatttttaaaagtacactgctttttctcacctatcagattggtaagtaccaaaacgtttgctaacacatagtgctggtgagggtgtagggaaatagacactctcattcactgctggcaagaacatgaactgtaaccctatgatagcccacatccaggaagttttcctatgtgcattattaccctatgtctaaaacaacgtccgggatgttcattaagggactgctgatggtagcaagaccagcaacagtctaactgttgatcagcagttaacttaggatatatatcccaacaactggatattacgcagccttgggggaaaaggaggccataggt

SEQ ID NO: 395212 - DNA, 220 bp, Homo sapiens
atattttcccttcaggaacactcttctctttgattttacttaaacattaaaactgcgtaagtggaatctgttcattcctagtgaggtagtgtctttaagttttattgtaagaatattgtaagaactgtgcaggatcctatacaaagagtattttttaggagcctgtgtagttaaaaacgtcatgttacttttggttactttttgacaacggtgagtattt

SEQ ID NO: 395213 - DNA, 245 bp, Homo sapiens
agaactatttcatcactagtattacaaatcaacatttacattcaataatgaacttcggtggggaacaatgtttacagatacacaaactttggtaaaaggaagggagattcaactagaagccagaacccctaaatgctcacaaaatagagatgaggtgggatataggtatcagagcaggaagccagctgacagctcagataaggttgttgtgaggtggcactgccatggtgagagtcagtcttcta

SEQ ID NO: 395214 - DNA, 468 bp, Homo sapiens
aatttcacagaaaacaaaagacatacttaaatctgagttgttcagaaatcatagaaaatccagacattcaagcattagaaattaactgagtttaaagccacgcagaatcattttatctaagtgccagaggtacttcaatatttataactgctttggaaagatcagaaagactagctccagcctcggaaaaaggtttcctgacttttgttcttttgactatttccaaggtctacctttgggaaattaacagaaggcaaattcttgcacactcattcatgtcctgcttcttgctctcagttaacctctggtgaagaggaaagaagttaactacaattcctcctgttctccccgacaccttgccccaaatcagtgtcttcaatagcaatgcctaaatcaaatggaaataaaagatattctagaaattcatacttccttggaagtatggaaacttaaattttcctaattata

SEQ ID NO: 395215 - DNA, 433 bp, Homo sapiens
gtatcctgaaactgctgaagttgtttatgaaatctatgagctcttgggcagagattatggggttttatagatccagaatcatgtcatttgccaacagggatagtttgacatcccctcttcctatttgaatggcttttatttctttctcttccctgatgactctgaccagaatttccagtactgtgttgaataggagtggtgagaatgggcatgctcatacactgccagtttttatggaaatgcttccagctgttagtcattcagtataatattagctgtaggtttatcatagatggttattattctcaaatatgttccctgaggaacattttgagggttattgagggtttaaggttttaaacatgaagggatgctaaattttatagaaagccttttcagcatctattgagatgatcatatggtttttgttttt

SEQ ID NO: 395216 - DNA, 322 bp, Homo sapiens
gcactaaagaaacatcaaatacatgttgaggaaaaccacagatcagtctaaaactgagtaaagcaatgaacaacatgtattaaaacatgcttctattaaacaaagtaaatctcagggaccatctttggtttcactaagtccactcaggaagagacacagcatgttcctaaggcaatgtaaggttcatttcctcatgcatagcttgacagagcacttatggcccatcgcagaatgtgagcacccttttatcatcacagactctcaattcagagctttgctaatttgaaaaaatgtgttttaggttgtgatttggcagacataa

SEQ ID NO: 395217 - DNA, 573 bp, Homo sapiens
gcacacagaatgcacacgtacacctacccacacacaggcacgcacatgcacatactcccacacatcatgcttgctcacccatcacgtacacacacacatacacacacacacaccccaacgtgaatctgttttgttttaccatggcctagtcccaacccccttcccagttatgtggtagccttgacaacaaatagcccacaatcatggtgaatgcatgtctgacagccactagaggaaagaaaaatgaagttggagctccttcaaagcctgattcccacagaactgtcattctttggcctctctggtagtttccaggaagatcccacttacaatactatgtttatttgacctgactcagacctcacctagcatgaactgcctttttcctggggagtttctcaaaaatactcagaggcatctgtttaacattgtagctgtcttgggggtaaataacagttgggggaaccaacaagctaactgaaagcttaaaaggaaaaggtaggtaattacatgtccatatggtgcactgaagctccaaaattactggtaggaatctagaaggccgtgtgcatg

SEQ ID NO: 395218 - DNA, 553 bp, Homo sapiens
aatccagttttgcaacatggcaaagtgaaatgtgaaaggcagattaaagttccagtactggctgagataattaatggtttatgattttggataagttactttaagtttttcagctttagtctcttcatctgtaaataaataggagttatttactttaaaaaatgtgtgaaagtaaaatagaatcacatattcaaaaatgcctatctcagtatttggttcatggcatacctccaataaatgtttctttgtccccttcccacttaatattattgagattgtttatctagatgtgatggatcacatctggcataagtatatcatgggagaatttcttttccaagaagattaaatccttagtatatttgaatgaaactttattaaatagttattataaaatctaatctctattgaacactttctatgtacattagatattctgcatgaaatattacatttaattctgactgcaattttatgttatttctatcattctgttttgtagatttggtcattcatataaagaataaatggttatgcagaaatgaaaactaag

SEQ ID NO: 395219 - DNA, 1336 bp, Homo sapiens
acttccgggaagttttcggcgacctggataccatcttcgacacggggacaaatcccgggatggagtccagggtttcccgcggcttcggcgcttcctgacctggcgtgactgccgacttgtcggcaccacccaggcctcaggctccctgtctgtagtggtgaatcgaccttcctcatggcagtccaggcttcccaagccccatgtcctgttgatccgggacaaactcttccttgaacgttcttcactacgagccgctgctgatctgtactgcctggaggagcatttccatagcgcccgcaaaaatacaataaagctcacccaaggaaataaccatggattctcacgcctgggtgccagtgtttggaatcgactgggcttttttatgttagtaggcaatttaaaacaattacttatttgaaatcagaagcgcaataggcataacttcaggtacgtgctccaccaccacgttttgtggatttttctttttaaacatcagttctgttctctacaactctccgccttcagggttatactttccaggaacaatagcttcccaattcggctttgtgcatccatttttcatacagcatcgttgtagtcttcaaatacaaatatgatcacggcaatctgctgaaaaatctttggtggctttcccttgctcttggacaatccctgattgtccaagttttcggcttcatctcgttcgcccaccatacactgaactataaactgtagtggctttttttcctcaggtcttcccacagactaagtaccaagatttttccaccctaccctcatccgtgctcattccgacacactttttgcctgtttgacacctcatttattgtcagatttcaagaatcgttttcttcggggaaccatttcttgactcccttactggatgaaacaagcctccctgttaaacagtgttggaggcgcagaaacatacccccaaataatggcgttttgacatctgaactgaagaagcctcaaggtcccactcccctaaatccccacgccatctctgccaaagcaaaggataaagtttagacacatcacaaggaacataattgtttttgttgcctccctgtaagaccaagaatgtagtaatcacacctgagcagaccctttcacaagatgttgtacaaattaatgtgttcctgatacattcattctcctttgtaatccctcaacagaattcctcttctccctatcataacctgtgtcgctgggattgtatccacaagcttctgaagccctctgaggggtgggtaatcacgctgtgattcttcctgtgtatacacgttaagtaaatttgtatgttttttctattaat

SEQ ID NO: 395220 - DNA, 1335 bp, Homo sapiens
acttccgggaagttttcggcgacctggataccatcttcgacacggggacaaatcccgggatggagtccagggtttcccgcggcttcggcgcttcctgacctggcgtgactgccgacttgtcggcaccacccaggcctcaggctccctgtctgtagtggtgaatcgaccttcctcatggcagtccaggcttcccaagccccatgtcctgttgatccgggacaaactcttccttgaacgttcttcactacgagccgctgctgatctgtactgcctggaggagcatttccatagcgcccgcaaaaatacaataaagctcacccaaggaaataaccatggattctcacgcctgggtgccagtgtttggaatcgactgggcttttttatgttagtaggcaatttaaaacaattacttatttgaaatcagaagcgcaataggcataacttcaggtacgtgctccaccaccacgttttgtggatttttctttttaaacatcagttctgttctctacaactctccgccttcagggttatactttccaggaacaatagcttcccaattcggctttgtgcatccatttttcatacagcatcgttgtagtcttcaaatacaaatatgatcacggcaatctgctgaaaaatctttggtggctttcccttgctcttggacaatccctgattgtccaagttttcggcttcatctcgttcgcccaccatacactgaactataaactgtagtggctttttttcctcaggtcttcccacagactaagtaccaagatttttccaccctaccctcatccgtgctcattccgacacactttttgcctgtttgacacctcatttattgtcagatttcaagaatcgttttcttcggggaaccatttcttgactcccttactggatgaaacaagcctccctgttaaacagtgttggaggcgcagaaacatacccccaaataatggcgttttgacatctgaactgaagaagcctcaaggtcccactcccctaaatccccacgccatctctgccaaagcaaaggataaagtttagacacatcacaaggaacataattgtttttgttgcctccctgtaagaccaagaatgtagtaatcacacctgagcagaccctttcacaagatgttgtacaaattaatgtgttcctgatacattcaatttcttgcggtatggcgacccctaacccttgttttaaaaacttccgtcccccttgggagagtttatttttttgatggttaagccctctgaggggtgggtaatcacgctgtgattcttcctgtgtatacacgttaagtaaatttgtatgttttttctattaat

SEQ ID NO: 395221 - DNA, 235 bp, Homo sapiens
tacataaaagtaataaaagtttgttgattacttatatatgagatgcaaaaggtagcaacagtattattaaataatatgggtactgttatgcatatactgagatctgttggcaaaggtagatcacttcaacagaagaccaatttacaaatgtgcctctgtttagaagatagatgttatataaataaaatactttatattagtattacagtagaggtattcattctcattgaccaaa

SEQ ID NO: 395222 - DNA, 430 bp, Homo sapiens
gtgattaagtcatgaggcccttgtgaatggactagtgccttataaaagggctggagggaactagcttaggcccttttctgctccttctctcctccaccgtgtgaagacacctagacagcatcctctatgaggaacagcccctaaacctgctggcactttgatcttgaatttcccagcctccagaactgtgagaaataaatctctattgtttatgaatcaccctgtctcaggtactttgttctagtagaccagctaagacaaaatatccaaagaatgttggtaagagaagagggagggggggtaagagagctaaattattacctaacacaccaaaagtccatagagaaggactaaagcatgaagtcacgtatgtgcatattatttggaaacagtatgtgccagtcaatgccagaagaaaggattaagagag

SEQ ID NO: 395223 - DNA, 387 bp, Homo sapiens
tgcagggattataggcgggagcccccacacctggcctagcatacaaatacttccaagcagctattacaaatatgttcacacaactcttagttggttcaggctgctatgacaaattaccatagactgggtggcttaaacaacagaaatttatttctcatagctatggaggctaggaagtctgagattttggtgccagcatgttcatgttctggtgagggccctcttctgattgcagactactatgttcttactgtatctcatatggcagaaacagacactctctgggatccctttcttcttattattattttttttgagatggactctcgctctgtcacccaggctggagtgcagtggcacgatctcggctgactgcaaactccgcct

SEQ ID NO: 395224 - DNA, 217 bp, Homo sapiens
ttctcacagtggagagcgggacattgtaaagagacattcagtgactcagtttttgagtggatgcttttgttttttgttcttagtttgcatctgcttgaatggggtagcattttaacatgggtctaatattaagcaaacaagtatttttaaaccaattctttgtaaagccatggttacatgagtaaatcacttagcttctataaatgtctattaagat

SEQ ID NO: 395225 - DNA, 453 bp, Homo sapiens
agtgagaatccatagctgagaaagactggccctgggtgaaggtttagtggctggagaggggcacagatgctgatgggcaaagatggaggtgtatctgtcatctcatctcttggcattccaccagggacacagacctatttctgaatggttccactcccatgggatctgggttgacctcctgggagaggatcaggcttggagcaatggccctgatgttaacctctcttgccattgggtccacactagtgcctcttccattcactcaactctccaagtatggggagtccatgtcactgtgcccaccgttagccacaacatcctccagtgcactcaggtggaccaaaactatcaggaagggtcagggcagtctcgctcagtgaaagggacagagactgagtggcagaaaaagaggtcagggctccacgaggcatcttctccaggtggggttgttgg

SEQ ID NO: 395226 - DNA, 407 bp, Homo sapiens
tggaaatgcaaataaaaaaggaggtcactattttatgaaaggatgattttattctacctgatgtagccagctgcaagcttcagaaggcagcacatacaataatgatgggctggtgagatgagagctaatggagagatgtacaaagtgccatgggatcaccaagcagtggtcaggtgaaggcatctgattttctttaagatcttgctcaaatgtcatctcctctagaagaaaatgtagggcttcatcagtcagacaacatggggaaattgatctcagttcaagaaacatgtacatgtattgattatctaatacattcaagcagttgtgcactggggatagaaaaatatcatcatcatcatcatcatcaacaacaacaatcttgctgtatgccaggcacataattttac

SEQ ID NO: 395227 - DNA, 427 bp, Homo sapiens
aataaccccttgggcaagaagaagagtctgatgtaaattctatttttctgccttattgttcctgttccaaatttagaactgatgaatgtagtttatgatgaagaaaacccattttgttgctgtgagctagggaattagtgtggaaagagttgtcagagacacaaaaagtggcccatattttaccttgacagtgctttttgaagggaaaagtgaatttagatactaaactgggataatacttcctttataaatacaaattatataagagtagcttaaacttttcattattaacagattattttttgtatatcttgtttagggtagtaaagattaacagtgggtcaaatattttggctagtgtcttgtcctgggatggctcacgagaactgttctactaaatataaggtgaccttgctttttgcttatg

SEQ ID NO: 395228 - DNA, 133 bp, Homo sapiens
cctagtcctggacattctgcccccgcttggacacctccatgacagcactctcggctggacagctctcaatgcccaaaagtttggtcaagtcttccccaactggtctcttctcaagctaataaacaaaaccacc

SEQ ID NO: 395229 - DNA, 422 bp, Homo sapiens
cgctcccctaattgattcaatgtaatctttatcaaatcgtagctagcttttttgcagaaactgagaagctcatcctaaaattcataaggaaatgccagggatccagaatagccaaactatcttgaaaaaaaaaaaatagaaccaagttagaagactcacacttcccattttcaaaacttaccacaaagctacagtaatcaagactatatggtgctggcataaaaacagacatatagatcaaggggatataattgagagtctagaaatgaactcatatatttatggtcaatagatttttttacaaaggagccaaggcaagtcaagggggaaagaacattgttttcaacaaatgatgctaggacaacgggatagtcgcacaaaaaaaaaccaaagttagatcccgacctcacatcacgtacaaa

SEQ ID NO: 395230 - DNA, 406 bp, Homo sapiens
ctacatgtatgctgccagtgataaaagcagtggattaaccattcaccttgctaatgttaagccatcagtatgttttacatcactttttaatatctctttcaagagtaccaagagtgaaaaattgtactttggatcagaatcagtaagaaaataattggcttaataattactgtataaatcaatcttttgtggttttagactgtgaccttgaaacaaaggttaaagattgtaccctaaatcagaccacagcgactgaaggttacttcttatgtaagtatctgattccagttcaggtttcagtctgcatggaggacaagctaagattccgtttttaaaaaataacttttttgcttatgacattggggaacatctgaggcttttatagaaagtaagtttttcattagtt

SEQ ID NO: 395231 - DNA, 276 bp, Homo sapiens
ggatttagctcccctggaatgatttatttcacatcaagccttcttaactctttggctgcagaggggaagtgcctgcatctttctctgcagagttgcctagggctggccaggtgaacagacacgctccctcctccccatcgtgccagccaggacacggtgtgtgcttatgatggagggagttagaatactagccttttcatcacaacagtcataaatcctcacatagggaaatacagataatatacaagtaggaaaaaaagaaaaagaagcagtctt

SEQ ID NO: 395232 - DNA, 485 bp, Homo sapiens
ataaaggacgatgttacacaatcttaaaaaatcagaaaataagagtttgtcatttaatatggttcttttaaagtgaacaatagttaacatgttttaaaatgaacccactcaagatagaaactcctggcttgtacaccaattgatattagcttacgctagcatgaaaaatttgtaggaggtgggcatggcagattaacaagctacgtatttaatattaaaactgatgtctcagaaaaaaacagtaaatcttttagacggatttataactattttctttttgtattaagctttccataaaaataaattttaactaatgaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaacc

SEQ ID NO: 395233 - DNA, 180 bp, Homo sapiens
agcaaattagtcacagctggaaaaaaaagtattgaactagatgacagatctgaggaaattacctaccatgcaacaaagagatgaaaagattcaaaacatgaaagagaagtttagagacatagaagagagaacataaaggtccaagctacacataagtgggttctcagccaggcgcagtgg

SEQ ID NO: 395234 - DNA, 291 bp, Homo sapiens
ttagtttactgtagtctaaatatagtcttagtttaccatattctaagttaatagggattttagtgaatttgtaatgaacctgttttgacagctgaatttaatttgttttattacatgatggaagatgacaatagaactagttatttctagatcagatgggaacatatatatgggctctttcaggtgcattgaggcatcagaaatgtttatatgtggtgtcaactggttggctaataaattcagctcttacaattaaattggaaaacaggtttaaaaataataggcatttgg

SEQ ID NO: 395235 - DNA, 172 bp, Homo sapiens
actaaacaataaagagaaaaacagctgaaaaaagatgtacagaggcaatgttatttttaggacaatatcaaaatatctaaaaacgtgtaactggaattccagaaagagagaaggagggtagaaaaaacagaaacagatgtagaattagcaaacaataactttaagacagtcc

SEQ ID NO: 395236 - DNA, 475 bp, Homo sapiens
acagacagaaatcactgccccctgcacaaaacgctctctgtgttcaaacaaagcagctgtgtggccttccagcagagttctcgctcctcagctgagacctgaggcgggctgaggatgcagaacaaagacctggcatctggaggcccaactgggtgaaagggccctggcttttcaacaacccgacagttcccttttatcacagcatatccctcccagtcagcaactttctcctcacctttgggcctgagtgtgcacccaaagcctggagtttatccactagaatgaggactccaagaaccaagtctcctatctggggctgtggcccactcccttaggactcggcttccctgaaggccaggcccaagggacccctgctgcctgcctctcttctgccctccattgctcagtcctcatgtcagtgagaagggcaagccaggcccttctccttcccctccaaagcccaacctcttaggct

SEQ ID NO: 395237 - DNA, 244 bp, Homo sapiens
atagtactttatatgtcctctgtttaaaaacaaaaggaactacaaagtaatcttgaaatctactgtgaaaggaaaataaaaacgcaggacttcaattcactatgcaaaaggtagaaaagtaagctgaaagctgagtccctgaaagctgagtccctttgttcctaagcagggagctacaaataaaaggtcaaacacctctacaggctactttatgttccattttatcttatgtaaagtgccgact

SEQ ID NO: 395238 - DNA, 528 bp, Homo sapiens
tgcgcaatatataaacatatttagtattaaaattttaataataaaagtccaaagtgttctttggaactttaaccaaactaaaatctgttgttctagaatgctcagccggacacagtggctcactgcaacgtctgcctcccaggttcaagcaattctcctgcctcagcctcccaagtagctgggactatataggcgcatgccgacacgcctggctgatttcttgtatttcaatagagatggggtttaaccgtgttgcctaggctggtctcaaactcctgagctcagccaaggcaggtggatcacctgaggtcaggagttcgagaccaacctggcctacatggtgaaaccccgtctctactaaaaatacaaaaattagccaggcatgttggcatgtgcctgtaatcccaactacttgggagactcccgaagtgctgagattacaagcatgaactgtgcccggccatagatctgtttttattcactatggctgggttctcagtgcgcccttcctatctgaaaattcatatt

SEQ ID NO: 395239 - DNA, 824 bp, Homo sapiens
caacacaggctgcacctgagcatcttctgggggagcttttaaagaaatactaatgtttgttctcatccccagagattttcatttaattattcaaagcaaaatttcaaggaataatgtgagacaacagctttcaagaagggctcagcagaggtactcagagtggagagttggactgaaagagggttctcaggagctggcatcactaagtggaagtgggagtgaggatgatgggacagcagttcaccagcagccaaaggcctggactggggccctggtggagtaggcggatgggaggagccataccttcaggcatagcttggtcctagactggagataagagggctaatggaggagcccaaagtcggggagctcagaagatggtagtctgaggccagaccccagaggaaatgctcttgagaataatatgggagaggctagattctctggagattccagggaatcgacacagaggtcgtttgtaccttgtaaaattctacagaacaatgtgataccaggtgagtgttattaggtaagtcatttaagctcagtgaaaacaagtcctcaattctggaggtagtcaaagatatctcttgcatagatctgtgaggatcagatgctacttggcataaacctaagccaggctcaataaatatcagtttcctctccttccctaaaaacaacgtatcccttggcaactccacaaagctttgacttgtactaactgtatacaaatgtgaatcctctcacataatgataaaatatggttgaggatttgaaacagccaggtgtgtgaattgctatgggcaagaggggaagaaaatttg

SEQ ID NO: 395240 - DNA, 337 bp, Homo sapiens
agaagaaaaaactcacttgacactctaaaagcatttcttactaggtctgtacatcttgggtacagcctttggggacagagaaaggtgggggctgtgaggagagcccagggctctgatagggtggagtatgcagacagaggagctgtatttacactttcacttgctgcaggtatgccacagtgggctttttcccttatgaaaaataaagactgaacaacagaagtgctgttctctgtagctatctgtgatttaaaaggagtacaggagaagctaagtccttagaactctagatgcagctgctccttggagatcttcttagtcgagaaagacttctgaa

SEQ ID NO: 395241 - DNA, 738 bp, Homo sapiens
aaatctgaataaagtatggaacttatgtatccacatggtttccttaactgtgataaaggcaccacattattgtaagaagttaacaggagaatctgagtaaggagtttatgtgaactctctgtactatctgatgatttattctataaatctaaaactattctaaaacaaaaatttcatttaaaaaaggcaaatataactttctcactttatatctgactttttaaaagtaatatcatactgaaaataatatttacttttatcgaagtaatacatgtatgtaattaaaagatacgtgatctgcaagactcatagaacccctttttacttgatttcccccatgggcaaagatattaaggaattttccatttctctattcctttgaagactttccccattgtccctctgttctccttcaatctgaacacccagttatcaaggctgctgattgtctctcactctggaaatcttttttaatagcatccaggatgtctttctattgatgttctttgtagaatatgttttctcaatcctgcgtcctcttcttcagtggcttacttcattctttatttctaggacccaagtttcaatatatttctgcaaagaaatacatgggaggtaaatcttgagagactgtgtctgtgaaatgtctgttttatcctcatacttgtttgaaaatttggctgattgcaggattgttataaatagtttttttctcagaaatttgttatgacactgtta

SEQ ID NO: 395242 - DNA, 320 bp, Homo sapiens
ttcactagcaaatatgtgcattccaatgaaccttggtttaaaatgaccattaaataggaaagatacataccgacttttgagaataaagactgtgcatttatgtagaggagattaaagagaacacggaacaagcctggcataaaagaacttcagacaaattgataacaggtaatattagattttagaagccagtgtaggccgggtgtggtggctcatgcctgtaatcctagcactttgggaggccgacaagggcggatcacctgaggtcaggagtttgagaccagcctggccaacatggtgaaaccctgtctctatgaaaa

SEQ ID NO: 395243 - DNA, 480 bp, Homo sapiens
tggtggttccggtttttgcaggcttagagaaaactgtccatcaggattgtgctgtcttgattttatttgatcattcccacccttttccctttgctgtagccccttgacctgtctcctgggcagttctttcctttgctaaatgtgagtacaacaagtaggctttcctttcctcctagagagggggaccttggagcccctccactgggtcagagaaacttccatagctgcagcagatcagtaacaggagagccgagctttactctgaaagcctctattttcaataatgttgtgtttgctctttggataatcatttaaataaataaacctcagtataggtcatgttcttacctaggtttgcacttaaatagaaggaaaaacatctcaaaccattttgttagttttatagttctcgtaactacactttaagctgtggttttccacccacagggatgtcatctacattatatgctggactgttgc

SEQ ID NO: 395244 - DNA, 274 bp, Homo sapiens
tgtgctttgcttaaaaatgtttatttttatttaaataaatttccttttgttctgttcttagtagtcaccctgatgaattgatcagaaatatccaggccaaagcttcatagcatgtgaaagggttagcatctttaatgtacaaaaacattcttgcacgtcagcatggaaaaaagacattttgcttatttttctagccacatggccgattgtgttaatatagtccctctcccacccctagcaggcccctttttctgaaacacacatagaaacactg

SEQ ID NO: 395245 - DNA, 422 bp, Homo sapiens
cagggacccaggcccccatcttgctgctctgccatgcaacaccagcattcccaaggttgcttatgacccaagatggctgctgcagcaccagccatcacattgacgtttcaaccagtagtaatgaggaaagggtgatgcagagccagttacctcctgtaaggactcttaccaagcacatgtgcacaattccacacttatatcccattgtctggggcttcgttacatgaccactcccaactataaaggagtcttattccaagtggccctgtgccctgccaaaactcaggaattctattactatagaagaaatagaggatgggggataagtaaccatctgtgccacattggggagagtgaaggagataaggtctaataaggtatcaaaaggccaggcgcagtggctcacaactgtaatcccagca

SEQ ID NO: 395246 - DNA, 225 bp, Homo sapiens
agggaattctgcccgtagggacaaagtgtacatcctgggctaggtcatcttggtggtgagaaccccttgccagcgctccaggcccttcagtgtctcagtaggggagaggagggtcaggcagggtgggcaatgtgcggatgtaattaatgctgttttcttttttttttttctttcttgagacagagtctcgctctgtcgcccaggctggagtgcagtggcgcgatc

SEQ ID NO: 395247 - DNA, 250 bp, Homo sapiens
ggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtag

SEQ ID NO: 395248 - DNA, 252 bp, Homo sapiens
tgtgattctttactgaaaataaaacaaaacatcctactgtttgttcctgcaaggaacacaggtccagaattgggaagggtgttggaaatgggtcagaaggaggggagaagagttgagggaatgcattaaaataattttgacacttcattttacctacttttttctataatgaatgtatattttttggataactacaaagttatttcttaaaagttaggactctccaaatgagaaagatgcttgtagaatgcg

SEQ ID NO: 395249 - DNA, 364 bp, Homo sapiens
tgcctcagcctcctgagtagccgggattacaggcaggtgccaccgtgcccagctaatttttgtatttttagtagcgatgaggtttcaccatgttggccaggctggtcttgaactgctgacctcaggtgatccacccatctcggcctcccaaagtgctaggattacaggtgtaagccaccatgcctggcctgttttaatttttttagtacacctctgctgaaaggaagcatccttatttgtaacacaccactcattaggctgtgttacaacttattttgtgttatgattagttctatgctgttactagattttgagttacacaaggtcagggactttgtcttattcatgtttgtatcatcagtgc

SEQ ID NO: 395250 - DNA, 178 bp, Homo sapiens
cataaatccagattgctgcagtttcacactggagcatgtgccagaagatacacgcaggctcttggtgtcttgtgctatcacacattagcaccttgtccatctcccctcacaacgcatttcaaggacaagttcccttctctgctatggccggagcagtcgtgaattgtttgggtcagaa

SEQ ID NO: 395251 - DNA, 189 bp, Homo sapiens
taccaaattttatccattcattagttgatggacatttgggttgttcccactttttggctattgtgaatatcaagatatagtgcacttctgccttcaaatcttgagaatgcctggtactgtcaagctgccaatttatagcatgtgaaataactatatcattgtggttttaatttgcactttttttttttt

SEQ ID NO: 395252 - DNA, 492 bp, Homo sapiens
  misc_feature (335)..(335): n is a, c, g, or t
tacgccatggctgactctagaggatacacttcctctcctcccactctctctttcggaccttctctagtcaggctttttccgccttcaacttcatgcagccaaaactactctcgatgaggtccccccaggacagtagtcaatcttcaggccacatcctgattgactgccagttatgtctgacacagccctgtccctcccttctccatgagacactcttcccaatttccaagaccccacattctcccggttctcctccagccatgcgtccccatcagcccacacgctaaacactggagtgcccagggctcagcctgccctcctctcctccccacctnggcctcccagagcactgggattacagacatgagccaccgcacccggtcaggtaaaattcttaagaggaaaagtaggagaagattggcgtgtttccatcagaaagcctgggtgagtgcccaggaatgggtgaaggtggggaggagaggagtgcagtgc

SEQ ID NO: 395253 - DNA, 540 bp, Homo sapiens
catggtggcatgcgcctgtggtcccagctactctggaggccgaggtaggaggatcacctgagcctgggaggtcaaggctgcagtgagctgtgtttgcaccaccatactccagcttgggtaataaagcaagaccctgtcaacaaaaaaaagttagattttttgtttgtttgtttgaaaagtgttaacctaggcacaatctacaaactggccaatttttgacttttgtaactgttgtatatacatctataaatatattctaagtagttttcttatacagaacagcatagaaaaaacacattaaaagtcctcagaattatgagtaatttgtataaaaatttgtaatgacatttcaaggtaattgtttctattggaattgtaataacatctgattgcagcttccttgaagattactaaatatatgcagtgctatgatcctttgctgggtaagcattgcagtttcgttgctgcttagctagtatgaaatgttggattgtaaaatgtcaatcgtgtaatatatttgcttataaatagttacactct

SEQ ID NO: 395254 - DNA, 168 bp, Homo sapiens
cacaaattcagtttgcgcttaatcattcaggcaggtatgtattctgtggctcaccagaatggaactaaaatgtgagtatgatagtcacatacatgcttttgtcttggggtagatggaaggtgctcaaatagtttcgactgttctctgtcattctgggtatacggagag

SEQ ID NO: 395255 - DNA, 407 bp, Homo sapiens
aagaaaagcatagtccttctgaaagctccaacatccctcttggacctcagtgggggcctgtgtgctgaggatgggggagcaagaagtcagaaggagcctgggtccctgacacatgaaccgtcattccagccctgggctccacaccaacagacttctttacaggaggaagaaattaactttgatctggggatgtttgtttcatgcatctgaatcatatccctccagctctaggcacttctccaggtttctaccccctccatttcatctgagagcagtttgccttagcttttcatttagtaaaggtgaaagatcattgtgattttgatggttgtctcaatgactggtattggacatggcagaaaacccaggtggctaatacgctgagagctgctcacacccactgggaa

SEQ ID NO: 395256 - DNA, 484 bp, Homo sapiens
caagcagttaatacagactcagcaggacaaatttctctaggtttcagggcctgagaataatcctctgtggcttgatcctctgccctctgggcccatggaggctctgtctgcagctggtgtgggcctgtttctcccctacccccaacccccactatgctgctcgccttcagtcatttttacttttccctgaagggttgcacatgtttgtagttgagtaactgtattagcccatttcttgcctataaaatcccagaagtaagacactttaaaaaattttgtcccatctctgttcctttcagtacaggctgacagcatttttgttggtatgatattctttaaaaccttgtcagtctccttacatatcaagggggtccatatcattagacgagaggattcttcacagttccttactgataaccccatctccattcctcgtttctgttgagatgattgatgggatccatgagtctgtattaactgctag

SEQ ID NO: 395257 - DNA, 382 bp, Homo sapiens
cccaacccagtcccacagatctatgggactatctctctttttctctttccttgctcctcttcccctttcttcttaggattgatggactgacagcagtttggcaaggcttccctaagcctgtaatagggagctgtggacccagccctgacttctcaagtagggggaaacagctctattcccgggcccttgagattgagtctcaagttgacaggagttgagaaagaaatgcatgaaggatggctgggcttacgcaggacaaaaacctctactggggaggggccagttttgtgccttgtgcctactgctgagagggaatttagaaacaaaggaagataagaagaaggcctagggaaacagcataaaggactggaaaaattcagaa

SEQ ID NO: 395258 - DNA, 443 bp, Homo sapiens
acttttgttatcaaataaaaacaaacacatttttaggtaaagagagactttattcacaaggatcattgcaacaagaggaaggagagtattgcaatagagaaaaccatccaaccacaagagctacaagcatctcaaagaccagagagaaaaagatttccttttatggtgaaggatcaacaaagctagaaagatatcagtatggggacaggaagatcaccatgaaatgttttacccaaggtcagctgattcttaggagggttgtatgctgggtcagaagaaggatagatcaaaactcacgagcatggaagaggaagagaaatttaactgatattcggtcaagttaataatcactttgtttctactgtccagtgaggataaacagttcagctaatcttttatgaagctgagaatgagaatttaaagagtctgtgtctggcctatca

SEQ ID NO: 395259 - DNA, 399 bp, Homo sapiens
ctattcgtacactccctcaccttttgaaaatcactaataaaaacttgttggttttgcggcttggggggcatcacggaacctgccgacgtgtgatgtctcccctggacatccagctttaaaatttctctcttttgtactctttccctttatttctcagactggctgacactcagggaaaatagaaaagaacctacatgaaatatcaggggtgaatttcccccgatatcacactggctcttctctcacctgtctacctgcttaacttaataggagaggcaatgcatggtgctcatgaacaaggcaagcattaaagtcagaccagactaacatttgactcagtcctaatattcaggtgagcttgggcaaatcgctcattaaccccaagtcttcatcattttg

SEQ ID NO: 395260 - DNA, 370 bp, Homo sapiens
attatagtgtaggtttacgtcctttataaggtcccacaatcagctgataaacatctgaatcaaatttactacgaggtggtttctgactgccctatttctagctagtttattttttacccagtcaacagttttcaagctcatataatgtgccaggaattggggaattgaggccagagatggaagataaagtcactctcctgacagagctctggttggggaaacaatcaggggaatgccaacatgatggaacaggtgctgtgacagaggcaagggcaggacacggacagcctggccaggaaaggctgccgcagacagcatgggaggtctccagagtcctcatttccaaaggagacagaagatcaagggtctg

SEQ ID NO: 395261 - DNA, 466 bp, Homo sapiens
cagcggaacaagcaaggcatccatcctttattgtattaaaactgctcactcaattccttgttcattagttccacaacagccacccatataacagacatggagcagtttccaccggatgaacttagacaagtcatcagctgctaacgaggcaccagggaagtcccagtcatatctacatttgccttcagataacctttacgggtttggaaattgccatgatgaaaatagcagagtcgtactgaggttgggagtttgacctgtctattcaggtgaaaaccacaatgtcaagaaggaaatgttggcagctatgtgaaagcaccaaaaaccaatgagttgcgcgtcttcaatggatgaagtatacagtatgtcaattttatctctataaagctgctaccaaaaaaagaaggaagtgtttttaaggcaaagatctggtgacacagaggctatgcagtagctaagagacttt

SEQ ID NO: 395262 - DNA, 581 bp, Homo sapiens
  misc_feature (581)..(581): n is a, c, g, or t
cttggttacctatgtacctgttaccactttcaaaaatctacagacagtcagtgtggatgagaactaatcgctgatcgtcaaatacatcaaataaagttacaaaattgcaaaaaaaaaaaaaaaaacaaaaaaaaaaacacgtgtgtgggcgccgcgcccgcgggccccgcacgaaaaagttttaaaaaacattcgcgttgggggccgcccgggcccccacgagggggaacagggaaccaggggctcccacagcggtctctccacggggagaaaaccggggccctccgcaacaggggtggttgcggacaatctcccaccacaaccaaaaaaagagcgcccggggggaaaacgggagattcgttcggaaacacaactctcagagagggacagcttccgaggcggaccacctaggcggcatccatgcaacgaggggaagtctcaccagggagtccgtgcataaacaaaaattaatcgcccccacggggaagacacacaaccgacacagcaccatgatcacacaaagtagcacatcacagagagcgacagagtgaaaatagatgcacgcgagcggaacagcaaan

SEQ ID NO: 395263 - DNA, 183 bp, Homo sapiens
cacaccacctgagtctatctttgaactagccaagttcaaagttaaaagtagggcaacttgggttctggagaaatgaggtcaatggatgaggcaggttataggaaaaatttgggagctcctgagagaatggattcagggagcaaggcaggttacaggggtggtttaaggggttctggggaaatg

SEQ ID NO: 395264 - DNA, 204 bp, Homo sapiens
gggagtggacacgtgcccaggctggttcagtgagccccttccctgggcgggggactgggaagcggagagagctagaccagtgtggaactatggtagcacgatgtgtacttgggggctggtctgcagagaaaatgggagacagcctccgtggaaatgaggcagaaataggctgcagagggtgccagccagggacgggggaaggcg

SEQ ID NO: 395265 - DNA, 819 bp, Homo sapiens
caacaccacgcctggctaatttttgtatttttagtagagaggggtttcatcatgttgggcaggctggtctcgaactcctgacctcaggagatccacccacctcacctcccaaagtgctgggattagaggtgtgagccactgcgccatgtgacttggtatttttttctgaaaggactcatttttctggtgcatgaccatgacacttcacctctctctgggggttgccactcatgttgttttctacatgaatggggcctcctggcatcgtgccatgaggcagtctaacatctaggttgtgtagtttgaaagagacacaccagatcttgcccccaggctacatcttaatattagaaatagttttagatttttaactaactgactttgactccgcctgccttctcgtttttctaaatgtgtttgtatactttctggcaccccctccttatctgcctcgtgtgggcagaggtaagagaggcttagtgtggggatattcgttatgatattgtatccagtgcctctccggcccagggaatacaaggatctggaatgcatgggccttgccttgatggtcccgagcctggtcgaagagtcaggagatagatatggaagggtgaatcactcccttggaaggcagagcaggccaggtgcccaaagggaggcaggcagacagcgtctgagttcagggaggaagcggatgggaaatctctggtgggaggtagaatctgatccatcctccaaaggatgggcaggatttaagtcaatacaggcaacggggaggagaatattccctgtgacctaaggtaagggtagaacaaggca

SEQ ID NO: 395266 - DNA, 516 bp, Homo sapiens
ccttagaggatctccgaatcatcatctgctaatcatcatcctgctgcgcgtattcatcatcctgcttcctccctgactttgactccgcctgccttctcgtttttctaaatgtgtttgtatactttctggcaccccctccttatctgcctcgtgtgggcagaggtaagagaggcttagtgtggggatattcgttatgatattgtatccagtgcctctccggcccagggaatacaaggatctggaatgcatgggccttgccttgatggtcccgagcctggtcgaagagtcaggagatagatatggaagggtgaatcactcccttggaaggcagagcaggccaggtgcccaaagggaggcaggcagacagcgtctgagttcagggaggaagcggatgggaaatctctggtgggaggtagaatctgatccatcctccaaaggatgggcaggatttaagtcaatacaggcaacggggaggagaatattccctgtgacctaaggtaagggtagaacaaggca

SEQ ID NO: 395267 - DNA, 256 bp, Homo sapiens
ttacttatctttccagacttttttgtgcttgtacaaatagttttcttattcttttaaacaaaagcagtatcgtattttacaggttacagaattctcttcgttttactgtgtcttgcggatgtgtcccttggacctgtctatatacataagtcgtgctttccttcaagttctcctcttcgttagcttaggagagccaagaaataaagactttcttacaaatgactgtttgagtttggctgatgtgtcctacagaaac

SEQ ID NO: 395268 - DNA, 4715 bp, Homo sapiens
  misc_feature (2972)..(2972): n is a, c, g, or t
tggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagccnccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggagcctcctccacaccagcgctgatgcccaataaagatgcccactgaggaatgatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcaaa

SEQ ID NO: 395269 - DNA, 4221 bp, Homo sapiens
  misc_feature (2972)..(2972): n is a, c, g, or t
tggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagccnccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggagcctcctccacaccagcgctgatgcccaataaagatgcccactgaggaatgatg

SEQ ID NO: 395270 - DNA, 4737 bp, Homo sapiens
  misc_feature (492)..(492): n is a, c, g, or t
  misc_feature (497)..(497): n is a, c, g, or t
  misc_feature (586)..(586): n is a, c, g, or t
  misc_feature (610)..(610): n is a, c, g, or t
  misc_feature (637)..(637): n is a, c, g, or t
  misc_feature (2994)..(2994): n is a, c, g, or t
gcagacagcgatggagcagttcaccacgggggccttccgaagctcagccagaaagtcggagtgagagggcaagcgctccttggtgtggcacgtactcgagaggttctcggagaaggtgacctgggggcggtcccatatgacagtctggttcagccggacgggcaccaagaacaccaggctgatggggaggctcctctgccccaggttgctgacctgatattgatgctgcatgacccgactggtattctctgaggccgtgaagttgagatatttagtggagaccccatggctggtgaccaccatgtagacagcatatttcaccggcagctccagttggaattcggttttgttggttctgggcatgttgttctcactggtcacattggccttgaggagcagtttgtttccaagggaagccttagagtctacatcaaacgtgatattaaaggtgacctctgagttttccgggaagatggggtggtttatgctgcngctgntgctcttcaaggccccagacacttcggtggaggaggcagactcacaggccaggcgccaggatcgctgtgagcgctggttctggagtgtngacaccttccggtaggacaggtcnagcgggaagaagaaggtgacctgtgtnctgtaggagtcctcaccatcatttctcacagtcactgtcacgttgaactcccggggcccacccaccacgaggcagtccaggctcatgaaactgaaggtgatgctgaggtcatcctggcagatgttgtcattgccacaattcttctcaaagggaaacaaggctgtgaagagtctctgagcatcctccgccagcactggccggaggttcccgaaagcagacaatggcgttcccaccagagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagccnccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggagcctcctccacaccagcgctgatgcccaataaagatgcccactgaggaatgatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcaaa

SEQ ID NO: 395271 - DNA, 2059 bp, Homo sapiens
  misc_feature (492)..(492): n is a, c, g, or t
  misc_feature (497)..(497): n is a, c, g, or t
  misc_feature (586)..(586): n is a, c, g, or t
  misc_feature (610)..(610): n is a, c, g, or t
  misc_feature (637)..(637): n is a, c, g, or t
gcagacagcgatggagcagttcaccacgggggccttccgaagctcagccagaaagtcggagtgagagggcaagcgctccttggtgtggcacgtactcgagaggttctcggagaaggtgacctgggggcggtcccatatgacagtctggttcagccggacgggcaccaagaacaccaggctgatggggaggctcctctgccccaggttgctgacctgatattgatgctgcatgacccgactggtattctctgaggccgtgaagttgagatatttagtggagaccccatggctggtgaccaccatgtagacagcatatttcaccggcagctccagttggaattcggttttgttggttctgggcatgttgttctcactggtcacattggccttgaggagcagtttgtttccaagggaagccttagagtctacatcaaacgtgatattaaaggtgacctctgagttttccgggaagatggggtggtttatgctgcngctgntgctcttcaaggccccagacacttcggtggaggaggcagactcacaggccaggcgccaggatcgctgtgagcgctggttctggagtgtngacaccttccggtaggacaggtcnagcgggaagaagaaggtgacctgtgtnctgtaggagtcctcaccatcatttctcacagtcactgtcacgttgaactcccggggcccacccaccacgaggcagtccaggctcatgaaactgaaggtgatgctgaggtcatcctggcagatgttgtcattgccacaattcttctcaaagggaaacaaggctgtgaagagtctctgagcatcctccgccagcactggccggaggttcccgaaagcagacaatggcgttcccaccagagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccaggtgagacctggtcactgtccttgtcatgacagtagcctctttgttgatctttctcctaattcagtgtgcccacagctgccagctcccggactcaagtgatccacctgccttggcctcccaaagtgctgggattacaggtgtgagccaccgcaccctgccagtttggctattttagataactcatataagtgaaaccacgccgtattcatcctttggtgactggcttatttcacttagaataacgtcctccag

SEQ ID NO: 395272 - DNA, 470 bp, Homo sapiens
gtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttc

SEQ ID NO: 395273 - DNA, 498 bp, Homo sapiens
tccttgtgagccctctctacaccaaggagcgcttgccctctcactcgactttctggctgagcttcggaaggcccccgtggctggaggaatttaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgct

SEQ ID NO: 395274 - DNA, 4483 bp, Homo sapiens
  misc_feature (2740)..(2740): n is a, c, g, or t
tagatcgagctcggtaccgattacgctcctgacggcagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagccnccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggagcctcctccacaccagcgctgatgcccaataaagatgcccactgaggaatgatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcaaa

SEQ ID NO: 395275 - DNA, 898 bp, Homo sapiens
tagatcgagctcggtaccgattacgctcctgacggcagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaaaagtaacagctctccacaggccgcacacaaa

SEQ ID NO: 395276 - DNA, 360 bp, Homo sapiens
agttcgaaaccagcctggccaacatggcgaaaccccatctctactaaaaatagaaaaattagccaggtgtggtggtgtgtgcctgtaatctcagctacttgggaagctgaggcaggagaatcgcttgaacttgagaggcagaggttgcaatgagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatcacttaagctcag

SEQ ID NO: 395277 - DNA, 236 bp, Homo sapiens
cagctgtcttgtagttgcattttgcagatggagataaagtgtcatcctgcacaagccttgaatatggtgcccagtggaggccatgttgtatctggaatgaaggaagaacatttgccagcaggagatgggaaggctggagggaatctttttgagaatattttcagatatgtatagtttgtacaattatatctactttgtaatattgaccagggctaaactacttggctaaaatatct

SEQ ID NO: 395278 - DNA, 405 bp, Homo sapiens
ggcataccctccaatccaaaatccctagcagggcctagccccacctgtacctcctctctgaagcttctgtgtccacccaggccctttgctgaactcagaaagcacctacctgtgcctgaccctctcccccaaccccatgctaaattctctaatcctcatcacagctgattaggatggtattatttactctattttgctcaaaaggagaacaaggaaaactcactcagcctagagagctccagctgtgattcaaaccctggtttgcctatttccaaagtccaaattctgtcccgtgaaatctcctctcaggcgggtgctagggctgacaggagaccaccagccccttggggacaggagccatgtcatgacgaagggggatgacacaagatcctctagagcactcca

SEQ ID NO: 395279 - DNA, 350 bp, Homo sapiens
ggcataccctccaatccaaaatccctagcagggcctagccccacctgtacctcctctctgaagcttctgtgtccacccaggccctttgctgaactcagaaagcacctacctgtgcctgaccctctcccccaaccccatgctaaattctctaatcctcatcacagctgattaggatggtattatttactctattttgctcaaaaggagaacaaggaaaactcactcagcctagagagctccagctgtgattcaaaccctggtttgcctatttccaaagtccaaattctgtcccgtgaaatctcctctcagccctagcacccgcctgagaggagatttagggggacagggat

SEQ ID NO: 395280 - DNA, 827 bp, Homo sapiens
gcttacacccgtaatcctagcactttgggaggccgaggcgggcagatcacgaggtcaggagttcaagaccagcccgggcaacacagtgaaaactggtccctagtaaaatacaaaaaattaggcaagcatggcagcatgcgcctatagtcccagctacttgggaggctgaggcaagagtgaggcaagagaattgcttgaacccaggaggcggaggttgcagtgagccgagattgtgccactgcactccagcctggtcgacagagtgagactccgtctccaaaaaaaaaaaacaagattgcataagatgtgaatactcagtcattttaatcagtgggaataattataattattataattgttttttgatctttacgaatcttgtcaaaatgttaaaaaaaaggctcttctttctgtcagttattaatgtttagagaaatgaaaaaatagtaaaaatatttagtatactataatttaaaacttacgaaatattgagaattattttcttttttaaaaacttagcaagaatagtttaaactgtgcttgccaccttcctctcatataatttataactaagtgagcatcttttctgtaccttgacagattgtcatgtttctaaatttggatccgctttacatttgtatattcattacattcttattgagcatccaccatagctgttccagtactgtgctaagaaaagatcatttcaatggatttgcagctaactttatggcttcaactcgagtcttgccttgaaatgtcacctttaaacatgcctagtcagattcaagggcttgcgtggatttcttagatataaggcattcaca

SEQ ID NO: 395281 - DNA, 361 bp, Homo sapiens
tctccaaagcagcctgtgcaaaatatctcttccgtattataccactaacaactaaaatgttgtcattactagaggctcatccagcactggtctttctcaaaaggcacacaggcctgggagggcagtgtggttttgaaacatgccagccagctgaatgcaagttgataagcaaagataatagtgcggtgagccaacatgggggaaatgcctggaggcagtatcacagggaggttctgacaagcacaagtgaagagaaagactggagcccagaaaggaagaggaaggagagaaggaggcactcaaagagaagcagagtatgaaacaacttcacaggtttgcctggggctggcagcaatccagt

SEQ ID NO: 395282 - DNA, 1050 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395283 - DNA, 603 bp, Homo sapiens
  misc_feature (25)..(25): n is a, c, g, or t
ttctttcccccccaccaacaccacnccacaccttcttaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395284 - DNA, 681 bp, Homo sapiens
  misc_feature (47)..(47): n is a, c, g, or t
  misc_feature (54)..(54): n is a, c, g, or t
aacacttaatataaatatctttcaaatctttaaagaaaaaagaaggngcttcgntgactataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395285 - DNA, 667 bp, Homo sapiens
cgagcgtaggtattgaattatgattttagatggggagtacgtcttataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395286 - DNA, 539 bp, Homo sapiens
  misc_feature (29)..(29): n is a, c, g, or t
  misc_feature (44)..(44): n is a, c, g, or t
gggagaggggcgcttaggggtgtgagttngttttggaaggcctngcgagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395287 - DNA, 535 bp, Homo sapiens
tattttttcccacttttttttctgacacggcgaagccagcttcggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395288 - DNA, 548 bp, Homo sapiens
  misc_feature (24)..(24): n is a, c, g, or t
  misc_feature (30)..(30): n is a, c, g, or t
  misc_feature (44)..(44): n is a, c, g, or t
ttgatgttgagttaagaggaaaanaagaanttttcaaaaaaaanttgacaaactgaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395289 - DNA, 545 bp, Homo sapiens
  misc_feature (35)..(35): n is a, c, g, or t
  misc_feature (38)..(38): n is a, c, g, or t
  misc_feature (40)..(40): n is a, c, g, or t
atatgaatagatgacgagaagaaggattaaaaaanacnanttttgaaaaacaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395290 - DNA, 524 bp, Homo sapiens
tcaccgcccctataaccaacaccacacacttaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395291 - DNA, 649 bp, Homo sapiens
  misc_feature (1)..(1): n is a, c, g, or t
  misc_feature (30)..(30): n is a, c, g, or t
nttccgagcagtccttcagtagtattccanaaaaggcattgttctcataggagatgacagctccatgcgtgttagtggccctgaagacctttcagtgggacaagatgtggaggtggaagacagtgatattgatgattctgatgctgtgtaggcctagggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395292 - DNA, 559 bp, Homo sapiens
  misc_feature (61)..(61): n is a, c, g, or t
ctcagcattatcccatcctacctcacctcttaaaacaaagaagttcggtgtaacgtacggnccattacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395293 - DNA, 539 bp, Homo sapiens
tcgaactggcacaaccagatggtcgcttcagggtaccgtaacggacctgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395294 - DNA, 536 bp, Homo sapiens
cctcgctaggcccgccaggtcgcggggaagcagagaggagcttgagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395295 - DNA, 555 bp, Homo sapiens
  misc_feature (55)..(55): n is a, c, g, or t
  misc_feature (60)..(61): n is a, c, g, or t
acacgtcactttcactagatttattccttaacacacaagtactcccttttggcgntaacnnaacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395296 - DNA, 916 bp, Homo sapiens
  misc_feature (47)..(47): n is a, c, g, or t
  misc_feature (54)..(54): n is a, c, g, or t
aacacttaatataaatatctttcaaatctttaaagaaaaaagaaggngcttcgntgactataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactaaaaaaaaaaaaatggcctcgttggcctcaaggggaaccttgcgccgtttccttaaggaggttaattatatcccccttactgctcctgccttgtcttcggctgcgaaagcgtctacctacttaaggcggatacggtatcccacatcgggttccccggaagatctgtgccatcgcccccaaggccgaaccgaaaggccgggtgtgggtttcaaagcccaccccctataacaaaaaat

SEQ ID NO: 395297 - DNA, 424 bp, Homo sapiens
  misc_feature (25)..(25): n is a, c, g, or t
ttctttcccccccaccaacaccacnccacaccttcttaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtg

SEQ ID NO: 395298 - DNA, 770 bp, Homo sapiens
tattttttcccacttttttttctgacacggcgaagccagcttcggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactaaaaaaaaaaaaatggcctcgttggcctcaaggggaaccttgcgccgtttccttaaggaggttaattatatcccccttactgctcctgccttgtcttcggctgcgaaagcgtctacctacttaaggcggatacggtatcccacatcgggttccccggaagatctgtgccatcgcccccaaggccgaaccgaaaggccgggtgtgggtttcaaagcccaccccctataacaaaaaat

SEQ ID NO: 395299 - DNA, 577 bp, Homo sapiens
  misc_feature (35)..(35): n is a, c, g, or t
  misc_feature (38)..(38): n is a, c, g, or t
  misc_feature (40)..(40): n is a, c, g, or t
atatgaatagatgacgagaagaaggattaaaaaanacnanttttgaaaaacaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactaaccaaaacaaaaatggccttcctggcctcagg

SEQ ID NO: 395300 - DNA, 595 bp, Homo sapiens
atattttatcccccatgtgttgcccctctaaaaccgatatcataacttcggtgtaacagtacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactaaccaagaaaaaaacacccggccctccttgccctacccgtcga

SEQ ID NO: 395301 - DNA, 594 bp, Homo sapiens
  misc_feature (55)..(55): n is a, c, g, or t
  misc_feature (60)..(61): n is a, c, g, or t
acacgtcactttcactagatttattccttaacacacaagtactcccttttggcgntaacnnaacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactactgcgaaaaataaaaaaatggccttgttgggccttatat

SEQ ID NO: 395302 - DNA, 425 bp, Homo sapiens
  misc_feature (12)..(12): n is a, c, g, or t
  misc_feature (41)..(41): n is a, c, g, or t
ccctcggcccangctagtctcgctgtgaacgtgccccaggngtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtg

SEQ ID NO: 395303 - DNA, 605 bp, Homo sapiens
  misc_feature (59)..(59): n is a, c, g, or t
  misc_feature (67)..(67): n is a, c, g, or t
ttccctactcttcttgcattggagccgcacccgcgtgacgaataggtttggtgccacanagcatcangttgtacacacatgcctgtccgatgagtgctgactgagcaccaggaactgtgctagaagttagaagttaagtgatttgccctgagtcacacagttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaaaaagaaatatcggccttcttggcctcagccgc

SEQ ID NO: 395304 - DNA, 978 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395305 - DNA, 1155 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactacaaaaaaaaaaaatggcctcgttggcctcaaggggaaccttgcgccgtttccttaaggaggttaattatatcccccttactgctcctgccttgtcttcggctgcgaaagcgtctacctacttaaggcggatacggtatcccacatcgggttccccggaagatctgtgccatcgcccccaaggccgaaccgaaaggccgggtgtgggtttcaaagcccaccccctataacaaaaaat

SEQ ID NO: 395306 - DNA, 871 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtg

SEQ ID NO: 395307 - DNA, 1050 bp, Homo sapiens
gctcagttccagggatctgggcctcagtccaggagagaagggaagggaattctcaggacagcagtgaagggagttccagtgtgaagacttcataggtggtcctagagaacaaacagttgggaacagagcaaagtgacagagaactccagaagacatggtgccaagaaagtaacaggaatgataaataacgcgaagagtctgacgaaactgagaagaccagaagaactttcaaactagacggggtctcactgtctgcccaggctggggtgcagtggtgcaatcatagctcactgcatctttgaattcctgggctcaagcagtcctgcctcagcctcccaagtaactggaactacagtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395308 - DNA, 759 bp, Homo sapiens
agcccgtctctaatatgatccacgttgttacctcccattaccgtcagacgcggcacggagtctgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395309 - DNA, 1087 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtcagttgatttggattccatctgtttccttctagtattataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395310 - DNA, 795 bp, Homo sapiens
  misc_feature (25)..(25): n is a, c, g, or t
  misc_feature (53)..(53): n is a, c, g, or t
  misc_feature (64)..(65): n is a, c, g, or t
tgtattaggtttgaatggagggttnggagcacgacagccaagaatcgtgtgcnttgcaacgcgnnggggaaaggttgtctaacctcatggtgcataaatttataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395311 - DNA, 754 bp, Homo sapiens
cccaagttagcaacgagggattgcaaagcgtaaaggggagtggggggggcctgaggtgctataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395312 - DNA, 1133 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtccacagagcagtcagagaagagcacacatgcctgtccgatgagtgctgactgagcaccaggaactgtgctagaagttagaagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395313 - DNA, 618 bp, Homo sapiens
gtgatagttaggaaagtatttaatattatagaggaaaaacaaccggggctcttcggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395314 - DNA, 609 bp, Homo sapiens
  misc_feature (38)..(38): n is a, c, g, or t
cgccaccccaccctccggccctacgccacccgcccganaagtttgagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395315 - DNA, 648 bp, Homo sapiens
  misc_feature (67)..(67): n is a, c, g, or t
tttctttgttcagttcattccacagaacagaaacgaaagagtttagttgagtcggtaacttaacgtnaccttttactgcgtacacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395316 - DNA, 607 bp, Homo sapiens
tattttttcccacttttttttctgacacggcgaagccagcttcggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395317 - DNA, 622 bp, Homo sapiens
  misc_feature (57)..(57): n is a, c, g, or t
gtatcacagatgtacctctccgacaacaccacgactcaagctgcaacttggttctgngagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395318 - DNA, 620 bp, Homo sapiens
  misc_feature (24)..(24): n is a, c, g, or t
  misc_feature (30)..(30): n is a, c, g, or t
  misc_feature (44)..(44): n is a, c, g, or t
ttgatgttgagttaagaggaaaanaagaanttttcaaaaaaaanttgacaaactgaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395319 - DNA, 609 bp, Homo sapiens
gcactcggccttccccccccgcccccgccgaatgtacgtagctcgagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395320 - DNA, 614 bp, Homo sapiens
tccccgccccacacaaacccccccccttaggggtactgtacggcccgtcacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395321 - DNA, 604 bp, Homo sapiens
tttctccatccccctcctccccacaaaacgtaaccacgctagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395322 - DNA, 617 bp, Homo sapiens
  misc_feature (35)..(35): n is a, c, g, or t
  misc_feature (38)..(38): n is a, c, g, or t
  misc_feature (40)..(40): n is a, c, g, or t
atatgaatagatgacgagaagaaggattaaaaaanacnanttttgaaaaacaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395323 - DNA, 596 bp, Homo sapiens
tcaccgcccctataaccaacaccacacacttaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395324 - DNA, 1092 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtccacagagcagtcagagaagagcacacatgcctgtccgatgagtgctgactgagcaccaggaactgtgctagaagttagaagttaagtgatttgccctgagtcacacagttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395325 - DNA, 536 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgagacggggtctcactgtctgcccaggctggggtgcagtggtgcaatcatagctcactgcatctttgaattcctgggctcaagcagtcctgcctcagcctcccaagtaactggaactacagacttttcagtcgtgtggcattcactaaataataaaggtattgtatgtttcagtgtgtggta

SEQ ID NO: 395326 - DNA, 920 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactac

SEQ ID NO: 395327 - DNA, 682 bp, Homo sapiens
cccaagttagcaacgagggattgcaaagcgtaaaggggagtggggggggcctgaggtgctataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395328 - DNA, 531 bp, Homo sapiens
  misc_feature (25)..(25): n is a, c, g, or t
ttctttcccccccaccaacaccacnccacaccttcttaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395329 - DNA, 555 bp, Homo sapiens
  misc_feature (37)..(37): n is a, c, g, or t
  misc_feature (46)..(46): n is a, c, g, or t
  misc_feature (49)..(49): n is a, c, g, or t
gggcgcgccccctgggcgagggttggtttttgaaagncgctccgtntgnttagccaagttccgggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395330 - DNA, 549 bp, Homo sapiens
tttcggcgtccattatcacattcatacgcaagcgagaggagggcttattgttacgaacgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395331 - DNA, 541 bp, Homo sapiens
  misc_feature (24)..(26): n is a, c, g, or t
  misc_feature (39)..(39): n is a, c, g, or t
tggggagagagttgagtctaggannngcactgggtggtngttgccgtactgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattacta

SEQ ID NO: 395332 - DNA, 776 bp, Homo sapiens
accatccaagaattcctctgcctactcgcctaaatattaaaaatacttcggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactaaaaaaaaaaaaatggcctcgttggcctcaaggggaaccttgcgccgtttccttaaggaggttaattatatcccccttactgctcctgccttgtcttcggctgcgaaagcgtctacctacttaaggcggatacggtatcccacatcgggttccccggaagatctgtgccatcgcccccaaggccgaaccgaaaggccgggtgtgggtttcaaagcccaccccctataacaaaaaat

SEQ ID NO: 395333 - DNA, 1213 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactaaaaaaaaaaaaatggcctcgttggcctcaaggggaaccttgcgccgtttccttaaggaggttaattatatcccccttactgctcctgccttgtcttcggctgcgaaagcgtctacctacttaaggcggatacggtatcccacatcgggttccccggaagatctgtgccatcgcccccaaggccgaaccgaaaggccgggtgtgggtttcaaagcccaccccctataacaaaaaat

SEQ ID NO: 395334 - DNA, 1170 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgagacggggtctcactgtctgcccaggctggggtgcagtggtgcaatcatagctcactgcatctttgaattcctgggctcaagcagtcctgcctcagcctcccaagtaactggaactacagtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395335 - DNA, 753 bp, Homo sapiens
  misc_feature (47)..(47): n is a, c, g, or t
  misc_feature (54)..(54): n is a, c, g, or t
aacacttaatataaatatctttcaaatctttaaagaaaaaagaaggngcttcgntgactataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395336 - DNA, 1164 bp, Homo sapiens
gactagtctagtgcgaggctggtgtcaatcggccgagggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtccacagagcagtcagagaagagcacacatgcctgtccgatgagtgctgactgagcaccaggaactgtgctagaagttagaagttaagtgatttgccctgagtcacacagttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395337 - DNA, 617 bp, Homo sapiens
tacccaaccccgggggaagagaaacctcctgatgggtacccgtaacggactattgtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395338 - DNA, 636 bp, Homo sapiens
tgggtgtgcgcctgatttcgtacaccgaggcacgggccagacgagcctgaggggttacagtaacggacccttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395339 - DNA, 607 bp, Homo sapiens
gttttcttccttcatccattcatctctatccgttgttatgcctagtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattag

SEQ ID NO: 395340 - DNA, 690 bp, Homo sapiens
ggagccttagggagggggcaagaagcaggtcatcaagagcagagaagaccaatgacagaggtggccggggctggaagaagcagaatgcatcgcggatggacagaagatgacttttaagtttcttgtgaaattgacatttctgcaggatggacagcgaacaacactttcatccatattatttttctttgatctctcaagcagctctgggaagcaggcactaccatctttgttttatagatggggaatctgagtcatcatgagcaaatatgctttcctgaggacacacagtcactaactagatcaatctccaactttggattccaaattgcatggtcttcccctgtgtctttcactgtcttgcagctcctctctgccccagttttaagctaattacatgaatgacagagtaactaatttcttctttcattccaacgtttaggtgctgtttatatataaaaatctctgtatcgtgggaattactacatcagtaaaactttcatacttcttcttaaaatacagatacaatacaggacaggcatcctctgaggacttgtccactctgatcgtctctgcatgatttttattgttcttattacctctgttttttaagttctccccaactgtgaaggaaatgcgatgcccggggaacacagattactcgggcaaaacccgattccggctggcatactg

SEQ ID NO: 395341 - DNA, 519 bp, Homo sapiens
ctggccgcctctagaggttcccctctccctacaatatctattctcttctgtatcttcagcaacctccggcccagcccacacataaacccactcagcctaagctctcagtcgattccctgggaagccatcctcagctacccagactaagtgaggttgtgggtcgcatccatccagggtgctgcacttctcccctagtaactcattgctccatgtctatctgccagcactggatgctccttgagggcaggacggtgcctgtcttccagacctctgtgtcctgtccctagcacagtgattggcccagagtaatcccaagttcatgttgctgaatggctcagatgtgtaaatgaatgagattcagaagcaacccacacagagtgggctccagggctaaaggtgagatcacgccactgaactccagcctgggcaatggagtgagactccgtctcaaaaacaaaacagaaaccactagtagaatatgtaccatgcttgtaggatacagtagggagagggtaccga

SEQ ID NO: 395342 - DNA, 438 bp, Homo sapiens
ctggccgcctctagaggttcccctctccctacaatatctattctcttctgtatcttcagcaacctccggcccagcccacacataaacccactcagcctaagctctcagtcgattccctgggaagccatcctcagctacccagactaagtgaggttgtgggtcgcatccatccagggtgctgcacttctcccctagtaactcattgctccatgtctatctgccagcactggatgctccttgagggcaggacggtgcctgtcttccagacctctgtgtcctgtccctagcacagtgattggcccagagtaatcccaagttcatgttgctgaatggctcagatgtgtaaatgaatgagattcagaagcaacccacacagagtgggctccagggctaaaggtgagatcacccagtgtgccttctatgacaggttgagagccg

SEQ ID NO: 395343 - DNA, 365 bp, Homo sapiens
aagtgaagggaacacctcccaattcattgcatagggccagcataaccctgatactcaactcttgcaaaggaaaactgtagacccatattcatcatgaatatacatttcaaaaaatcccatcataataattaacaaactgaatcagcagtatataaaaaacttaattgggtttatcctgagaacataaggcttatttaactttttaaaatcaatcaatgtaattagctatagtaacagactaaagaaaagccatatgattaatatactggagaaaaaaaacatttaactggatttaacattgattcccaataaaaactcacagcagactatccacagaaagaacttcctcattctaataacggtac

SEQ ID NO: 395344 - DNA, 401 bp, Homo sapiens
caacatggcgaaaccccgtctctgaaaaaaataaaaaattagccaggtgtggtggcatgggcctgtagtcccagctacttgggaagctgaggcaggaggatcccttgagctcaggaggtagaggctacagtgagccatgatcacgccattatactccagccagggcgacagagtgagaccctatctcaacaacaacaacaacaaaacaacagtatttacatattatttagtaggcacgcagccaactcccacggcctggccagttttaaaggaatggatcccatttttgaaagcagcaagatcaccaagcagatgtttgccatgggttgaagagggcatcaaagcaagcagctctgaaccatttctcaaaaagctatctaagcagctgtaagactcccgtg

SEQ ID NO: 395345 - DNA, 231 bp, Homo sapiens
gcatgatccaatgtagagttatatctgtgttttcctctaagagttttatagtttaaacccttacatttaggtctttgattctaagtgtatggtttgaggtaggggtccagttttattcttttgcatgtggctatccattttccccagcaccatttaatgaaaagactatttttccatgtcagactgtcttggcaccttgtcagaaatcaattaaccttaactgtgaatgtc

SEQ ID NO: 395346 - DNA, 469 bp, Homo sapiens
agtgctacctccacaaacagtaacaacaaattccgcgacaaccagatcagtacggccaagtacagcgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcagcagtgtgttatgttgaaacagctaatctgtttgtggagtaaactgtacc

SEQ ID NO: 395347 - DNA, 423 bp, Homo sapiens
cacacacacacacccgacaaccatggcttcagtacttctttcagggaactatagaaatgtccagatctttaacaattaatgaccaaattggaggcaagagtgtaactgggtagtcgtaatctattttaactgaaatgtaataaaattggtctcctgatacattctcaccctcctgaaatcatctagacctgaacgtccagagtcagctggacttacgacattatgcctaattgaaatatggtgttcctgaaataggtctaatgacaaattccagcgttcgattagtaaaaaataccaatggttcatctttaccaaagaccacacgtactgaccagggtacagcagccatctctgcattgtctcccctggaggcagcagaggagcctcgactgtagtctgtctgcacacattcttcttctgcct

SEQ ID NO: 395348 - DNA, 175 bp, Homo sapiens
ttgtatcagaggacatcataaaaagaataaaaatatgatggctcttattttcaaatttgactagtcttaactggacagacaggatatatgtatgaaataacaaggagacagctatgcaattgttcattagaaacttcttgttggatccatcaacgctaatatgcctgaagcctgt

SEQ ID NO: 395349 - DNA, 362 bp, Homo sapiens
ttatatatatatatatttgtgtgtgtgtatatatatatatatatatacatttctttgtctatttatagaacaggttaagtgacttgtccaaagtaacacagctaaaaagtgacagcaggggttcaaacccattctctttaactccacaaatgagtatggttctccaattcatgcttccttcagctaacagagtgttcaaaaatgcagattgtaaaggccaagtgaggtggcttatgcctgtaatttcagcactttggggagccagagtgtgaagatggctggtcttgaactcctggcctcaagcgatcctcccaacttggcctcgcaaagtgctgggactacaggtgtgagccactgtgcgc

SEQ ID NO: 395350 - DNA, 988 bp, Homo sapiens
actaaggggtgcccaggaagtgccaggaatgtgaacatcagctccaaatcagcaagagcctccaacccctcggccctgcccacagagagacagggcttaggagagacagggcctgcccagtctcagccggtcagtagcagagtctcgctgagaacccgggtggagctttggctgcccggctggccagccacgggccccaggccaggcctcttgggggccttccaaaaagtttgacactcaggaaaacactgtctccagaatacgaaaagaagacggcacaatcaaaatgcatggagatgtaattaaatgtttatataaccaaacataatgtcagcgttatttttaaatttaaaatcagataattctatttgtgaacaattggtggggtagattttttttctcactttaaaaggttttcccagcatgcagaagacccccagacaactcagacaactataagttaaatgaatttcctatggcccaaaatgtccaaaagcaaaagaggaaattttcctttcaaacacttttacaagagaaaaacaagtttatgaaagaggccgtggctgcagattcaaggcacttgctgtggtgtctgggggtggcctttaaaattcggagggccaggacctctgaagctggacaggccctgcctggccctgctgctgttccgggaccccctttcttccctgaggcctggggtagaagagcaggtcctcctctcgtgaatggtaggggtgctgctatctgggaaggcttcctggaggaggtgggtctatggggcctgggagcacctccaggactctggggcatgggggtagtgtgggcgggcactttgaggcctgcctgcctcccctgagctcccactgcagagtccagagggtgggaagagcagtggctgggtgctggtggagggaggcatcagtgcacagatgccataaagctgcctccccagggttctgccagctccccgcctagccctggtggtaca

SEQ ID NO: 395351 - DNA, 220 bp, Homo sapiens
gcacgcagtttgatgtgttttgacaaacgtacaggcccctgtaaccatgaccacaatcaggatacagaacgtttccaccacccccaaaagttcccgggccctttgcattcaatctccccatcccaccctcactggccccaggcaaccacagatctgctttctgtcactgtagattaggtttgcctgttgtaggattttatttaagtggtgtcatacatca

SEQ ID NO: 395352 - DNA, 298 bp, Homo sapiens
gggggtgtttattcaaattgggtttttaatacagcatttatgcttacagagatataaaaaatacagacattaagactctcaagtagcactgaccaatagttttatattgcttgccagataggtacttttacattttctggtattaaagaagtaaaaagaaatagatgaaattaattttaatgtacatttgcttaagccagtataaccaaatattaccatttcaataggtgatcaataccaaaaaaagtattaatgagatactttacattcttttttatcttcagtattctaaatcttg

SEQ ID NO: 395353 - DNA, 518 bp, Homo sapiens
gttgttgttgttgtttgtttgttttgagatggagtctcactctgttgaccaggctggagtgcagtggcacgattatggctcactgcaacctctgcctcctgcgttcaagcaattctcctgtctcagcctccagagtagctgggattacaggcatgcaccaccatacctgactaatttttgtatttttagtacagacagggtttcaccatgttggccaggctggtgttgaactcctgacctcaagtgatccaactgccttggcctcccaaagtgctgacattacaggtgtaagccactgcgcccagcccctcagcttctgtttctaaccaccaccaacgcctctctgctctaccattaaagtacattgcaaacccagccacttctttccaaggccaccatcctaagtcaggttcccatcattttctacaaaaataattatagctgattatagtgggttgcatggcgttctccaaaaagatatgtctatgtcctaatccccagaacttgtggtgacctta

SEQ ID NO: 395354 - DNA, 772 bp, Homo sapiens
aggatcccccttgggttggaactgaatgggaactataaatgtattgcgagggcacaacgaccaggtccaagaagaaaagcagcgagaaacaaatttctgggacagaggtgaaggtggaggggtgggagcagctttaccaataggtgggactaagtcaggttgaagagggaactgaactaagagctaggaagtcaaaggtcaggccaggagagaaaccatcaagcccccttgactcttccattccactcacttttttcttttaaccttaaactaaagttttatttgggaattttaacttcatttcttttccttcaacttttattttaggttcggggatacatgcacatatttgttacacaggtaaacccatttcacaggggtttattttacagatcatttcattacccaggtactatgcctagtacctaatagccagtagttacttttcctgcccctctccctcctctcaccctccacactccataggccccagggtgtgttgttcacctctgtgtgttcacgtgttctcatcattcagctctcacttacaagtgaaaacatgcggtatttggttttctgtttctgcattagtttgctatttgattccctttacctctaatattggtctaagtttaatctaaaatgagggtggtgtttaattctctaggtgtaaaaaataagtaaatgcttgttacttaaacgtttctttatgtaaatttgtgtttatctttatttgattatatcattaaagtttgtgggactaccgtacttc

SEQ ID NO: 395355 - DNA, 201 bp, Homo sapiens
ctcacaggcatttaccctaataaattctcttccatgtctaatccactattggctgcatctgaatgggttaaaaactaacattccaggcttgattctttgcacttagttttttctctctctcccacatgtagtcagtaacagtgtcctagtattttctgtgttacctctttttccatatttccatatgtgtgtgtgtgttgg

SEQ ID NO: 395356 - DNA, 553 bp, Homo sapiens
tcttaattccaagagcaatgggaaggcactgaagtagttcagactcaaggctgagctgatcaaatctaaatttcataaagatctaacggctcacagctaacagattgcataggaataatagaccaatgcaataaattagagaatctataacgacatatatgtaaaaatgtaatacagaacaaaataggtacaagggtcttaaaatcaaagttcattatcagacacagaagttgccagggaagcaaaagtattcttaacacaaaaatatccgctaatgaactaaacatttataatatcagtccccattaaacatccctcccaaagcagcattagcctctatgtcaggccatttcacctttgccctgtcagtctctcaatgattgacaggttatttcaattacaaagcaacacaatgcatatcatctacaaagtgaaagtgcaaacattccaaaagatgtaggcctttatgaagtcactgaaaatgatgaaaactctttacaaagcaactgaaaaaaatgagtatttggaaagatactgactgggaaggggcatg

SEQ ID NO: 395357 - DNA, 145 bp, Homo sapiens
gaaaaattttctgctgcatggactttttttctttttaacataaatgagagtcagtcaaggagcacttatggaacagctactaccaggggttgtgctaagtaacgtgtagcctaaggcaaagacaacacaagacttgctggtgtgg

SEQ ID NO: 395358 - DNA, 422 bp, Homo sapiens
cactatccaagtcctgggtattgtttgttggggaagccgtatctcactatcagagtcctggcagagtgtggttattgtttgttggggaagtcgtatctcactatgaggatcctgtgtattgtttgttggggaagctgtatctcactatcagagtcctgggtattgtttgttggagaagctgtatctcactatcagaatcctggcagagtgtggttattgtttgttgggaagccgtatctcactatccgagtcctgggtattgtttgttggggaagccatatctcactatccgagtcctgggtattgtttgttgggaagccatatctcactatccgagtcctgggtattatttgttgggaagccgtatctcactatcagagtcctggcagagtgtggttattgtttgttgggaagccatatct

SEQ ID NO: 395359 - DNA, 614 bp, Homo sapiens
aatttccactgggttgcaacaaaatagggtgaaagcaaagcaggatccagggacctctacaaagccggcccgattccatctacaatactgtcttttattgtgagaccgcgtccttccaaaatccggggcattaaaatgtcccctacctctgtgaagtggtgacgatatgagatggtggttgaatgggtgtctgttttttattttaatatcctcatcgggcaaatgaggatattttaagttggcaaagctccgtgaatagctggggatgaagtaaaggcatgtgatcagaagccagcctcaatttccttgatttcctctgctcaagctcaaaaactcagaggcagctgagggcgtcaggagtttttaaaagtgaatgggagcttgaggcttcatcctgtgtgcctcccggactcaccacacaaaaggatcatgcccccaccccacctgccccacagcattgtctaaagctacagcaaagagttggagtggcctccgtggtgtccagaaccaaggaaccgaaaagcctgaaatgcaacaagatgtcaaccacagagaccctgatggaaagttccaaccaaacaggactgggcgactccacccaacccccacctgca

SEQ ID NO: 395360 - DNA, 459 bp, Homo sapiens
cattgcgaccattcaactgtgggtcacgacccatttgtgagccataaatcaattcagtggattatgaccagcaatttttttttgaaagacaggatctcactctgtcatccaggctagagtacagtggtgcgatctcagctcacttcaacctccgtctcccgggttcagacaattctcacacctaagcctcccgagtagctgggattacaggcatgtaccaccaccccagctaatttttgtaattttagtaaagatggggtttttcctggccacaggctggtcttgaactcttggtctcaagtgatccagcccacctcagcctcccaaggtgctgggattacaggtgtgagccaccatgcccgaccttatttctctttaaaggaaacattctacataggactttagtctgaagtctttcagctggttaacaattgaaatgtcgccatccggtcactggta

SEQ ID NO: 395361 - DNA, 158 bp, Homo sapiens
atttgaattcctgtttctctacttatttgctttgcaatgtaggtagtttttaaatctctaagcctgagattccccatttacaaaatagggatgatatgctggaattattaatatgttgattaaattagacaatacatgtaatgattttagcacacaac

SEQ ID NO: 395362 - DNA, 276 bp, Homo sapiens
gtggtgatctagaggatcccaaccgtcaccaccttggagaagtccatgtggtaaggaactgaggcctccagccaacagccacatgagtgatctgggaaacagttcctctacctcagtcaagccttcagatgactgcagtcccaataacatttttactgcaacttcatgaccctgagctgcagattagccactcccagatctctgatcctcaggactctgtgagataataaacacttgttgttttaaaacaaaaaaaaaaaggggtaccggagctcg

SEQ ID NO: 395363 - DNA, 418 bp, Homo sapiens
cgctccccaagagggggtgacgacttggggcagggacggggaccctggcggcgagcttccgtcctccgctcgcacgccgcaccttccggccccaggccctcccctggctcctggagggttggctcctggctcaggaagcccacgcctgccttggaatgtcctggatcctgcccaccgccttccaggttccgcctaaatcgcgcctcctaatttgacttattcctactagtaacaatagttactgttattattgggaaatattgttattagatgttgccagcacccggtggatgccgagcagttttgcatacacgctctccaatccttgaagcaacctgttaggcagtttctctaaggagagatcccagaccacttgaccaaaaaaaagtctctggaaggcttactatgtttctactta

SEQ ID NO: 395364 - DNA, 190 bp, Homo sapiens
gggaataaccccatgccaccaaaagccctgtcttggaactggggaagatcttcagcatgaacaccttttccaggaacaaaaactgccacacatctgcgggacttcctgggcgcaattcggggtccaaaatgaagcgtggtaataaagtgacaagatcggctgtctcatgtgggccaaagagggcgcctac

SEQ ID NO: 395365 - DNA, 217 bp, Homo sapiens
tgacaggtagttctttgaaaaagtaggatgtggtgacagcctaggtatgacatatgccttcccattggttgccagtattgattgggctagtctcgctagtcataagggtttttctctccttattttttgctccatatgcattcttcatctcatgaagtcttcccagtgaagctgtgctttctgttgctgatgagagaaaaatcaggtatttctaggg

SEQ ID NO: 395366 - DNA, 705 bp, Homo sapiens
tatttaattttaattgtgggaagaaaggcagatacaagcccactgctctgaggttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggtcattttaatagatttactttgaatgctggtggccaccaaactttgtaaccttctcagaattggttattttactattttctgctttttgaaaaaattatatagaagtaatatacatatataaaatatcagtggattccacctaacttctttttaatggctgtggagttcacagtgttgatattccagagtttgcttaatcttattgttggtcttttgaaatgtttcctgtttttcactgttattaccgttaggccatatacctattttataagtttctttaattttccttctgaatcctc

SEQ ID NO: 395367 - DNA, 793 bp, Homo sapiens
tagaggatcccgtatgcatttagaccaggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggtcattttaatagatttactttgaatgctggtggccaccaaactttgtaaccttctcagaattggttattttactattttctgctttttgaaaaaattatatagaagtaatatacatatataaaatatcagtggattccacctaacttctttttaatggctgtggagttcacagtgttgatattccagagtttgcttaatcttattgttggtcttttgaaatgtttcctgtttttcactgttattaccgttaggccatatacctattttataagtttctttaattttccttctgaatcctc

SEQ ID NO: 395368 - DNA, 684 bp, Homo sapiens
  misc_feature (128)..(128): n is a, c, g, or t
  misc_feature (185)..(185): n is a, c, g, or t
ctccgacgcccgcagcccggctgctactgccgcaccgcggcggccgtgaacctcctgctgggcgtcttccaggtcctgctgccctgctgtcgcccgggaggggctcagggacaagcgattgagccgtngcgaacgtggtggagctgtggcaggcagaagaaggggaactcctgctgcccactcanggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgc

SEQ ID NO: 395369 - DNA, 524 bp, Homo sapiens
aatattattattaaacccgttttacagttcaaaaaaactaaggctgagaaaggaaagaaactggtccaaagtcatactgcaagtaaatgatggagcagggatttcatgccacaactcagtaattaatcactgtgttgcaattctttctccttttcattaggctctgtaacttgtctggggacaaattaaggttgtaaagttcagtttactttccgtcagtcatatggcatcaccaagccacctctggtggagtgagaaaagcatggtacttcaacatcggaacccctgatactggtccctggctggatcttcacttcttgagttcctgtttccttatctgaaaaatgttattaatattcctacctcatagcaatgttgggaaaattccacgtggacgtgtagccaaccccaagtcatatgtagagtctgaaataccacataaatgtaaagtaacatctgttcatgtattggattttcttcatttatctttccccagatgctgtattgcatcccagttcgcaaaa

SEQ ID NO: 395370 - DNA, 1785 bp, Homo sapiens
  misc_feature (1729)..(1729): n is a, c, g, or t
gccaactgttagcattttacagtaggatcagagagtcaagtacattagttggctaaagtcacgaagctaatgtgtcctaaagatgagaattgaaggctccagagtccaaatatttacccacagccttactcactgcgtgtggattgggtgcaaatctcactttggcacccgatacctgtgtgacattggacaaactacttagcctgtctaatcttcagttttctcatctgtaaaataaggcagggaaccctcccttccagaatagctgcaggaatacagggaggtgtgatgtaagaaagtagttcatctaggactgacgtgtggtgagccctcagtgtgcgttgctactgtgttacccttcctgataacttcttagtacacatacagcatacagactgccgcaagtgttcatgacctttactgggacagtcagaataggggaggatcccagtgtggattctgtctcccagcctttatcagctgtacaacattgtataagttacttgaccttaagtcttagtttctccctttgaagtaaaagtgatacctgctcttttgtatcccatgggagtgaaatctcaagctcactaaaaatagtgcttttatttattttttcttagccagtttgcacagactacagataaaaagtgctttttttgagacagggtctcactcttcccaggctggagtgtagtgatgcaatcttggctcactgcaaccacaacctcttgggctcaggtgatcttcccacctcaggctcctgggtagctgggactacaggtacactccagtacatccggctaattcttgtgtttttaatacagacaagatttcaccatgttacccatgctgatcttgaactcctgggcttaagcgatcctcccgcctcagcctcccaaagtgctggggttataggcgtgagccactgcacccagacaaatagtacccttttaatgggaagattattgctctcaaggttgctttcctgtgtttaaaagttgtggtcgtgctgctttagggaggtagtgagtttccagccctctagaggtctagagaggctgaacaacttacttggtgggcattttgttgagaaggccttttttgtccagtgcttcagggaacactggtcaaggtctgggccacattgtctatcacaccccttcttggagggtttacaaccacctctggaaagttccatgagaataaatatacctaactttgttttattaaccatctcaaaaacttgcttgatcatgaaactcgtttttttaacctgttgacatcttacagaactatcagcgttactattggttcaggtcttttatatctactgtactttgtgtttttgtctttgaataattgtgtattgaagtctcccattgtgtggactctggtgtgtgatgtgcactgcacatgtgtgttacacaaaggctcctgtctgagggagcaaatggggcctaaaattaaacttaagacatcaaggctgggcacggtggcttacgcctgtaatcccagcactttgggaggccgaggcgggcagatcacgaagtcaggagatcgagaccatcctggctaacacagtgaaacccagtctctactaaaaatacaaaaaattagccagacatggtggcaggcgcctgtagtcccagctactcggaaagctgaggcaggagaatcgcttgaactgggaggcagaggttgcagtgagccgagatcgtgccactgtgcnaagcataatttaaagtggcgtggggcgaatccagagtccagatcatctgtctcaga

SEQ ID NO: 395371 - DNA, 574 bp, Homo sapiens
aagcatcaggagcctgtcagaggggacctggtggcgggcacctggatggcagagggaggcggacaacagttccgggacagcgcgctcccatctcctgctgttttgagagcctcttcccctgcttcctgccccagaaagccccatgccttcctcgggaaggtcactcacgggtaagctcagcatggctgtgacgggtctgggtccggtgatgctcagcttgggagactccagagaacccgcacgtggggcctagtgcccgcagacacccgtggggtcgggggtactgtttgctctccaagccaccagccaggttgtgcacaacgccaggacaactcttcagggctgagacacgtggcttccctgggcccagcacctgggcagcacgttccgtgtgtatgccctgaaatcacaccaacgcatgcagccaaccccgagactcaaccccaaggccaggacacggggccagtcctggagcagcacaacggggtgcccagctgtgaccctgcctacccggaaccctgagtctggtggcactggaggctcagcatcacaatgatcctttcttgtgttacca

SEQ ID NO: 395372 - DNA, 347 bp, Homo sapiens
agaccctcttccgaggcaaggagccacattcctgccgtcgggaccaccaaagcggatttctacaaactaaagtcgagaacttttcggcggcgaggcggcgcaccccgcgcgggagagggggcgcaggcgtcaccccgtcctcactcagcaacacccggcgccgcgccgggcgaaggctggcaaacttctcgcggccggcaggtgggctccgcgggccccatgggcgcaggcacaggtgtgcggggccacagccgggccttttgcagccggcgaccgcccccccttccccgcgggcttttgcacacgacgcgccgacggcagcttcacacgggttggcgagggccgga

SEQ ID NO: 395373 - DNA, 403 bp, Homo sapiens
gctgtttaactagtgttatacacatttcaaggtctttctagtatagtggcttctagacttttaaaaaagcagcagaagcgttttaaaggaatgcaaaatatgaaaacgagattaaaactattgtttccggttgaagccaatcacaatgttgctcaaaaggggtcctaggaaacaaatcacaattttagaatatcattcttttttttttgagactgagtttcgctcttgttgcccaggctagagtgcaagagtgcagtggcacgatctcggctcactgcaacctctgcctcccgggttcaagcaattctcctgcctcagcctcccaaatagttgggattacaggcatgcgtcaccacgcctggctaattttgtatttttagtagagatggggtttctccatgtt

SEQ ID NO: 395374 - DNA, 326 bp, Homo sapiens
gcagacacacacgtgcacacacacacacacaccacccaatcctagcacccactgggtacaggccctgagctagataatactccagtgggactcactgtgaaatggacttttacgttgcagtgcatcacgttctaattctttggaggagtgggaagcagcaaagctcttagagccaggctattcacacccacaccctctatcttcatgacacccagcagctctgttgaaggctgctctcttggggtgaaactcccagcagggctggtaggaaattactctcggcagagctcagggagcactggctgctctcacttcgctgtggtcat

SEQ ID NO: 395375 - DNA, 532 bp, Homo sapiens
cgtccccctgtggctgcacatttaggtcaactccagtgttctgcttctctgaataagaactttggtatctagatgtagcaacttttccctgaatcgagggtatgttctctgggctgcttctcgcactgggactgctaaaccaagtgggataaacatccttaagttcatgccagtttgtcaaactgctttcccccatggctatcaactgctcccagctcaactgcttccagctgtctatgaggtcagcccctgtgcaccatccctgcagcctcattcatcccacagacaccaagtggatgctatgggatgtgccaggaactgaggactcactgacagcaagatctttcccttccaccagggcgccaacccaaggtctccgcaaatatgatgggcaaaatatggagtcttgtttcactttgcatttgcttaactgctagtgagatgcagaatagcgagacacagcatatgtttgtagtcctttctgaattatgtttccccctacttccctaccggtatcatagagcacatataa

SEQ ID NO: 395376 - DNA, 236 bp, Homo sapiens
cggccaagggtgtgctttagagtaacttgaactttttctgaatgcaaatgtctgtaccccagccctagacatttttgttcaatatttctagaatggagcctgggggtttgtatttttgtttgtttgcttgcttgctggagtgcagtggcaccattgtaccttgctgcaggcctgaactcctgggctaaagtgattctctagcttcaacctcactagtagctggagcttcgtacagg

SEQ ID NO: 395377 - DNA, 257 bp, Homo sapiens
aggaatacacattgttaaaagaaaagatttcccagggccaccggacaccagcgcgtgagaatccggaggcagggaggcgacccggttcccgaaacctacgcggctgcgggaggcccaggagccccacgcgaacctgtccgcacagcccagcggctaggttcacagaacgcagacgctggagcctgtcgcccaagcaacggccccgccccgcccacgggaggcgccggtgattggccgcagcctcagtggccccgccc

SEQ ID NO: 395378 - DNA, 628 bp, Homo sapiens
ccacaaaaaagtctttgcctagggtctgcatatgtgactggaagctaaattattggaatgagcttgtttgtttaaggttattaaagttctgggttctttgacttctaaagtcactctgatatgtatttggaagagtaaatgtctagcaaattggctttatatttcctttagagatctagcaaagaccaaacctgctttggacctcatctgtgccacagtgcccttgggggatgggccacctgtagcagaggaataggagctgaggcatgagctgataagtggcatcactttagggccctctccaatctcacctggaatgtcactaatagtgacctatttctttgggttcaagcttttcattttctgggcctcctttatattgcagattcttttattttatagataggtctcactatgttgcccaggctggagtgtgggggctattcacagacataatcatagtacactactgcctcaaacttctgggctcaagcaagcctcctgcctcagccttcaggatagctgggattacagatgtgcaccactgtgctcggctgcagattccttttaggaggtgaatacataatcagtaatttgctaatgccttagtaaaaacttagtgatgtgc

SEQ ID NO: 395379 - DNA, 778 bp, Homo sapiens
cacaagccctcagtggcatagacagtgagtacacaatgctcctatgtctgggtggtcagggggccactctaatctggactgagcctgctcaatacctgtgggtcatctggctacctgctggggtgactggggccaccaggctctgctctgtgtgtctctcctccttcattacgctagcacaggcttgttttcatggtgatcctgaggtgcaagagaggacaagcttaattgcacaagcgctttttcaagcctctgcttgttccatgggtgctagcatctcattggccaaagcaagtcatgtggccacgtccaggtgtgaagaactgggggccttttgcaatgctcctggtagacacaggcacctgatgatctcagatctttaacagcacaatcatttcagtgctgatcactgtcatttacggagctggcactgtgcctggttagtttactttaactcaatggctcccagtggggggtgattttgtcccccaggagacatctggagatatttttggttatcacaactgaatggggaagatgcttctggcatagggtgggtagaggccacggttgctgctaaacactcttcagtacagaggacggccctcacagcaaagacttacctggccccaagtgtcagtattgccaaggctagccgagtacagtggcttatgcctgtggtcctagtattttgggaggccgagataggagggtcatggagccaaggagtacgagactagcctacacaacagaacgagacctcatctctacaaaaaaa

SEQ ID NO: 395380 - DNA, 1032 bp, Homo sapiens
agcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagaggg

SEQ ID NO: 395381 - DNA, 935 bp, Homo sapiens
gcggctcggtgtgcagagcacacaatgccccgctggaaaacagaaacccacatgtgcacgtattagtctcggtaattatttattgcgtagcgctataaacaatgtatgcaattaagggtaattaaacctcaactaccgcctgcaaaaatagcaaactttccctgcaaaggcaggagctgagctcctgggaacggctctatccctcctgcagcgtcccgggacaggccctcggattttgggggacccttccctggctttcagagtttcttgaacgttctctccctggtgctgcctccgccacccttcggtagccactcgctctcggctgttcgcactaaaggcggcccctcgtattaacaacgggccctacttctgctgtccctccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagaggg

SEQ ID NO: 395382 - DNA, 766 bp, Homo sapiens
caggctggtactggcctgggggttctggatgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagaggg

SEQ ID NO: 395383 - DNA, 288 bp, Homo sapiens
tcttctcgaaaggcaacatgaactacatagttgaggaaaaccatgaactacatagttgaggaagacgggttttgtctgaaaggatttagagaccagccagggagacagccaagaaaatcaacaaccatcatgcagttatggtagaaatagaagctggatgctagctactgcagcatcccagcagactgaggaaggtttgttggaggagaagatgcctgcactgaatatagaaagactgaaggatgcaggaatgttgcctttcggagaagagaaagctacatcagacaa

SEQ ID NO: 395384 - DNA, 541 bp, Homo sapiens
tcaagggcctgacacatggaagctattatgattcagtgccttctttatgtgtaagtagatggtgtctatgtggtttgagttccccagtggctggaactgttgaagtgtgatcccagggagggatacctgggttggattcccactgctataacctcctagttttgcctcccagagttgttgtgagggtcaataatataaaacttataactcttgttgggggaagtatttatttcacatttatgtatccacatggagtgacttctggatgtgttccctatctcccacacaggggtgagaacaaacttatttgcctggtgaatttgggagaaggatctgagctcagccccttccttttccttttctggaaccaacctgctctcatgttacaaggtacgagggcctgcagtgtccagctataccatggactgagtgggcaagtctgtttaatttacaggcaaagaatacatcagcaagccccttggctgcttaatctcaaatcacaatctctgatcaacttttccggtaacaaaggaggtgatat

SEQ ID NO: 395385 - DNA, 256 bp, Homo sapiens
cttactgcagtgctggcctctgagtatgaagaaggactcctgattcatttagaaagtgaactgcgtgaggaagctcattttcatctaactgcagctgattttctctcactagttgtaataatcgtttccggtcaattacgggaaattcaattggcacatttttacgctccgataaaatgattttttcaagttctacatagcagtctggaatcagctgtccaacaacaagctgatctcggatctatgaaattacaaa

SEQ ID NO: 395386 - DNA, 547 bp, Homo sapiens
atcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgctta

SEQ ID NO: 395387 - DNA, 170 bp, Homo sapiens
tatttgaagggtagatttttttaaacgtagtttcaaagtagctaataaagagattgaacatttatcagaattataaaacttacttagagatgctattctgatattgaggataatatacaaattatttcagcacctccttcccccaacaaaatacttgatttactttagat

SEQ ID NO: 395388 - DNA, 356 bp, Homo sapiens
tcatggatattttattctatgggtccaacactattattatttattttgttactcaaattgtttcagccttagcaatcagaagtgccttcaggttggctcttacattcctttgaaaaacccttcctccccaccatcattttctttttaaaagtatttccttactttctggttccataagatgttccaggttcatcttgtattttcatttccccagccctggaatcagccacttctaacgagccctagttttttttctttttctttcttttttcttttttcaattggagaacagtgtttagaagccaagatctggatgctaggtgtgttcattaatactagggtgttggtatttctaa

SEQ ID NO: 395389 - DNA, 399 bp, Homo sapiens
ctagcttcttgaggttgctgtgtcctccgcatccctcgggaaatggagtcacagccactcctgagtatttgaagctctgtttggccagcttataacctttacaataaaaaacaaaatgcaggccgggcacggtggctcacgcctgtaatcccagcactttgggaggccaaggtgggcggatcacgaggtcaagagttcaagaccagcctgaccaacatggtgaaaccccatctctactaaaaaaaaaaaaaaaaaaaaatacaaaaattagccaggcatggtggtgcatgcctgtaatcccagctactcaggaggctgaggcctgggaagtggaggatgcagtgagccaagatcgcaccactgcactccagcctgggcgacagaacaagactctgtctc

SEQ ID NO: 395390 - DNA, 404 bp, Homo sapiens
tctgatgcctgcaacagtctgaactcatacacctatcatcgcgagtcagttcagaaccagctaaagaacactgggtttgcctcctcctgtacgtgggatgagtaagtcccatctgaaaatgcttcccaggagaagaccttcagcactaagactctgcaacagccccaaacctgtcccagctggtcccagaaccaaatatctcaccaagtgattccaggactggaaatattttgtgggttagcagattggaaaaaataataataaactacttgtagaatcatacttaatagtgtgaatgctcaaaactagattttagtaaaaaaaaaataagctacttgtggaatgaaaatgctcaaaactagatttgagtttctcaagtgaatccagccactgtcctctgcaaa

SEQ ID NO: 395391 - DNA, 323 bp, Homo sapiens
tgctaacctacttacattctgccaagacaaactacaactgaagtagtattcatttctataccaattaaagcattcaccttaaaaataacagaatatacactaataccaattctcccaatgacctaaccaattctgctgaaaattagttcttagaggtcctagtgaaccacatacggtaactatatgacagtctggtagcttgtataagctatttttctgtaggaagtgaaaagatctaggttgtaataaaacatatacctcagttcagtaacccagtgtcaacatcttataaagattcccagggttaaattattttatatggc

SEQ ID NO: 395392 - DNA, 412 bp, Homo sapiens
agctaggattacaggcatgtgccaccacgcctggctaattttgtatttttttttttagtagagacggggtttctccatgttggtcaggctggtgttgaaatcccaacctcaggtgatccgcctgcctcggcctcccaggtcactgcgattacaggcgtgagccaccccacccggcctcattcacagttttcagttgaaacataattatgtttttgccatgctaatgatggttaatactctggaggtggtgggtatgtgtcaatcactcagacaatttacctgtgtttactcactgaatcctcaagaaagagaggtgggaaatacatcacatctgtcttacaaaggaggaacttagggctcagaggttttggatttcaatacactgttgctgcaggagtgggaatttgaataa

SEQ ID NO: 395393 - DNA, 325 bp, Homo sapiens
caaagtttgggtctagtgaggaatggatttgtcaacttttaatagagtatgtcaataacaaaagtcctatctccctggaggaaatagactatgccctgtgttggtggcagaggcctgtcatcctctagtccataaaactacaggacacaagccagaaactacttcctctcaagaaattaatatccctcaccccaaaagtgtaacacgtgggctgccttagaccaacttcccccaccaaacttccttccccctcctacagaccaacttcctcctccaaacattactaacttccctccccctccagcagttgcaactgcctcaaact

SEQ ID NO: 395394 - DNA, 236 bp, Homo sapiens
agtgaaattgctcagagtctgagagacagaagcaaaatcaggacaaaaacttcaatttcctaatgctcagggctggctggtagtgctcactaaacccactaaacctgggttttaaaaacttgcctgattgtgagtacatctgagccagggtgtgggaatctatatattttgcaattgtccaggtaattcttaggatcaaagaagttttggacatacttgtcagtggtatggctcca

SEQ ID NO: 395395 - DNA, 563 bp, Homo sapiens
  misc_feature (31)..(31): n is a, c, g, or t
  misc_feature (74)..(74): n is a, c, g, or t
ggccagctccagttacaacagctcagggcangcttctaggcacatagaagcttgattttcaaagaagaataagngttatccagacaaagatgggaaggaagtattccaagctaaggaaacataggtaaaaaaagaccagagttgaacaacagctgcaaaacgaaaacaaataaacaaacaaaaaagcactcaggaatatacttaaccaaggaggcaaaatatctctataaggaaaactacgaaacactgctgaaagaaatcacagatgacacaaacacatggaaccacatcccatgctcatggaagggtagaaccaatattgtgaaaatgaccatgctgccaaacaggctggttcaatatacgcaagtcaataaatgtaatcgagcatataaacagaaccaaagacaaaaaccacatgattatctcaatagatgcagaaaaggcctttgacaaaattcaacaacacttcatgctaaaaactctcaataaattaggtactgatgggacttatctcaaaacaataagagctatctatgacaaacccacagccaatatcatactga

SEQ ID NO: 395396 - DNA, 1348 bp, Homo sapiens
gagatcatgcatctccattacagtattatgaaagaagtacttagtgtactgaggatcgtatcatttcccttacagaataaatgcactaataggcaaaaaccaatgtggactcaattttaagttaagtaattcagaaaaactattccattggtctctatgtaaacaaaactgggaactgtgagtatataggtaaagctcgtgctatgttatcagaggttatctttcccagtccctcactcagtcagcaaatatttgttttagaccacctagtacagtcgtctctcagtctatgcagggattggttccaggacccctgtttataccaaaatccacgcataatcaaggcctacattagtcctgtggaactctcatatgtgaaaagtcaatcttccgtatacagggcttcatatccctagaatagtgtattttcgatccatatttggttgaaaaaaatccacctaaaagtgtggacctgcacagctgaaacctgtgttgttcaagggtcagctgtatgttgaagaatatggctagagctagtttctgtgatagaacatatggagataactatggaaaacagtcttcagatagccttaacttttttcctgatatagaagtggggcctcttcaagaatgtatttactatcacgagggattcatatagcatttggactcttagcagatgtgggtttctttatctttctaatagcagctgccagtgactcatccagctgctaagaataagcagctccaaattcccccagtttctccttgtgccataaacaagacctagattttatgctggctgtttattgttatccttcttaatcagacagcctcagatttcttagactaaatgcaacatctgtgtctaggtgttcctaaaataattggttaagtagctttaatgtattctcagctttttctaggaaactccagaacatctttctaaaccagaatgtgtcaatctccaattttaatccggaattagtgaaaactcttggcggcaaggttctaaaggaaaggatttattaagccccattttatcaattataatgccaggtacctacctactcagtggaactcctactgcattattcttctgcagataacttccttagaatgtcatgtgcatactttagcattatcaagtggaaagtaactcttctgggaggtagcaaaacaagagcataacatatctaaaaatgaagccacctgtagaactctaaggacctggtcccttttgacaaaaaatattttattccagtttttagcaagtacaggatatgatatcttttctgcatgactgagtactgatgctaattatcttgtccaaattttagataatctc

SEQ ID NO: 395397 - DNA, 327 bp, Homo sapiens
agcacgagggagttcgagctttgccctaaggcttgggaagcctttggaggatttgaaggctggaagtaacaccatcagatgtgggttttgaaaagctccctctggctgccagggagaatggggtgggcacgggtttgagagcagggagcccaaggaccaagctttgctgttgtttaggagatgagatgacagtggctctgtccagagtagtgactgtggggatggatccaaagggtggatttgagtttagggggaattgacaggtcatggtggctcgatgtatgagagaagtgtcagggcaattttgtggcctgggcacctggctgg

SEQ ID NO: 395398 - DNA, 417 bp, Homo sapiens
tcttttaattccatatttataaacccatatcttattaactgtgacatgttttcagttttcacataagaatatacatcctcgaactagaactcaaatatgtactacttattttcacttgagtggaaactgacatcaagtcactaaatataataggagggtttaaatatggatttatttttcttgtgactgacttcacatttcttgaagcagtgaattcaatgtcaattcgcactttgagctatttttaatttgggggtcagaaaattgttttttattatcttagatcttattctcttgtacttctctggtaagtgaaaattggaaggacattttgaaagtctgcatggattataaaatcttgttgtagcgaagtctgattcttctttccattataaagtactatactactgatcagtt

SEQ ID NO: 395399 - DNA, 379 bp, Homo sapiens
gggtcaaaggcaggagagaaggaagggacagaggaattaggagatttgattggtatgaagattcaaatcatttttgggggtgagttaagtagacacctgaagcgggatgaccataaccaggtgggtctgtggaggttaggggtgagcgggcaggatgaactggaagagtcagcaggcactgaatgagggtcatggatattagctgacaggttgggcattctgctgagtgctgtggtttcagatgacaggtggagactctaatattatttggttttggaggagcaacaccttgagttctacagagaatgggtgactaataccagccaagaagcatgacctcattcatcccttttccctctggaagggcgtctatggtagg

SEQ ID NO: 395400 - DNA, 542 bp, Homo sapiens
aataagaagaaagaaaataagtttgtgttactcatttatttcaagggcatgatgtaaaactggcacacatcacttctactgctattctactgccaggaacttagtcataagggcacagctactgcaagtgaatgtgggaaatatagactccagctggaaagcagcatgcccagctatgactcaggagttttgatgctaaagaaaaaaggacagaacagatactggtagacaactcatagtctctcccacaatgaccagttctttctcatttatagccagctcttcatcatcccttccattattttcagtatattaccaagtccaagttcacaattgaaataaagtagaaaacgggaacttttgcaatccaggatcctgtctgacttgtaattaaggaactctatggctgcttctagaggcaagagtctgaagtacattccctcctcttactctagtatgttgatggcatttaccagttcctgttggtaagtgattgcacttcagggataaacaaaggaatatggataggaagatgaggaaaa

SEQ ID NO: 395401 - DNA, 123 bp, Homo sapiens
tacccagctccagctggagacagtcagtgcctgaggatttgggggaagcaggtggggaaaccttggcacagggctgacaccttcctctgtgccagagcccaggagctggggcagcgtgggtga

SEQ ID NO: 395402 - DNA, 324 bp, Homo sapiens
acctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagg

SEQ ID NO: 395403 - DNA, 386 bp, Homo sapiens
gaaagaaaaaacttgcccagtgccatgtgtatatggggtgggagtaggtgggggtggcattggagggaagggggaggcaatgctcaatttcctaacaaagaaatagaaaaaaaaatattttctaggattgaaaaagcctgtctaattaaaataacacaacaacattacttaatctgcaattcttcttgacatgccttgggaccctgccttcaattttctttcattaatataggcagggagaaatgagaggcgggaaggtgatggaggcactttacagttcctttctacctaagggtctgtcccctccagaggcaagaaacaacaaagcatgtctcagtttccaccaaattaataagcaagataggggagaaattgtctgataaatc

SEQ ID NO: 395404 - DNA, 338 bp, Homo sapiens
agagttttacagttttacagcctactattttatagtttaaatttggttacattttttgttgtttttaatataacttacatggaaatctttttaaaatgtatatgatacgtatacagtggccttccctgccatcttatgtaatttaactcctctaggcatctaagcatcatctttgtcatcataaattattttactctgctggaaaagatcattgccttcaggacccactgaaatgtaccctaaatgtatccagattatatttaaaatatatttttctgcctctctgttaggtcatgtagttaatgcctaattatagttctttttcctctccttgttta

SEQ ID NO: 395405 - DNA, 477 bp, Homo sapiens
  misc_feature (18)..(18): n is a, c, g, or t
  misc_feature (20)..(20): n is a, c, g, or t
tgaggtgatctagaggancncaggctactccacaaacagagtgctacctccacaaacagcacgacctcctgagagcagggagacacacagggtagacacatcgtctgtgctcagtgctgaaccaatctgtgtcttcctcccagtgctatctgatgggactgcctttgaactgttatttccatcttgaggtcttgacttctaggctctgatcctagaactgtggctgccaccagctacagaagtcaccccaaatgtcttccatttcttaataaagtcatctttctgggcctcaggaatctcaaatcccttctgtagagcctcccagcacagggctgctaagagttaattaatccacttgggaagccagtctgccctggcagggttcagtccatggagacgatcacatttatcgtttagttaaaggcttcatttagcccctgtttgtggaggtagcactaagctcctgtagatcgaccg

SEQ ID NO: 395406 - DNA, 324 bp, Homo sapiens
gaataatgcttgtctcatgatactttatctcatataagggaaggagaggaaatccttagttacatcatataaggtagcaaaaaataaatacaataaatgctagagacaatatttattcagaaaacatcagtgagtccagtgaaacttggagactctgaaatgctgtgccagtcattagagccaggagtgtattatgatttaatggtacctctctgctgcatctcatgagctgtcctagaaaaacattttgaagcaataaagcatccatttggctcctaagtaatgagaggcattgttctttgcattaactatttattcaggaag

SEQ ID NO: 395407 - DNA, 372 bp, Homo sapiens
caggttcaagtgattcttctgcctcagcctcctgagtagctgggactgcaggcatgtaccaccatgcccggctaattttttgtattttagtagagacggggtttcaccatgttggccaggataatctctatctcctgaccttgtgattcgcctgcctcagcctcccaaagtgctgggattacaggcgtgaaccaccgcgcctggccaaactatagtattattataggaccaccgtcacatatacagttgttgagtgaaatgccgttaagtggcacaagtctgtatttgaccgtgagtctctttttacctagtaagagtagacttctgtaagtcaaggaatatgctttattcaggtgctcaaaacttgtctat

SEQ ID NO: 395408 - DNA, 607 bp, Homo sapiens
cacactccagctgccaattaactcatgggccaccatgaaacccacagaatgcctctatgccaagaaggttctcaagtatctgctatcataatataaacctaagtgcccagtgaatactgtttttctattacaaattgatctttggatacatttccccagaaaatgttacatcatttttaccacttagtgcctacctagcacgcgagctctctgagcttcacttgctgcaacacaaaataagcacagaattaggagataactaggggaattatcatagcactgaaatctgaggtcatttcctcatttttgaatactggaaaatgaaggatatttgaaactgttcaccacaactcaggtgacacgggcactccactatagaacatctcactattgctaaaaattacatacctgtgcttaaatgtgccaatgacatatgctggttgagactgatcaaaacaagtctggaagaagtctggttagaagaacaggtttttttacatacagataacatgttagcaacttgaatattaaatttggcacatgaacttttaaaagtattaggattgggatgtgattttcttttcttttttttttttttttttgagat

SEQ ID NO: 395409 - DNA, 585 bp, Homo sapiens
aaaatatgtacatatatatatatatatgtatatatcctcaaaaacttcacagaattaccaatgaaccagaaatgctactctgaggtatacacccctaaataattgaaacaaaacaaaccactcaaacaaacacttgttcatgaatgcccatagcaacttgattcaagtagccaaaaggtggaaacaactcaaatgtccatgactatgtaaacaagctgtagtatatacagacaacggaatattactcagccataaaaaggaatggagtactgatacctgctacaacctgcatgtcccttaaagacattatgctaagtgaaaggagccagacacagaatcccgtgttttttgacttattttatataaaatattcagaataggtaaatccttagagacagagtagattaatgattgccagagaattatagtgtgtacttctggagtaacaaaaaacttgaaaatagagagtggtggtggctgcacaacattgagaatatactaaatgccactgaattgtacactctaaaattgctaattgtatgttatgtggatttcatctcaataaaagaaacatcaaaaaaacca

SEQ ID NO: 395410 - DNA, 142 bp, Homo sapiens
tcgagtgctaattattagcatcatccctctactattttttaacctaacctccaaggtcaaacaacacaagtgagtctcaaactctcaactggaatgaaggtggagggggcatagagctcacctcgggattggaggcgtattg

SEQ ID NO: 395411 - DNA, 1234 bp, Homo sapiens
ctagcaatgttgatggatgttaaaaattagtaaacaaaaatgtgatgagaaataggatatttgcagagtctcagattatctccccacaagatactttttagttacaacagggaaaaaatcataaattccaggtggagaaacctggccaagaccacattaaccaaagtcaatattaccatttgtaatatgaggtttattgacatcacacacctcctgagatatacactgagaagggcacaatattgcttctggagtcttcttgccaaaaatgggtaacctctgttgaatcacgagaaaacatcaaacaaacccaaattgaaagactcttcataatatcaaggtcatagagagtaaagataaaggaattgatccagatagaggagaattaggagacatgaaaattacacacaatgtgggatcctgaattaaattttagagcataaaaaggataattggagaaatttgattaagttccacagattaggtaatagtattgcatcaatgttatcttctaaaataacattagggctgggcacggtggctcaggcctataatcccagcactttgggagtccgaggcaggtggatcacctgaggtcaggagttcaagacaagcctggccaacatggcaaaaccctgtctctactaaaaatacaaaaaaacattagccgggtgtggtggcgcacacctatagtcccagctacttgggaggctgaggcagaagaatcgcttgaacctgggaggtggaggttgcagtaagcctagattgtgccactccactccagcctgggcaacagagtgagactccgtatcaaaaaaataaaataaaataacattaggctgacagttagtaaaagttatttagaaaacgattattacatagaatactataaggaaatgtaatgattctaggaaaaggagaaaatgcttagaatatagaaattcaggccgggcacagtggctcacgcctgtaatcccagcactttgggaggctgaggtgggcagatcacgaggtcaggagatcaagaccatcctggctaacacggtgaaaccctgtctctactgaaaatacaaaaaaattagctgggtgtggtggcgggcgcctgtagtcccagctacttgggaggctgaggcaggagaatggcatgaacccaggaggtggagcttacagtgagcagagattgcaccactgcactccaactccagcctgggtgacagagcaagactccttctca

SEQ ID NO: 395412 - DNA, 398 bp, Homo sapiens
ctgcatcagcctcctgagtacctgggattactggtgcccgccaccacacccagctaatttttgtatttttagtagagatggggtttcaccatgttggccaggctggtctcgaactcctgacctcgtgatctgcccgcctcagcctcccaaagtattgggattacaggtgtcagccactgcacccggcctattttttatttatgtaaaattgaaagaaggaatcttgtctatttcctataatccttcatgctacatgaaagctcgatgaggacagtgtgtgttgtttactgtattctcataagtaaatagatgaagcaccaagcccatagtagatgcttaataaatcctgaattttctgacttctccattgcatgaaaatatttgtgtatatttgcttt

SEQ ID NO: 395413 - DNA, 549 bp, Homo sapiens
tatcctgccttcatcccaaagaagagaagaaaaaagaacccaaaccaggtctcttgtgtcaagccatctctgaatgattcagagccttaatagggggcctagaaatagccagtaaaatggccaaaaaaccccactccacaaccacattttgaccccaagacattcaagagcttcccttatgccagacaggggagaagaaaggatgtggagatcagggcttgtcagtagctgggactgcacatccactccatgttcaagggaacctggtctgaaatagccgcagataggggaatgaagcaatgactaaaaaggagacagtttaatactagggcttaagatggcacttcaaggttagtagaaggtcatttcccatcaaaacagcagaatcaaatctcatgagtaaggagaaggctttagagaccatgtctaatccaattagccaaatccccttcatttcttttctaagacagcagctatggctgagtgagaaagggtcttgaatcagtatggcttaatgaagaggagaaagggaagaagatactaaaatca

SEQ ID NO: 395414 - DNA, 330 bp, Homo sapiens
gtactactaacagagtcagttttttccacactacttgtactgctattgtacaagtgttaaaaaggcaatcagattcaatgtcttcacaccaacacattaaggaaaatccactccctttcatcttgccatgtaatctaaggaagtaggaattggatggttttaatagaaagtggaatgcctttccagatcctacaacagaagcaaggatgttgggtcacctataatcaggaagccttcacaagaacctcactatggttttcctactccaaccttctgtgattctggccaactcattcctaatctcagcctctgtacatcgtgttctgtttg

SEQ ID NO: 395415 - DNA, 589 bp, Homo sapiens
agaatgtagaaatatgcttccttggagttttatgttccccttttttttgttaaaataatttaaaataattttgattatgtgttagaaaagcattactataaaagtataaagcccaatagaatactacgcaagtagcagtttattgaggggataggttggggatctcctttttttttttttttttttttttgagaaagttataagttaccacaagagtataagaactattttgtttttcctttagctaagatgttgcctttgtttttggtttttgttgctgctgttcttgtttaattttctagctagttacttaatcttcatgtaaagcttcacacagggtctagtatgtagaagacattcaataaatgttggcatgaatgaatgaagcaagaagccattttagcaaataaaatttttaatttgcatgttttcaaattgcttaactgaaaatttaccaaacattactgagtaactttaggtgacagtgagtgatagaagtaatcttttaatctaatattttctaaatggttctttctatttagattattaaatattttgaaaacttctttgtcattcattgatcattaag

SEQ ID NO: 395416 - DNA, 554 bp, Homo sapiens
caagaaaaatcacatgctaaaattagtagaaagaaataagtcatgaagattagagaagaaattttagaaatagaaactaaaaaaaaaattacaaaaagacaaaggaacaaagagctgggggctttttgaaaaaaaaattgacaagctataatgagactaggaaaaagagaaagaaaactgcagtaaaatcatagatgaaaaaggagacattacaattgataacacagaaacacaaaggatcgtaagagattactaaaaacacctatatacaaacaaattgaaaaatccaggagaaatgaataaatgtctggaagcatagcaatttcacaagctagaataataaaaaaacctgaacagactaataatgagtaatgcaattaaggcagtaataaaaatctcccatcaaagaaaaacagaagaattatggttttactgctgaattctaccagacatttttaaaagaggtaataccaattttattcaaaatattccccgaaaaatgaagaggaaggagtacttccaaacttgttctatgaggtcagcattaccctgct

SEQ ID NO: 395417 - DNA, 539 bp, Homo sapiens
ctttaggctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggaggtagaaatatttcttttttataaattaaaagcaaatatttaaaatatgccattgcctattctatttggttttgacaaaaccaaaaatctgccttgattaaaggaatttccacatttttcttgtatcttgtttaaattaataccatgtactaaatttattagtgataataatatatactgtttaagtttaaaatcaccctgtgacatgtgtattcagagcctgtagtatttaagcagttagtggatatcagttcaaagatgataacttagacaacaaatctacataaagtaaaccatggcctttctaaattttcaa

SEQ ID NO: 395418 - DNA, 134 bp, Homo sapiens
tgttgttgaggtttaaatttaaaatgaagaatcacaaatcaatcagtaaaggaaagatggctatgactgtttaacatgatagcatgggagctcactgccctgcacgatcaaagtttcacatagacagaggagca

SEQ ID NO: 395419 - DNA, 642 bp, Homo sapiens
gtgaccttttatagctaaatgacaggctgaatttttgaatgagattatacagcttttgaatctttaaggagcatttaatctaaatcagtccgttactaggaaaaagtatgtaatcccatagcaacaaggccctgaaagttatttacattttttgtttttctggtcaggaaaaagaaagttgtataaccagtgatcattactgatagcaaaccagaagtgaaaacaatccagttattttggtgccagcttcatgctgtgtctcagcttttctgaccagtcgggtttcctgcaggggacttgagtagtgacgcttgttgtcaggctgcccacgtagatagtattattgtgctcaggcattatggcactgaactccatggtttgcactaatatttcaaacaactgactgcctcgtctctgtttggacttggatataagcaagcatcaagagggtgatgatttgttctccaaactagcctttgcaaagaggtgctcacaattgaaattacctaaaacatttcttttaaacatcaagccaggaacatccaagttacttgttctttacaatttaaggattagatcaaatcagcgatatcttcacaaatccatccataagaactttgccaaagacttgttggcttcatg

SEQ ID NO: 395420 - DNA, 317 bp, Homo sapiens
ctagaggatcccttatgctccctcttcaagtcctttctgggtatcacacagccacatgtgcaaacatactatcacacatgtacacatgcagtcacacctttacacatgtgcacacacatgcatataacacacatgcatataacacacatgcacacatgtacacatgcagtcacacctttacacatgtgcacacacatgcatataacacgtataaacacacatgcatataacacacatgcacacagatacacatgcacatgtgcacacacacatgcatttatgcccagctggacccaggattgatgtccctgagccca

SEQ ID NO: 395421 - DNA, 505 bp, Homo sapiens
ctgaaggtcacatgcctcattgctcttggagaataggttgacttcaagttcatgttcttctcttttactgaagttgcatttattggtcttagattatctgtcaagaaggatgggaaggaaaattaaaatgcaagctccaagagggtacacgctgttttgttcatcattttccaagtgtctagcatagcttgaagcataaataggaatttaataaatgcttattgaatgaacgaagatcagtggttttcaggttcataatttcattctttatacaggagattctttatgttcataatctcattcttaattacttcactaaatcacagagattaagaataagagttttggcatcaagcaggcctggattaattgttgactttggttaagttactaaatattcctttaaacctcaatctcttcttctgaaaaggtgaaaaatggggttgtgtatgtgaagtgctccgaagtatttggcacacaataaattcatgatagatgggcttta

SEQ ID NO: 395422 - DNA, 320 bp, Homo sapiens
atatcctatgcagagttacagctcagtaaatgtaatcttccaacctcattttgatgactgcatacaatcccactgtatggtgagttacatgttggttatttaagatacttataatttgggcctgggcacagtggctcatgcctgtaattccagcacattagaaggcggaggaggaaggattgcttgagcctaggagtttgagaccagcctgggcaacatagtgagactccatctctacaaaaaagaaaaagttagctgcgcttggtggcgcatgcctgtagtcccagctactcagaaggcagaggctggaagattggttg

SEQ ID NO: 395423 - DNA, 322 bp, Homo sapiens
ccggtaaatgtagatactgtgatacatcttcactacagtgttttcatagtctctttaaaagacatccaggtaaagggagaagagggcactaattcaggcaaataaaagaacataggtaagggcccaggtaaaagaaaggcaatggcctgacagtaactcaatgtggagagtgaattcctgtaggagaaaaggaagaaatgaggctaagaggttaataggtactagttcaagattgggctcgtaagccatgctgagataaatgatcaggaaagcaggtgggtgcagattccgaacaatcagtaactgggatgtacaaatgtgt

SEQ ID NO: 395424 - DNA, 561 bp, Homo sapiens
  misc_feature (532)..(532): n is a, c, g, or t
taaagttctgttgttattttagctgaattctatcattcggaattcttgaatgctatggttctgattctagaattctcaggttctacagttttagaattccatgctaagcacgttatgaatctaggattccaaggttctaaagactgaggttcagctgggcgcggtggctcacacctgtaatcccagcactttgggaggccgaggtaggaggattgcttgagcccaggagttcaagaccagcaccatggcggtgggcaagaacaagcgccttacgaaaggcggcaaaaagggagccaagaagaaagtggtggatccattttctaagaaagatcggtatgatgtgaaagcaccggctatgttcaatataagaaatatgggaaagacgctcgtgaccaggacccaaggaaccaaaatggcatctgatggtctcaagggtcgtgtgttggaagtgagtcttgctgatttgcagaatgatgaagttgcatttagaaaattcaagctgattactgaagatgtgcagggtaaaaactgnctgactaacttccatggcatggatcttac

SEQ ID NO: 395425 - DNA, 380 bp, Homo sapiens
gatgagtcagtaaaaatttgtgaaaaaggaatgctatgtggtcagaaaatacagagtacactgaaaattgaatgttttaatttgctactgtctccagtttgtaatgtgtcttgtcattttaaaattagattatttagatcagtttttttttctttttcatagtataaatgttgggaaattctgaatcttttttattcatcttgccagctcacgtgaaataatccttgatacggtactgaatattttgtctcttaggatgaaaagagcaacatttgtgtatgtgactatttgctgattttaaaagtatgttatattatttctttttggaaaaaatagagtcagattcagaataaagcacaagtaaaaatgagtgatgcaat

SEQ ID NO: 395426 - DNA, 127 bp, Homo sapiens
ctgtaaaatgagaataaaggtaatatctgcaccacgagtttgctgtgaggataaatgcacataaaaggactgtgcctggcatagaataaacacaaatggtggtatggtggtatagcctggtggatag

SEQ ID NO: 395427 - DNA, 726 bp, Homo sapiens
caatatcatattgaatgagcaaaagctggaagcattccccttgagaactggaacagacaaggattctcattcttgccactcttattcaacatagtactggagcagtcaggcaagagaaaaaatagaaggcatccaaattggaaaagaaggagtcaaactgtctttctttgccgatgataatgattctataccgagaaaaccctaaagactctgccaaagactccaggaattgataaacgacttcaggaagtttcaggatacaaaatcaatgtacagaaatcagtagcatttctatacaccaataacgttcaagctgagagccaaattaaaatgcagtcccatttacagtagctgcacacccacaaaatacttaggaatacatcaaattactttttgtgtgtagtattagacaaccagccacattctttgagctaaaaataaaaacatgcaagatattaaaaatacaaatagggactgaatagtacagtgaagaaaattacaagtagaacataagggaatagtcaagaattgtaggaaaaaataaaaatataagtacagactagatttctcatgtttaggaaattagactttttaaataaataaaaaattgccaggcatggtggcttgcaccaataattccagccacttgggaggctgaggtgggaggatctcttgaggccaagaatttaagaccagtctgggcaacatagtgagactctgtctcca

SEQ ID NO: 395428 - DNA, 406 bp, Homo sapiens
gattccattgtccttttgtggtatctcaacacagggctgccctcttactgttctgacctcagttatccttcccacagtctttgtatctatgtgacttagtgcttgttttttgtttgtttatttgttttgttggttggttttggatttttctttttaataagcttcctttcattgggtctcagaattcagttttatagttttcacaaatttttggacacttttgttcactggaaatgtgtgatttgggactgttgtttatacttggcctttttgccttgtgctgcccaagctatttcctgagtaggttgctgcttttttctgtttttcctgatttgcttctgtgaaaccaagttgtctagatcaaatagtttttttcatcatctattgcactgatgtacacctcatt

SEQ ID NO: 395429 - DNA, 360 bp, Homo sapiens
ccctaagccccagggtaagaacagctgccttcagctcatccttccctgaagctttgcaaaaccttctggccttccaagaaggcttgcatctttccctaaaactttttcttacaacttttcccaccaccctgactgaactcctgcatatgacttctcccagctcccttgggcatgtctctagacaggtaggactgccttggactgaagtagaatggagctggaagtcaggtcacagtactgcttcaggaacttcagttgggcctaaggtttgcaggccctgttactgcaggcatgaatgggcatggcgcatccctggatttttggtgaaaggggctcttggcaggactggggaggagtggg

SEQ ID NO: 395430 - DNA, 364 bp, Homo sapiens
atctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtata

SEQ ID NO: 395431 - DNA, 716 bp, Homo sapiens
tgtgtgtgtttcctgtggttgatgctcataagcgttacctccgtggaagaggtttacctttttaggaaagagttggttttctgcttttgcaaatttgtaccaactgttgatcatctcaaggacagtggagaagggacaggcaaggagcctccctttcagtcttggcattcttcgaaaatagaaggtggcttccttaaatgatttcccgacttgactcatcaatgtaggaatgcctgtgttgacactctcttccccctctctctctccgtctctgtccccatcccttttactttttattataggacagttttcaaccattctgtggaacagttgagaggatgataaagtgaaccctgtatatattaaatcacctacattttacaattatttgctctgttgttttgtttttgtgggtatgtttgctaaattacagacaacatgatgttttaccacccaaatacttaatcatttcttttttaaaaaactgacatttttcttataaccaaattatcttaactttttaatgtcttttgaacccaaatggcagagcccttgcaattagccttgttcccgtggaaggtgtattccattgccggccaggctcatgcatccagcaggcgcctaaggggctcctccgatatccagccagctctgacaatggggccgtagcccagaacaaggcagatgggattggctcattatgtgggttggcagaa

SEQ ID NO: 395432 - DNA, 410 bp, Homo sapiens
tgtggaaagagctctgaacagggcagccacttctgagggctgacgaggcctccacacagggacgggaagggacaggaagggacgggaagctttggttacttttgtcttaaatgcacaatggcagaattcattggagcaggacggccctgtggtaccggtacatggaacaattttctctgacagtgatttgcaatctggttttctagcccacagttgctttaggaagtattttccaaaaataaatccatatatctaaatacaccaaaatgtgttattttccataattgctcaaattaatccttagctgctaactaaaaacagcagcatggaacaggtcaaggaaactattattgtggaattcacacaatggaaaaatgtttaattatttggtttgtgatttggtgttttta

SEQ ID NO: 395433 - DNA, 184 bp, Homo sapiens
tgctgggcttacaggtgtgagctactgtgcccaacccctaattttttccccgatgtatctaatctgttctttgatctgtttagtgagtttttaatgtatattttattgaagtatattaacacaagaaaattcacaaatcttaggtgtccagtttgatgatgatatgtgattgtgtgtactcctg

SEQ ID NO: 395434 - DNA, 473 bp, Homo sapiens
ctagtgcttactttattaatggaagctgtttgaattttcatttggttgtcttgggtttgagggcttctcatcagcccttttttattgtttcacttttcaaaaacattccactttgcttctcatcatctttgttcctcagttgaactgagagcaagtgtgattttaatgaagcactgatccttttttttaagagcttttcagcaggcctagatgattggcatttattatcattttgtgtctgccttctgctcagaatataaaggaatcttggaattattttctctcttctcttataggcccaaaggggtctcacttctctcccccttccttgctttttaaaattttacatctcctacaccttctagcatcccctggtacaatctcctacaggcccttcaaaatcttttgggcacaagtggctgggctgagtcagacagcttggaaatgcaaaaaggcaggccaggcagaaagat

SEQ ID NO: 395435 - DNA, 514 bp, Homo sapiens
aggtaatttgaaatcagactttaaagcatgtttgaaaagatggcaagcatttccatttgttttcatagctttttttaatgacttgactccaaataagaaggatgtcttattatttagcttgacaacatctatgttaaagagactaggatctaaaccccgaagagaaattcagaaactagaaaaaaagaaaatgaacccggggtgttaagctgggaaccaaaaagagcacatttcaattcttttccaccgtaatgccacaaaaccgtaccttaaaacttctaagattacaatcttaggtaagaaaaggaaatattttcagttacaaatagacatgtctttgcgccttcattctagactttttttttgagacggagtctccccgtcccccaggctggagtgcagtagctctatctcggctcactgcaacctccgcctcccgggttcaagcaattctcctgcctcagcctcccaagtagctgggattacaggcacctgccaccacgcccggctaatt

SEQ ID NO: 395436 - DNA, 200 bp, Homo sapiens
catgctctcaaggcagcaataaactgatcaagacacgagacagggttacaatatttttcagtcaggtttaatgcacacatttgcctccaccaataataaactttttgacaagttaacagtttttaagatgatcagtaaagtttttttttaaaaaaaaactctagttttaaaaactccagtgtatgctaacattctttaca

SEQ ID NO: 395437 - DNA, 253 bp, Homo sapiens
tgctgggattataggcgtgagccgctgtgcccggccgaatgcctgtttaacagacattcagtctactgccaaaataaagtaaaggcttgtcctcatggtagcctgcaagactgtttgcatcttcatgtgaagttgtatggcttgcttttctgcatttgttctgtcctcctctaggtgtgagtagtgaggtttcctctttggccaatatttttttaaattaaatttaattaattagttaatttttgagacacag

SEQ ID NO: 395438 - DNA, 203 bp, Homo sapiens
tttcacagggctcctttcctccagctgcccagccagcgcaatttagttattggcagaaaggaatagaactttacggcaggaatatggaccaacagtcaggcagtgatctccaccagctttcctcacaaaggctaaagcaactccattggatgctaatctgccatgttgactaatgactaaaccttttctgggaaggactctaa

SEQ ID NO: 395439 - DNA, 288 bp, Homo sapiens
aacagatccctgactgagcaatagccaatggccagcttgcgaatgctgcaggttgaggaagtcctgaagaggtaggtgaatctcagagcccagcgacactggcagaactcatacacacaagagctctccagctatgtggtggcttaggccatggctctgaacctggggtccttaatgggctacagaagctctgcatgccccctaaaatgacatcattttccagagaccgggtccttggcttttatctgatcccccaaaaggcttgcgagccatttgaccaacacactc

SEQ ID NO: 395440 - DNA, 302 bp, Homo sapiens
gagagaacctcctcctctggaaagctgtctaaattcaagacaaccagagccatctccttatggacggggaccgtaacttttcaatttacccagaattcacattcggcactctctgcctctcaatggctctctctctctctctgaacatgggtatctattctgctcaaacaaatctgtaagcacttctatttctaaaaaaacagctttggccgggcacggtggctcgcgtctgcaatcccagcactttgggaggccgaggtgggtggatcacgaggtcaggagttcgagaccatcctggctac

SEQ ID NO: 395441 - DNA, 452 bp, Homo sapiens
ttgttgttgagaccaaatacaaatcctacccagagtatgcagagaatctgaatgataatgttctggtcttgttaaatttgccatttgaaatttcataatgtaaatgtagcatgacacatctaccaatcatgtcttctctttgactttttaggccttaacccccacattcctagaatgtgatttctttcaatgttgacatacccctgccttccacacacagccatctgcaggccggctaggcaaaaggcctgtggatggagtgagaagagcaagatatgtccattgtgcaaggcatgcccaaacattttccaccatggcttaaaactgaagctggagagcatgatgtcaccatgtcagctggaggcaagaaaggacattggttggaagggaccactggtgttgcagagcaacagtctcgaaggctctcggaggctatggctgagaccaccccc

SEQ ID NO: 395442 - DNA, 248 bp, Homo sapiens
ggattgtttgaagattgaatgtgctgtgatgatagcctaggattattgtttttcaatttttgatgagcgtaagcattcttgttgactatatcttttgtaactactgacccatttagaatggcagaattagctggcagagagattgtcattcattttaagctttcaatctctgacatcttcatctttatttctcagtcttttttacttatcagtggtttactccattattttctccccttttaaaatgt

SEQ ID NO: 395443 - DNA, 319 bp, Homo sapiens
tcccccaacccctcaaacccccaatactgtactttctggaagcaagtcactataaacagccacacttagcgggtgaggagttatgttctaccttcttgaaggggcaatatctacataaattatttggaatttttctgcacaggagatgtgtttattttttcaggcatttatttctatgagtatacattcatggatattttatacttactgggttataatataattggatatttattaggttataattcaatgtcaccttatttattttgttactcaactctttatttttttaagttataaatacatatatatctcaaaa

SEQ ID NO: 395444 - DNA, 434 bp, Homo sapiens
cacagggtcctaaaggttccccaccccccgcccaaccaatgctgcgccaagttaccgttatacaagattaatgaccaattcaacttgataaggctgatttaaaaataaaaataaggctggccatggtggttcacacctgtaatctcagtgttttgggaggccaagacaggaggattgcttaaggccaggagttcaagaccagcccaagcaacaaagggagacgtcatctctacaaaaaactaacaaataaataaatagccagacatggcgatgcatgcctgtagtcccagctactcaggaggctgaggtggcaggatttcttgaacccaggaggtcaatcctgcactaagctgtgattgcactactgcactccagcttgagcaacagagcaagaccccgtctctaaaaaataaataaacaaataataaaaaata

SEQ ID NO: 395445 - DNA, 686 bp, Homo sapiens
atcccagctactcaggaggctgaggcaggagaatcgcctgaacccaggaggcagaggctgcagtgagctgaaatcacgccattgcgctccagcctaggcaacaagagtgaaactctgtcttaaaaaagaaagaaagaaagaaagaaacacccagaataggtaaatccatagagacagaaagccagaggtgatgattgcaaaacattttgaatatactaaataccactgaattgtgcacttctaaatgatcaatggttaattttctgttacacaaattttacctcaatttaaaacaattatatattaaaagacgtaaaaaccattcttattggatgggctgtacaaaatcaaatgacgagccagatttggtacatgggttgtagttcacctctattctattaatacactgagtgactaaagagtcaacagtcaaatataatgcataaacgtggactgaagtcaagtgagagctataaaattttatttaggacattggaaaattctaaatattagacattatggaatttgaattttcttcagtataaccgtaaatctgtggtaagatcatgttcttattcttaggagaggcagctaaaacatttaggaataatgtgtcatgatgtatgcaaattactttcaaataactcagccaaaaacaacagaaaattttaaatgtgacaattaaa

SEQ ID NO: 395446 - DNA, 504 bp, Homo sapiens
acggagtttcaccatgttggccaggatggtattgaactcctgacctcagatgatctgccctcttcagcctcccatagtgttgggattacaggcatgaggcaccacacctggtctcccccagatcaccttgaagatcatgcctggaacctcagcatggagtgagtctccttccccgcctttcattgtcagtgtcagcacttgaaattctcatcaccctgtgcttaaaccagctggaatcatttctgctttccgcaagtggatcctgacctatatagtcaattccttcctgcagcctgggcctggctgcaatatggctgccccacctacgtcaaccacttcctgggacttgaacaccgcatgaggccgagcagatgagaaccacacgttcaacctcctggaaacagtttcctgattttgtttttgtttattaccagaaaaggaagtgtctgaaaactatgtattttccagcagacaaactgcctgtaacctaaactagcctttaac

SEQ ID NO: 395447 - DNA, 285 bp, Homo sapiens
ccgccccccaccctctcccaggcacccagcattttgagcccagaatcatgggaaactcccgtcaggtccacacggtgctgagcccaagcctgcagggcttgggggaggtgggctgctctcagcttcccccagcctggcctggcatctcctggacccccgcaggggtggcagctcagccccttgtgggttttttctttggggggacagactctcgccctgtcacccaggctgagattgcgccattgcactccagcctgggcgacagagtgagacgccatctggaaa

SEQ ID NO: 395448 - DNA, 433 bp, Homo sapiens
aggaaatatggttatggtgagaaagaaaagatagctaaaaacagttaaaaatgtaaactagtctaggttaataaaatgtggaatccaggataaaattttatagtttcaaagatgatgactaagtggatattgacactattcgggacagtggggtgtaaatagttgggaaatagtaagttacatttaagacctactcagttacttggtcctgtggcttgtttcatactgaaaaatgtatgagatcacctacagtggagtttagtcagcatacacagtgagtacatggaggccagacaaacttttagttgaaatgcttgcttgctttggctcacggcaacagtacacttcttatggacttttattattaattttcatcattagatccctaaagcctgaaaaaatatagggcaaacgtatttcgctgtgtattccg

SEQ ID NO: 395449 - DNA, 736 bp, Homo sapiens
gaggggtatcttactgcctaacttttaattttaactattgtttatctgtatgcttaatttggctttttattttttttgttttcctagtgcatttggattttacttagcttttattatgaagccatgtgtttcagtttttttctgtatgtgtaggtgattgggcttatgaattgatcaggagcatggaggaataggtacatctggattagcgagtgtgtgaattcttgagctgatgggcctaagctctaaaggatagattagttgtcagcatattctggtctagatagtatggcatagtttttaccagtatgctttcttttccccatcttcccagtttgctttttactctaatggcttgaaaaagtataggttaggttggaagtgagagaacaaaaatctgctaatttaactctgaacaaggaaggctttaggctgatgtttgaaaagtgtgttccatggaatactggtctcctgaggtagtctgagaaaagaagggtcctgtagtccaggaagttctgcatactccttttgtgaattcaggatgtgttgccatattaagtctccaggatttgcagtcaagaaagttaacttggtttaactgagcattttctgaaattacttggttaaggaaatatggtttttctttcttttattcttggtactagttctgaggatatgttaagggaaattttaggggattgttaaagatctgtggatccttgggtggaggcaggtt

SEQ ID NO: 395450 - DNA, 609 bp, Homo sapiens
gtcgagaaataaaaatttcttttttccagagagaaatatagcagtagctacaagggaaagtgggcaatctaacctaacttaggatagagactgagcatgctttgggtgggggaagcagagattgagaaagaacacaatcaattcagttatagagacaagagtacagatggggtgatttgctttggaaggaaagaggagaatgttttctctgagacagaagggaagggactgagaacagatgaagagagatgtctccgtggtagggtgggaagccgaggagctgaggtgtggcagctttgattctctctgtaaagcagagggaacgcatcgcaaggacagagtgtggggagacagcaggtcactgatgagcctgcagtccgagcagagggacttggacagtgcgaagaggaggagtgtcattttgttggagctggaattgggtgccgctcctctctggagtccacctctcaatgggcactgagaacactgatgtccccagatacacttgtccctgcctaggttaacacaaagagagtgccaatgattgtactctccagctctttatgttttcattctatgcagatcctggcccaaggtgtctaggtcact

SEQ ID NO: 395451 - DNA, 608 bp, Homo sapiens
cgctgccatttgccacgtatttgccatagacccaggactattagcatctttaacccacgtaaccacactggggatggctggggaatgttcatgtccccattttacaggagtggtgattaaggctcaaaggatggaggtgatggatcaaagtcgtctgccaagtggtggcagcattggttctcagaccgaggcccgtctacacagtgctgtgcctcctcccaccacgaatgcacgtggcccactctgcccacgcgtccctgggtgtgattatgaggcacttggggaggggcttgcttgcctcaggtgaaagctgggcttgatgcttccagcggatgtaaagtttgcaccaggaatggatccccagttccagagggacctccaaacccagcagggaccctggtgaggccagtgagagccagagcagcccttcccctccttcctgctgcccctcccctccttcctgctgccccctctcccatcacaaccacttcagcccagaagcgttctatccaccccgcaccccaccccactccacctgccacccagctaaacataaccaccttggcgagcctgtcagaaacagatctggaccgctgtggtaaaacagg

SEQ ID NO: 395452 - DNA, 187 bp, Homo sapiens
gatttcagtcttgccagctgccacaatcaaaagagacaattgctttgaatgaatgaatgaatgtgtgtgtgtgtgtattctattggttgtatttccctggggaaccctgactaatacagttgtgcaaaggtggatgtgcaagaatgatctacttccggtcatgttgcattcctgtcactggagacag

SEQ ID NO: 395453 - DNA, 324 bp, Homo sapiens
aagtacgtataagaataattaaacaatttaagtgtacacttaaaaatggttaagatagtaaattttatgtgtttttttgtacaattaaaaagatttatatcaagttatgcaacgttttttaaagaaacaagaaaatatcagggtttaatcaattaagcaacattaataactttatcaatattaataactttatcataaaatacttaaaatgtggaatatagagaaaatatataaagaattacaaaaaactaatcccatcaacctggagaaaactactctattttggtacactgccctccagcttttggggacacatataaattg

SEQ ID NO: 395454 - DNA, 254 bp, Homo sapiens
aaagaataaaacaaagaataaaacaaacaatgtgaccagatttaggaggtatttaaggaaaacctcagagtcacttcagagtgacagtcattgaaatgggatactaaaagaggtacagaaatctccttatctggctgtgttcaaaatagaatgtatttttagtagagacggggtttcaccatgttggccaggctggagtgcagtggtgccatctcggctgactgcaacctctgcctcccgggttctctcatcat

SEQ ID NO: 395455 - DNA, 357 bp, Homo sapiens
aatgaaggttatgatgaagggagtggtgaagtcctcttgttgattttcctcctgaatatttcagaaatctatctgctcttcttcatctccattgtcaccactaagatactgtcatctctttccaagacgattgcagtggcctcctaataggtttccaacattcacgcgtgtattctctaatccagtgcttcccaggcttttttttttttttttttttaacagtacagctctcagaaaattgtatttgcacaattcactggggtaaccggacaaaggtgctcaaagctggaggcaactgctcaggggggttttggctgccctggaccacccagccactccagggactgagggatcaat

SEQ ID NO: 395456 - DNA, 257 bp, Homo sapiens
caatgaccaaggtcaggggagcctggggtgacttggaatgtttaaaagatccagagaggctgagggatgttctaagctgattaaggagtagttctgaatctcaggcaggacatgcaatgaatggaaggactcttcagaacagttctatctgagctgaggaccgtttgcagaggggcctctgtcctttggagatgcgcaggactcaagctagatgtccactccagcccagctccacctcaattcactgagtctgaccc

SEQ ID NO: 395457 - DNA, 388 bp, Homo sapiens
gtctctagaaccaaaagttatgaatgccaattaagtttcgatttggcttatatgatctcaaatcttcaggtttacaaaacatatcttgagccaccacccagctctgtcacccaggctggagtgcagtggcaccatctcagctcattgcagcctccgcctccgaggtttaagcgattctcatgcctcagcctcctgagtaactgggactacaggtgctcaccaccatacagggatgttttttctatttttttggagagacacggtttcaccatgttggccaggctgctctcgaactccttacctcatgatccgcccacctcggcctcccaaagtgctgggattacaggcgtgagccacggcgcccagcccattttttcttttcacccac

SEQ ID NO: 395458 - DNA, 218 bp, Homo sapiens
gaaatcattatctcatagcatttgtgttacattatttatcacacctatttcatttcccttaacggaaagagcagcaaaagctgtaccttgtctgatgttcaaactcaggaccttcagaatacgagattgacaggtggcctgctgctctaagagagcaactgttcctaagagctgagatccagattattaaatctcatttcccacacactgctgctttt

SEQ ID NO: 395459 - DNA, 527 bp, Homo sapiens
agaaaattccaagtaagtgagacatagaagatgcttaacagtaaagagactttctattaggaagttcaagtgatgcacagtgctacctaggaaactctcctatcagtttttggagtacacctggggcaaatggctaatattttcatctgctgtggagatttgaaattaatagcatcttaatagaattttacttctgattgttcctggcacccccaaatgtcaaaatttgacaccagaagagctggcaaatgtgtctgaaggaaatttttttaaatccccacactcagtttaataaggtcaccttattgtagtcccaatgcaactaaaacttaaattgaccacgctgtttaagaagaatttttctgggtacttctgtgaacgttttttggaactaggaaaaaaaaaaaaaccctagttattaaatttcgaaatgacttgagaacaaatttgatgtttagaaacctaacccaaaggcgataatttcatgtcatccaacatttacttctttttttattagcaaataaaat

SEQ ID NO: 395460 - DNA, 277 bp, Homo sapiens
cccaagtggctgggactacaggcgcccaccaccatgcccagctaatttttttgtatttttagtagagatggggtttcaccgtgttagccaagatggtctcgatctgctgacctcgtgatctgcccgcctcggcctcccaaagtgctgggattacaggcgtgagccactgcgcccggccctgttttcactcttatttacttccacatttctaaataatatgtttacattgctatttttttttttctttttgagacagtctggctctgtcgcccaggct

SEQ ID NO: 395461 - DNA, 522 bp, Homo sapiens
atataacagatgaaggaaagccaccgcagggccttttcgaactgagttcagcttgttcaacatgttccctgagttcgtactctttctgatacacatgtctgcataatctgggaccgacagagcttagcgaccagtggggaatgagacaaggacactctatcataattcagtaagatgacctacctagaagcaagtttctgaggtttctcagttgcttgtatataagcctagcagtgacagaacacaaggtcagattggctgaggcataaaagatgagggggaagtaattcaggaacagctgaagagccatgcagggaccacattcatttattctgtaacaactacttattgaattgctaaagttagtaatcaagatcccccctctttttgttgagacggaatttcactcttgttgcccaggctggagtgcaatggctattcacaggcgcgatcccactactgatcagcacgggagttttgacctgctccgtttccgacctgggccggttcacacctccttaa

SEQ ID NO: 395462 - DNA, 362 bp, Homo sapiens
atacattgactgatgacatttgacactatacaagttatattggatgggatgacaataatctagactgccaagcctctttgtagtatccccagcatttaaaaataaatgttgggtgggacttccaggctatagccaagtaaggaagtcaaccaatcttcttaggaaagcaaatataaggctggtcaaaatgaacaaaaacaatcacttcagtgctttggaaattgaataaggcatacgacaatcggggaagcatttatactagaaaaactgctgaacttttgttagaacagtgggaatctgtggaattgttgcctagggttgcatccatccctaatgcagttcagttgtcatggagattctag

SEQ ID NO: 395463 - DNA, 595 bp, Homo sapiens
gtcccaaggatgagaaactggcaagggcagggggaaacaaaatatgtatgatagccaaattatacagacagaaaagttatggacaactgattaatttcaataattctaggatatgttttaggtgtattcagagggttaaagctcattaagataccagatgaaacttgcaagtacatctccattaccgcagttaataattatacaatttctcaatctgcagaaagccgcttcagtcggaaaaaccaatacaaccataatcctttatctttagagtggtcagagtctgatgaatgggtcaaagatttctaaaacaggatgaactgtatcagcaggttttgtctttgcagaacactgcaactaaaaaaaatgcttattacaaaacatgtatcattaaaagagagtgcttttcccctcttattaccagggagtgaaaaaactccctgtagtaatgccttttcatgtctattttaccaaaaacaccaaaaaaaatcataaagttgctcaatagcatcaaatgacaaagaagccacatgggattgtaattaaaagcaagggatttggaacaagagagatgtgggttcaaattactactctg

SEQ ID NO: 395464 - DNA, 409 bp, Homo sapiens
cacgttttggttagtcaaggaaggccaactgttcaaaccatgttcaaataagcaaataccatgctggaacaaatccagctatttttttacttcacttccattctctgcacatcacgttctctgcccataaattttcttccaccaagcagctgtcctggagtctctctcaacctattatggtttgggggctgccgacgcttaaattgctttttcctcatttaaagtgttacatttaatttgtctaaggttttttagtgcagaattgtggcacacacaaggatggaagaaaaaccgtgaatccacacacattaatatgttcttttcctttgagaattctttctttctttcttttttttttttttttctgagatggagtctcactctgtcacccaggctggagggcaatggc

SEQ ID NO: 395465 - DNA, 315 bp, Homo sapiens
cacctcccacctgacctcaccttcactgctgtcgtctgtgtggttgacacaccaaacccagccactctttgcattaggccttcgcatcggctgttccccctgcctggaatgctctttccccagtatccgtttggctcgttccctcattatcttcagtcctctggttgaatagcacctccttagcaagcccttccgtgatggctcgatcttatttatttgtttgtttgtttgtttgttttttgagacagaatctcactctgtcgcccaggctggagtgcactggcgagatcttggatcactgcaaactctgcctcc

SEQ ID NO: 395466 - DNA, 209 bp, Homo sapiens
catttaagaaaaatggcagcagaattatttgcttttgagatctctggaagataaaaccattaggccaaaattggcaatctaaactcaaggagcagtattcagcatataagacaatatgggagaccttaaattttccctttgtaaaaaaggggatttcttagaagtcacaagttaacaaaaatgcaaatcctgtcacctgcacaagggtc

SEQ ID NO: 395467 - DNA, 454 bp, Homo sapiens
aatggtccccattttataaatggtaagggtccaagaagcaaagcaattcagttagccagcttcttacaggcaggctcagattcaaactcaagataatctccaaagtcaacagttttccactgcaccaaagggcctctgtgttacatgggccagttagctcagtaagtttcccaagcacacatcagtgccagaaaggacatgtgctcttccactaacggagaatccattcccgtgaaatgctaatgacttagtgtcaattcatacattcattcctgttttatcgatcagccttttatgagtttgaccaacgagttcattcataaggaaggcttgatcactctgagtagttggataaaaatccaaattctgaactaaaaggagagccagcccaagatgccaagacctcttagagctgtgtccatgttaatgacaacagaaaaggtctttggcatca

SEQ ID NO: 395468 - DNA, 598 bp, Homo sapiens
actcatataattctcagatgtgccttaatttttaaaatatgtgtatatagtttatacacatacatcataagttggctgcattaaggagttggaaaatctgggacttcatttggatttggaaaatcagttaacatctataaattcaagttcctcattttgaaactgtgttggcaatatctactttagctacctcacattgttctataggttagaatgaaaaattgcatgtaaaatatactgtagctctgacatttgtacggtccctacagaaattttacattagccaatcaacactttttgaaaaatctaactccagtggtttttaaaatgtatgaagtgcttgtattttagtacaaacatctagttacatttaaaacattttgtgaaaagaattgccataaaatatttttaaagttcacatctttcttaccgtttacattcatgttataggctttttgtctcctctcctttcatttttttctactcccagagttctggaagctgaccaaagagatacttgtgtgaaatgcttgtattttccctaccatatttaaggctctcaagagcaattttatgctcctgttttaagattttttta

SEQ ID NO: 395469 - DNA, 269 bp, Homo sapiens
cgagtattcctgtggctgaactagtgagaagagaataatagagatcctaaactccctttttgacttatggggactcagggttagtaggcaaatgaaggtacctgcctcggtgttttatgtggaccatcccatgcattttgtaaacctgtgttccactcatttgtttctgggtcagttgtgattttggtattgaatccttcatttctttcggtttattcatttcagaatttttttaaagattaaaacaactcccacgtgattagattttg

SEQ ID NO: 395470 - DNA, 349 bp, Homo sapiens
tacaccctccgctacactatctagttgagaatcaaccagctcctggaacactgagaccctctcacagaggttcattctcagtaaactgagaacagattgctcaacttctacacaaaaagaagggagaatctttacctagacaaatgacagtcttacagttttcctgcattacatcattgtagagggccttctgagtgtaatccagtaactccaattcttcctgagaaaaatatatggccacttcttcaaatgtcaacaagctctaaagaagagaatggacttcagctctgaacttgccactgcagaagcagcctaactgcgtatgaactgcatggtaggccaggtgcta

SEQ ID NO: 395471 - DNA, 845 bp, Homo sapiens
aacaaaacaaaacatgctgaaatcgaaaacaagacatattacttagagcagctatcataggaccaatggaaaagagcataattagtaaatgcccccttctgcattaatacagggattacatgtcataattccatgtagcaggtgatgggacttcctgacattcctgggcccagcatacaatttctttctttcttacttttttctctaaaaagtgagagagggtcacactatgtcactaggctggagtgcagtggcgtgatcacagctcactgcagcctcaacttctcaggctcatgtgatcctcctgcctcatcctcccaagtagctgggaccataggcacatgccatgacgcctggctaattttttattgtttttgtagagacagggctttccttatgttgcccaggctggtctcaaactcctggcctcaggcaatcctcctatcttggcctcccaaagtgctgggattataggtgtgaaccaccgttcctgacctacaatttcttttcttttctttttctttttctttttttttttttgaaatggggtcttactctgtcacctaggctggagtgcaatggcatgatcttggctcactgcaagctctgcttcccaggttcaagcagtcttcccacctcaacctcctgagtagctggaaccaccacgcccagctaatttttttgtatttttggtagagacagggtttcaccgtgttgtccaggctggtcttgaactcctgagctcaagcagtccatccatcttggcctcccaaagtgctgggattacagtgtgagccaccatgcccagcccacaattttttaaaagcagatcattgtatatataa

SEQ ID NO: 395472 - DNA, 320 bp, Homo sapiens
tgtgtttttctcatttcacagttaaggaatctgaagatgaaaaagatgaggggacattcccaaagtcgcacagccctcaagccagtgcgaaaatgtggaccccgctgccttgtctggtgcccatttctggagagagaaaagcaccgctgggtcgtgggggagactggccggtggcagcttctggcatctcacctgtctctgcacgggttaagaatctcccttgttgtggatttcagaccttgagtgtacagctccccatctggactctcgtgaaggtcgtggtaaacaacacacagagcatctctttgtcacgggctcag

SEQ ID NO: 395473 - DNA, 300 bp, Homo sapiens
tttctgcaattactctgctgaaaggaaaacaggctactcagcactcatttgctttgagttaaagttgtctgtttcatatcctggaaacctatcgtgccttgttttacagaggcatttcatggtttacagtattatacattggagtaaaaataccatttaaaaatcactaaaaagaatagttcgtagtgactttcaggacaactaggacaaacatattatagtaaagcatgggtgaattttatggtatatgaattatatcaaaacaaagctttttttaaaataatgcatgtagagaatagc

SEQ ID NO: 395474 - DNA, 223 bp, Homo sapiens
gacctgagtcaggagagaggtgctttagcgagacaggtcttgctatgtggcttaggctggtcttgaactcctggcctcaagcagtcctcccgcttcagcctcctaaagtgtcaggattacagacatgagccaccaagtccagcctgaagatttttaaaaattattgttagtagtagtcgccagagttactacatccaaagtccctactaagttctaagtagtc

SEQ ID NO: 395475 - DNA, 259 bp, Homo sapiens
aaaggtaccgtcctacatacagtgaaatctcgagagaaaatctcaagaatggctgggagagatacaagaaatagaaaactgcatgtgccaatagctactcttagataggtgcacctgcagtgaagagaccagcatcagacggagtgggaggcccatatgggggaagccagaaacacaggcagagggacagaagcagacagtggagagaaactctggagagaaactcagccttgcaagatggaaagataagcttgcctgt

SEQ ID NO: 395476 - DNA, 676 bp, Homo sapiens
tagcaaggggtaggccattctcccaaagagctaacaatgaaactcctaatacttgtttagcagtcactacctgtctaattctccctggagaatgggacaattctgactgcctttcctttaatcatggagggaggtgaccattctaacaactactcaggacacatcccacaccacctgacccacagaaccacactgccttctgctgagtcccttgcatgccaggcactgggttaagagctttatagatctgaaacccacgcgaggattctacaatgagaaactggaggctcagagaggtaaagtgacttgcacaaggccacacagctgacaagcactattcttatggcccgacaaccaggtctgtttgccccaaagacaatagtgtcaactactagacaaccctgccctccattctagtgttttccacatattacctaaggatggttactctgcaatatgcaatgactctcattgtatttccatttttatatggttacttatctttcaaccagactgccagccacctgatggcacggtggcagctgcaccagctgcacagcacttggcacactggcagagccgatgctggtatttagaggagaaacatacacaagtggtactcaagaaagcaagaaaaggggggggggtttcctgtagagatgacaccaggttctgt

SEQ ID NO: 395477 - DNA, 285 bp, Homo sapiens
gacatagcaagaaggcagatgtctagaggctaaggaaacactgaacctgttgacaccatgatctcaatgaaactgtgaaaaaatgaatttctgttgtttaagacactactctgtggtaattgcttaggtaagtataacaaaatattttgagggagagaggttttaggatgttgaaatcaagaacacgacttgagacatgttaaatttgctgccattttagatggcaagtgaattacttagggctttgactcatctccaggtgcctgagctgctgctagagtatgg

SEQ ID NO: 395478 - DNA, 464 bp, Homo sapiens
aagtctgaaagtgtccgactttgacaggacaaaatgcatcagatacataagatgcaattctgtatgttgggctgcatagaacatgcaacttcaacacaggcttacttactattttagtaccagtacaggtttaaaacctgtaaatacaggaattctaataaattcttcaaaatgtcaaaaaatgatgtatttataacttactttgaacagtcaagtatattcctaacaggagagaatttccattttgatgagacaacaatgacaatgaaatctttttaaaaattcacttctctggtgattggaaagttttctcctagattatctctgactccatacgattcaaacctcatttcttctccattatcctcacactcctggtgttagttactttaagacatagtcatattaaaataccacctctgaccctacagttttcatcaattcattgggtaagttgatatagg

SEQ ID NO: 395479 - DNA, 319 bp, Homo sapiens
cttcctgtaaggtcttgagcaggtcatttaactgcacctgaaaatgaaaataactgtccccacctcaaccagttgttgtaaggattaatgagataatagatataaaagcatttgataagctttaaaatgttttaagaacataaggtctactatcttccagtgataattgagaatagtaattgtgtgttccttgtttgcttcattaggcaaggtgatcaaaaatatttgtcaaatgaatgcataaattaatgaatgaatgagaagtgagtgagtgaatggacaagtgaaaaaatcaataaatgcctaaatgcaatctaag

SEQ ID NO: 395480 - DNA, 324 bp, Homo sapiens
cctgtgggccacacccccttggtcgcacctctaacctcctggcatctagcggtgaagccccagaacctggcttctcctggcatggagctccatcatcttcatgatgttgttgagtggactcctttgactgcctctccaaccaccagaagagccaccaccaaacttattattgatgatggtgcccctctcccagcacattctttatggtcttagtgaagagtgagctttctgctccttctcttggactatgaccttctcttgggtcttttggtctgacataatatacaatctctgcttccttcagcatatcctctggcttctgac

SEQ ID NO: 395481 - DNA, 274 bp, Homo sapiens
atgaaaattgtttcccctcctttttaagtgactaaacatcttttattggttttatgatatatatacaaatagactagtggtgagcatagctgccttccaaatggactatacaattttattttttatttatttttttagatgagtcttgctctgtcacccaggctggagtgcagtggcgcaatctctgctgactgcaacctctgcctcctgggttcaagtgattctcctgccttagcctcccaagtagcagggattacaggcatgcgctaccacg

SEQ ID NO: 395482 - DNA, 287 bp, Homo sapiens
ctcagcctctcaagtagctgggaccacaggcaggtgccaccatgtctggctaatttttgagtttctttgtagagatggtgttttgccaagtcacccagtttgaggctggtctcaaacacctgggctcaagcaatccatctacctcagcctcccaaagtgctgggattacaggagtgagccatggcatgaggccttgtggggtgtctcttttaaatgaaagcatactctgtttacgtatttgatatgaaggaatatccttcctttccacaaagacaaaaattatccta

SEQ ID NO: 395483 - DNA, 193 bp, Homo sapiens
gtactaagaggtctaacaggcatttgagattaatagatcccaaactgagttcctggttcccacccaatcctgctccttccaccagccttctttatcatagataatggtggctctgttgttccacctgttcaaacagaacacctggagtcaccttgtactcttattctcctagtccacttctaattccacagaa

SEQ ID NO: 395484 - DNA, 745 bp, Homo sapiens
agagcaaccttacttatgttaccataaatgagtttgttaaattaatgttttttaaatttaccagttttaattcctaatatggtaaatcctaacagatatacctatgtaaacaaaagctctttgggatcttcaatatttttaagagtatgaatgagtccctgagacccaaagtgtgagaaccactgatacagaaatcagacttcggtaacttttatgatcaataacaggtgtccccaacccctggaccggtaccgatcgctagcctgttaagaaccaggccacacagcaggaggtgagcagctgggggagtggggagtgagcactatggcatgagctccgcgcctccagtcatatgagtgctggcattagattctcagaggcatggaccctattgtgagctgtgcaaacaagggatctaggttgtgttccttatgagaatctaactaatgctttgatgatgtgaggtagaacagtttcatcccaaaaccccaaccccctatccaccatccatggaaaaactgttgtccacaaaaccagtccctggttccaaaaatgttggggatctctgctctagaagatagctttacattctgaaggtttctgggcacatgaaataaccattacccagaccaaatatttaatttttatttatttacttaaaaaaaatttttgagacagtctcactctgtcatccaggccagagtgaggctcatgcaggttcactgcaaactccatctcctgggtt

SEQ ID NO: 395485 - DNA, 762 bp, Homo sapiens
tgaacagtggagctcatgatggcattagagcaacacccattttactgtgttgtgaggagtaaagatcataatggacataggtgctcttgattcatttgggaaaaaagaggggcatggggcagggatttgcttgtggaatagtgctctgagggcagggaaagcaggtagctatttttatgggaaccacacacaaccctaatactgtaggagttgaaagaacaagcttttaggatggctcccagcactgccccttgggagctgtctgccttgggcactctttgccataggcgctgtctgtcggtgccccaacgacgtcttcatcctggaattcaatcagacctcaaagccccgtggtgataatcaaaagtatcaatatgtggcaaaggtgtagaagagtgattggcttgtaggaagcacttaaggcaggtgcacaatcaactttgtgattactactaatataataaagcagcaggttgtttactctgatgtcccgtggaccccttaagtatttctggagccaggcctatgtctgcaaaatgatgagttcctgccccagagagctacagcatctttctgtaaaaccataattgattcagactgcacctaactaacctagccagaaagttggaatttcaagatgaccaactagacctttaatagttcagtgcttttatagttcatgtccagggtcacatgtcactgggaaacaaacctccatccttctgtcctgtgaaatgggtactcatcctcaaggtggtagaa

SEQ ID NO: 395486 - DNA, 638 bp, Homo sapiens
gagcggggtctgggctgagagttggggtgtggactgagagtggggtctgggctgagagtggggatctggataagagtgggaggcctgggctgaaagtgggagtctgggctgagggtaggggtctggtaatgagagtgaggtgctctcagagttaaatgctcagtccccgtgtacacctggggccctgccaggcagttagtaggattcagattattgtcccacactatttattgaggatctattatatctaagtcagagcaggaagcacggctttagtttcctgtggctgccataacaaatttctgcacaattcatggctcaaaacaccaaaagtgcatcctcttgcagctctggaggccagaagtctgaaaacaaattatgggcagacttggctcctcctggaggctctgagggggaagccgccccaggcccgctcctggctcctgccagctgccggcagtgctgggcgttcctgggctcagagctgcagcagtccagcctctgcctccacttccacagggccttcctccctgtatccctttatgtctcacatgtccctctccttttcttatgaggacacctgtcatcaggtttagggcccaccctaacccaggatgatctcatgcagagatcctcaa

SEQ ID NO: 395487 - DNA, 837 bp, Homo sapiens
gtgttagttttatgacttgtgtttttccagaaatttgtccatttcatttatcaaatttattggcataaaattgttcataatatttcctgtcaactttataattctatactctgtatagatttattcccaattcctatttttatccccaatattggtaacattttttaaatccctgatctagctatttatcaactttattgatctttttgatctgtttcctatttcatctatttctgttatctttattatttccttctttctactttgtatttaatttgttctttctctagcttcttaaatggaagcttaggtttagacttttttcttttctaacattaacatttaaaactaaaaatttcactgtaatgactactttggcttcatcccacaattttaaaaagtatgtgaatttttctgaaggacacaatttttaatatgtagtcattttattatcatgtggttcaaatttactttcattatggtcagaaaacatactctgtaagattttaatcttttgaaatacactgagactcatgtcctaacacacggcctaccctggtgaatcttccttgtgtacttagggagaaaaagtgtattctgtatttgttagttacagttctataaatatcaatcaggtcatggtagttaatagtgtttttcagatctttgatttctttactttggtgggggcgatccagttgtattatcaactacagagtgaaaagtgtccaactacggttgtagtttgactgttttccctctcttagttgtttgcttcatgtattttgaaactgtatttattaggtgcatatacacatgtaattcttataacttcct

SEQ ID NO: 395488 - DNA, 404 bp, Homo sapiens
cattctaggtgaggttgagaagaatgtgtgttttgttattgttggatagagtattctataaatgccaatcagatcgaattgattgatagtgttcttcaagtcaactatatcctttatgtattgtattcctgctagatctatcacttactgacagagggttttgaattctccatctctacagtgggtttgtctttttctctttgcatttctattcgtttttgcctcgtgtattttgacactctgtaatcaggtgcatgcacatttcttggagaactaattccctttgtcattaggtaggtttcccgtttactcctaacaattttccctgttctaagtcttctttgtctggtattaacatcgctacttcagttttcttttgatcagtgtgttgtctaactttttcc

SEQ ID NO: 395489 - DNA, 599 bp, Homo sapiens
cacaccacctgagtcaagttaaaggacaatgaaaaactgaaaaaaaaagatttataatggtacaaagtgttactatctcaatgtataaagaacttccaaatgataaaaataaacattaaaagagccaacaatgtgatagaaaaatgagctagaaaaatgaagagacagttaaaaatgccaatgactcctacccatatgaaaatatgcttagtatcattcataataagagaaatgcaaattaatgctacattgatatgtttctcacatacaaggactcagtggtgtgcacaccacctgagtcctgccagccctaaggaagttccttttatgcattggaggaaaaacatgttggcttttctcttgacgtgggagaaattgaaaagaaggggaaggggaaggaaagaaggggaagaagatcaaagaaggaaagaagaaggggaagaaaagaaggggaagaagatcaaaacccaccatgccccaggctcaacagcatgccgatggaagtggaagagcctgaagtcttgcaggactcactggatatatgttattggactccgtcaatgtactttgaactacctgactcaggtggtgtggggtac

SEQ ID NO: 395490 - DNA, 613 bp, Homo sapiens
tgagctcggtacccatttgtcagttttggggggcagatgactcaggtggtgtgaaaaaaaaagatttataatggtacaaagtgttactatctcaatgtataaagaacttccaaatgataaaaataaacattaaaagagccaacaatgtgatagaaaaatgagctagaaaaatgaagagacagttaaaaatgccaatgactcctacccatatgaaaatatgcttagtatcattcataataagagaaatgcaaattaatgctacattgatatgtttctcacatacaaggactcagtggtgtgcacaccacctgagtcctgccagccctaaggaagttccttttatgcattggaggaaaaacatgttggcttttctcttgacgtgggagaaattgaaaagaaggggaaggggaaggaaagaaggggaagaagatcaaagaaggaaagaagaaggggaagaaaagaaggggaagaagatcaaaacccaccatgccccaggctcaacagcatgccgatggaagtggaagagcctgaagtcttgcaggactcactggatatatgttattggactccgtcaatgtactttgaactacctgactcaggtggtgtggggtac

SEQ ID NO: 395491 - DNA, 459 bp, Homo sapiens
atggtgtctcgtggtcagaacaaatttatagataaaaaaagggaagtgacgtacagaaattggaagtgaggctcagaaacagctgaattagttacaggttggcatttgccttatttgaacaccgtttgaacacccagcagtgtatgaatggttgaagtatggctgtgctgggattggctaagactcagctattgttataggcactattgttataacctctaagttaggttttcaattttccctacctattaagttaggttgcagttcatccaaggactcaaatatggaagtacagagtccttctcatttagtttgctttaatacttcccgtgaatcttcggagtttccctctgttgcccaggctggagaactcagctcactgcaacctccgcctcctgggttcgagtgattctcctgccccagcctcctgagtaagcagcttggattgcgggtgcacgc

SEQ ID NO: 395492 - DNA, 345 bp, Homo sapiens
tattacgaaatgatataagcatggtcctataaatactttctaatggtttcataaactggctgttgttctttctccacccttccagaagaagagctcagagctggagatttcacaattcccttctaacaactatgcattgatcccatttgcgataacctgacattatattcatatcacaatgatccagacagttgtgcatatttcaggaatggaaaagacaagtcatttattatatagcaatttttttccttttttgtttggtccaacaagttgggcaggcctatgactacatctcaactgttgtgtgcttcttatttcatatattttatttgtgtctgcctgaat

SEQ ID NO: 395493 - DNA, 205 bp, Homo sapiens
ttatggtaatctgtaatctattctcccacaaagctggactattcctgtaagaacatatcttataccatttcattcccagctctgaatcctccagtggttacctatgacaattaacaaagaaatccaagctctttactatggtctgtatttatctgctcctcagagtgtgcattctcctttccgcctcccagtgcctgcagcctga

SEQ ID NO: 395494 - DNA, 306 bp, Homo sapiens
atatttagaactcaacatttgagatagtccctcaaaataaatcatgattctagcaaccaaaacagatatttcagttaatgggcttttattttcagagcagcaataatcttttctttttagtcaggcttttagaaagatggcttcatcttctccttctacaacgctggcacagaaccaccctaaagtgtttccctgagtggccaaggattaagatggggccactcaaccaccaggacccacttgtgactgaccttcccttccccacttcagcagccaagtgaacaccccgggggcaacctaatcagc

SEQ ID NO: 395495 - DNA, 141 bp, Homo sapiens
actagagcattaatatacaatgagggcaaggagaaaaatgtgaggaacccagatgatatatttggatacttcttggtacttccttgcttaactatgatgactgtaaatggatagatacattaactctggattgtgaggtga

SEQ ID NO: 395496 - DNA, 368 bp, Homo sapiens
cccgagttgctggatagttgctgtggacagtagcccaccaccacgcctggctaatttttgtgtttttagtagacatggggtttcaccatattggccaggctggtctcgaactcctgacctcgtgatccacccgctttggcctcccaaagtgctggggattacgggcgtgagccaccgcgcctgtccaaaatttctgttttatttggagcacagcatgtggaaaaaatgatgttgtggaatttgctgtggctggatggagagagctggaacttaattcctggcctgctgtctctccctctctttttaaaaaaaattattgtaatttctatgaggttttaagaaaaattcagtgtggtcgtgtaactgtg

SEQ ID NO: 395497 - DNA, 103 bp, Homo sapiens
ctcccaaccccaagcctccccaagccctcggcctgctgcagggaccctgtgcagccccaggtccagccctcaacacctgctggcacctcaaacccaatgtgcc

SEQ ID NO: 395498 - DNA, 383 bp, Homo sapiens
tgagacagagtctcgtgctgttgcccaggctggagtgcagtagcgttatctcggctaactgcatcctccccccaggttcaagcaattctcctgcctcagcctgctgagtagctggaattacaggcatgtgccaccacgcccggctaatttttgtatttttagtagagacagggtttcaccgtgacaggccaggctggtcccaaactcctgatctcaggtgatccagctgcctcggcctcccaaagtgctgggattacaggtgtgagccacctcatccggccactaagtgggttctgatcatactattgtgtgatttttttttttttggctgtatcttttaagatctatctaaatatcagtgattcttatgattggctgatcat

SEQ ID NO: 395499 - DNA, 503 bp, Homo sapiens
aggaggtggaggttgcagtgggccaaaatggcaccactgtactccagcctggaaaacaagagtgaaactctgtctcaaaaaaaagaaaaaaaatcagtgattttccaatgagtgtaccatgtgcaatccataggtgtactgccaaatcttgatcaatatgtaaaatttatttttgccacactgagcatacacattattactacagagccttaatttaatattgaacaaggaagaatatgatgttcaggatgtgtgcatggtgggggaaagaggcaggatcatttgtcctaagttaaacataaaaagtgccctgttacatcatgttgggtccagagaaagagcatgtggttatcagaacatgaaacaactttgatccatgagtatattaagcctgggttgtcagggcaataaaatttctgctccaacaagaaggcaaacaaaagaactgcgtgatcactgtagatatctttatagataccataaaactctgttttgtttagtag

SEQ ID NO: 395500 - DNA, 359 bp, Homo sapiens
gggcttccaatgcatatgctggtgaggtggacccaatgtcctttgatgggcaggagagggagtgggctctttgcgaatttagtaaaaagaggctgtcactttgaagctgccaaaagcagcaagaggccttgttttagaatgcatttttaagtgttgttctatttgcagagtgacagctgggacagctgaggaggagagtgccaggcgaggcagggacactgtccatgcaggggaggtgaaaaaccatggggctgatgaaaatgcacatggatgtcaactccagggatgtcaaggtcttaccctggcagcagaagcacgagcggccgtcacagcctcaaggaggcagggtggatggcagg

SEQ ID NO: 395501 - DNA, 358 bp, Homo sapiens
ttattctatatctgcctcagtttgtggtacagaagcaatagatttttctctttatttttttaaataaatataattttattctaaaggaatattattatatggcaacactttgagaaccataaaggtgcctttgaaatgttgttagaaaatcacttaaatcatattttttattaataaattgatgccattttcaggcacagtatttttttgggcaagcactgtacagcataattcaaaatatacccatttacagaatccaattaggtatttttctgctcacaattatatgatggctgatttctgctcacaattatatgatggcggatttctgcctacattatgatgtgatatgatatga

SEQ ID NO: 395502 - DNA, 308 bp, Homo sapiens
tggaaatgggagacgtttttgaactggcccaccttgttgatggtgtggttttgagagacaaaattaatgatgtcgaggatgactttaaagagtgtgatatttgtagactagaatggtgatactattggcagaagtggatttgtctctatggcctctacggatcttaaaattgataatacatccctctttatttagtttggctgcctggaaactcatagccttatttgctcctcagttttagtaattaattgcattttgtgtagaaacctcaactctctggttgtatttgatttttctacccttttccc

SEQ ID NO: 395503 - DNA, 580 bp, Homo sapiens
ctcgaagcagagctaacttgaggatcctggtacatcctgaaactgtccatggttcccaggctgctcaagtcaagggtcacctgtaggccagtgctgagcctattgattttttttgtttgttttgttttgtttgagacagggtctcattctgttgccctgactggagtgcagcactcccctcggcttccccactatgcttgttggtacccaaagtctggcagggccaaggcagcagggggccagcatgtcagcactgccccaagtgtgtgcacacctggctgggctgtgacagtaccccagcttggccccatgttgctccaagatcagagcaggtgccaacagcagggagaagccagtcagtaggagcagtcacttctgagaccatggggttgggggacttcccaggcctccaagagtgcagagaggcccaggtctggaggtgtgaggcatgcagggtgcctgcctgctctggcccccaagaacacaggaaggcctgagtccacagccccaacttgggcagctgcagttgcacctggggtgggggggatgggggctgctgcctgctcccagctcccaccag

SEQ ID NO: 395504 - DNA, 259 bp, Homo sapiens
ccgggttgctctgtgctctcttagcgctccagaacgccctgtcctctctctttgagccccgggacaccctgtcctcgctccccgaggccccgggacgccctgtcctctctctctctgcgcctcgggatgccctgtcctcgctccccgaacccccgggacgccctgtcctctctctttgcgccccaggatgccttgtcctcgctccccgagcccccgtgacgccctgtcctctctctttgcgcgtcgagacgccctgtcc

SEQ ID NO: 395505 - DNA, 440 bp, Homo sapiens
tgccccacacagaagctcttgtgctctcagcctgtgtcttaggttctctttgcaaatctctctccacaccgtctgaaggaagtgtgcttacaggactctgggggtaggatggaaatagatgttcttccatctcacccttaggggctgaaaacctggggtggaatccttcttttgccccttaggtgctgtgtgacctcaggcagctctcttgccctctctgagcatccatttcctcatctcctaaatgaggatgatagtatctgcttcccaagattgctgtgaagattattttcttcttcttttcttttcttttctttttttttttttttgagacagagtctccctctgtcacccaggctggagtgcaatggcacaatctcagctcactgcaacctccacctcctaggttcaagagattattgtgcctcagcctcccgagt

SEQ ID NO: 395506 - DNA, 627 bp, Homo sapiens
tgccgtcacggtcaaatatcactttctcaaacatactgatatattttggctgtgtccccacccaaatctcatcttgaactgtagtgctcataatctccacgtgttgtgggagggagggagcaggtggagatcattgaatcacgggggcggtttccaccatgctgttctagtgatagtgcgtgagttttcaggagatctgatggttttctaaggggcttcccccttcgctcagcactcacttctcttcctgccacaatgtgaagaaggaagggtttgcttccccctccaccatgattgtaagtttcctgaggtctccccagccatgctgaactatgaatcaattaagcccctttcctttataaattacccagtctcgggtatgtctttatcagcagcgtgagaatgggttaataaacatatattttctgactaccccctcccctcctccaaccactcttaccttatcctgatggcactgttcactatctgaaattatattatgtgtttacatgtttgtctggctcacttctcccactacattttaaactcagtaagggcagagacttcgcttatcctattacatttctacctcgagtgcataaaaaaaagtctgaaacactggaggca

SEQ ID NO: 395507 - DNA, 880 bp, Homo sapiens
tcactgctgtattttaacagtgcctgccctgaagtaggctctcaattaagatctgttgaatgaatgcattaatgaataatgaatgaatgaatgtggggaactatggaggaggttaatggtgaagatgcaacaactaaacagtaaatgaggaaagaagtgcttggattcgactgaaatatgtagaactgtaccctttgaggaggaaggagaaagggaagggtggaaattaactgtcgaagaatgagttttgaataaagaaaaatctgagccaatcagtcaggcaatattgaaagttttgtgcccggtctgacaaattggagtgcatctatcagagggtggtgaagatggtgggaaattgacaaccatttacatgatgaggaattgattaattattttgaaaaagaaaaggaaggaatgaagaggtaggaaggaagcatggggaaggggaaagaacataccagatgaaaagttaccatgagagggagagtatatagtatatttattttgaatgtacaatgcattatttttatagtatatttggggttatcttggtaggaagaatatatatttattttgaactaatcacagtaaatagctatagtacatcaaatttctagatcaataaaagaaaaaaacttaatttgttcagaaaatagggtgttttgtgtggtattgaacataaagtcccttgagtgttcaagcaaagcctgatgatgacttctcaggagtgttacagaacgtttaaaaaaacttgtattagggctaatggggatggtaagtttgaagtgcttctagagccagtggctggtgtcagcctgctctaccattgaactaactcagaagtgatgaaccagctttctgctacgctaccagaaagagg

SEQ ID NO: 395508 - DNA, 703 bp, Homo sapiens
ggggaaggttcttctacttgattggaaaatttccaaataaatctttccagaagatactatgcacacagctaagtggcctgtctgtggagtaacccttttgtaaacaaacagaaacctaaagcttgatgttttggggggctgcctgtcatctataggttcatttaggtgtatttaggaagaggatccatgaaaccactggtttcctgttacataataatcattaataatgatttaaaatgtgtacattgattttttttaaattccaaaatacaagcgtatatggtaaattaagtcaaatgtatgttcagtgagcgagatgggcttggggcaaaacaatactttgcttccaaagaggatacaactctcaaggagattctttcatcttgcctttaaggtcatttaaactaattcacataatcttcagaaaactaattcacatcatctattcatgtgtaaaatcaaaaggaagactgttttcttagtctctcgttgcctaactggccatttatactactaggttgattaagggatttgcctttttctgctgatatgggaacaaaaagtcttaagcatttttaaaggcaatggaaaattcagccacatgggggaaaattgatattgtcaccattgagttgctctgtttcttggtgaagagtgaatctaatctgatttccttcttcatcagatatgcctctttaacaac

SEQ ID NO: 395509 - DNA, 358 bp, Homo sapiens
acacttactgtcacaaaacatctggtcctatgtgaaagctggaccatttttcctcgagatgagatgagtttctatcttagatatgtgatagtgacttatttgtttgaatatcctagtcctacccaaccctattcactctccaactagtattattactatatacaaagtttaaatcatgtaaagaaaagtcaaagttcagcacctctaataacttagtcacaaatttatcaacaaattactgcgaacttgaactcttctttcttctatcaaaatgaaaaacaaagcaggcaatcgaatgcctttttaagagtcagtttgtcaccgagccctcttaaaaacatctgttttaaagggtcaa

SEQ ID NO: 395510 - DNA, 380 bp, Homo sapiens
acacacctccatgcctctgctcatgttcccttcgaggtctagccattgctgtcacctctcctcacccttactgccccatccaactgacaatgcttgctaatttttcaagactcaacccaagtgctatgacttaagtgtgtaccccagaattcatgtgttgaaaacttggtccccagtgcagcagtgttgaaaaatagaacctttgggaggtgatttggtcatgagcattctgccctcatgattggattaattcattcatgaattaatggattaatgggttaccaagggagtgggtcagttatcacaagagtgggtctcttaccaaaaccagtttggccgtctctagtgagcccttcttgccatgtgatgccccgcaacat

SEQ ID NO: 395511 - DNA, 376 bp, Homo sapiens
aatttatgagcatttatggcccggttatgccttaaacgggtaagaaggtttgcatgaactgactctaggagtgagtgtctggggtggcatttgtagaaatgaagttggcaggagaagaagtacagaatgatcacagtggagaggtggaaaatcatagctcaggaggagtgttccatttggctttagagagggctggggcagagaagagtgagcaggaaatgaggctgggatggtaggttgaggctagactggagagtcctcatgtcccatctctagtggaatttggacttgagactgtgctgaataaatagcatcagtaggtttgtgaccttgggtagtgacccattctgaattcgaagaagtgaaacaggcagtg

SEQ ID NO: 395512 - DNA, 312 bp, Homo sapiens
cgcccgcctcagcctcccaaaatgctgggactacaggcatgatgacaccacgcccggctgttatttctaataggaagttgccgtcctcttttctcaccccagtggcatttctggggagcagttttcccacctgctgatcggactccttgtggtggtcatatgggcttggggtgaatcgggaggggagagtttaattggcttacatgtcaagctgtttaaaacaggcctttcaggctagtgagtattgatgctggttatattgagaagctgtggcgggcgggggtccgggggctccttcgtaatccttgtgct

SEQ ID NO: 395513 - DNA, 421 bp, Homo sapiens
ggagttcgaggctgcagtgagctatgattgtgccattacactccagcctaggtgacagagcaagaccctgtctctaaaaaaataaaataaaataaaaaatatgtaatttgtaaatggttctccagtactaaaatgctaagcctatatctaatttagaagaccattaaccttacccatttaaatctggccctgtctagggttgattctcatgtttaaagattatacgtacatttaagagcatgttgtaatcaagtattttgaaaacaagtgacctgttacctttaaagatactgctgccaaatagtaacttgcaaatgcatttatttacttgttctatattggggtaaagggatatttataggtgaaaggtcataaaatttggagcttgttagaaaggtgtgtaaacacctcatgtaggttg

SEQ ID NO: 395514 - DNA, 402 bp, Homo sapiens
tcttcgtcatcgtgtataatccttgcaatatgttattgaatttggtgttctaatgttccgaggagaatttttacatcaatagtcaacaggaaaattgatttgtagttgtatttttttttctccttagtgtctttgtggggtttggtgttgtgttaatgctgggctcataaaataagttggaaattgttttatctttttcatttttctgaagtagtttaagaagggttggtgttaaccctgctttaacattttgaaaaaaatatgtatttaatgaagtgatccgggcctgggctttttgaggggaggttgttgttactacttatatgcctattcagatttttttatggtttatttttagtataatctatatttctagacatttgtctatttctcttagcttat

SEQ ID NO: 395515 - DNA, 627 bp, Homo sapiens
tccctttcagggacatggaaacagtagttgcctggctcattctaaagaagatctcagaatacttccttctaatgttagagagaaagagacttcctttacttcaagccctacctacttacaattggtttttatcattatcaccatccacagtgttgcaggctgcctgaaaaaaatctcctatcagacacttaaggccatttcacagcttcctcttcccaaaccacattgatagcactgggttatcatctgtcctttagagatttaagattcttaacttcttgtcaccagcagaggcatgactttagctattaagggataaatctgattatcacgattggaagaaaaagccagtacacctctgggacacattatggcatggatccttgggaaggcccaagtctgtttccccttcactttcttagagctgggcttctctcctaaagctgctgttgctgtgtgctcttgggactgttaccccaaccaagatcctaaaaaaaggcttagatgtgcctgtggttggggtgctctgcaaggcaccaaaaaaagaaacctgcagaaggctacataccatgaaggaaaaaaccacaagaatgtgggctacaggagagtatgatgtgaaaagcataa

SEQ ID NO: 395516 - DNA, 367 bp, Homo sapiens
gaattgtctctaaaaaacaaacaaacaaacaaacaaacaaaaaaaaactattagctgggactacaggcgcccgccaccacgcctggctaatcttttctgtttttagtagagacggggtttcactgtgttagccaggatggtctcgatctcctgaccttgtgatcggccctccttggcctcccaaagtgctgggattacaggcatgagccatcgtgcctggccgtgtgtacgtattttttaaggtaaaatacctcatgagtttatactgatgtgccacaaggcttttacttaacttcattcattttacatcagtattttctttctctcaaactgaaaatagcagttctcactcacaccaacacaattt

SEQ ID NO: 395517 - DNA, 475 bp, Homo sapiens
cggcctcccaaagtgctgggattataggtgtcagccagcgtgcccggccaggcacagcttttaaatccaaatatttagtcatgaccttgctataatattttagttttcctcacctagttttgtgtgtggcataaaattataatagttgcttggaaaaagtcagtgatttgcaaaagggtgacacagccatggttttgttgttgttgttgttgttgttttaaggatctataaaagtgtctttgagtagcatttttttttcattgaacatttattttgaaattctgtagtctctggaacacagtctacccattcctctgtcccatgtttctttggaagtgccacaaccttgggtgtaacaagagtacaaccagcattaggctgtacctggaatcaaatgaatgcagtaaggagcttgcctggaagccagcacagagtaaatgttagccttccttttccatccacacgtttccttagt

SEQ ID NO: 395518 - DNA, 232 bp, Homo sapiens
aatcagccacagagcagaccctgcagagcatgatggtactgctaggtgcaaattgatccatttccctctggggaattatcggaatctagtctctgccgctatgattaggatataaatgataccactcctgcctccagagaaaggtttttttttttttttcttaagaagcagggtctaaccctgtgggcggcaagccacccaggcaccgaggcaagagacagaggacacgagc

SEQ ID NO: 395519 - DNA, 175 bp, Homo sapiens
taactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagc

SEQ ID NO: 395520 - DNA, 474 bp, Homo sapiens
actacagccatgtgccaccataccttgctaatttttgtatgttttgtagagatggggttttgccatgttgccgaaggtggtcttgaattactgagctcaagtgattactttttaaatgtaatttaatttataaaagatattagctatattaattatactgccatctagtagagtcttgatattgcaataaccttaacaaaaaaactgtagtttagaaaatattcccataggacaacactaaaaaggtaatgtttttggctttaaaagaagatgtgaaagtgataaaaggaaaattgggactgtaatgttacaagtgtgccttttaacttagagctgccactaaaatacataaacagctttgtgaataaagccgtacaatgtaacaaatactagaacatggaaaccattattaacatacaaatcatatcttgtgatcctcgagcacagctgcagtcggtccgcgctgactgcatc

SEQ ID NO: 395521 - DNA, 454 bp, Homo sapiens
actacagccatgtgccaccataccttgctaatttttgtatgttttgtagagatggggttttgccatgttgccgaaggtggtcttgaattactgagctcaagtgattactttttaaatgtaatttaatttataaaagatattagctatattaattatactgccatctagtagagtcttgatattgcaataaccttaacaaaaaaactgtagtttagaaaatattcccataggacaacactaaaaaggtaatgtttttggctttaaaagaagatgtgaaagtgataaaaaaaatccttcaaaggtcttctctagcaaatatgtatttattatatagtttgccacacaaatggattttatagccctggaaggaaacataaagacttcttacaaagcaaaatttaagtaataattaatagagtactgatgaattatctctgaattcagtcttgaaatg

SEQ ID NO: 395522 - DNA, 544 bp, Homo sapiens
ccacccgcctcagcctcccaaagtgctgggattacaggcttgagccaccgcgcctggcccagtatctttgtttttatcaccccttttgtctcttgttttgtctttgggtttccttagaaaccccttcttaaaaagagtctgagctttgcagtctttcatctataatcttctgttattcaggggctctgtaaatgtggtggtaaagtgtgtgtagaaggaagcattctatactctataattaggtgtcagtcttttggtgggtctttgccctgggctattaccttgacaagtttttctcagcatttcctccccttaagtgagagaggaaggttagagtgggctgaagttgtctaattgcccttctccagctcagataaggctttggttagacattttcttgagagcttaccttcattacagagaacggaacgaagaacagaacgaagaacagaactctctgggaatattccaaaatagctatttccttctctccctgctggaagcagaagcggattctctgatcttcacagtgagaacatgttgg

SEQ ID NO: 395523 - DNA, 777 bp, Homo sapiens
tgggcctctttttttctgttgatgcttctccaacattccaccatggatggaacctctaacacctcataacatgtttggaaaattaaaagggataatcactgcttattattcctactaccatagaaggttaaaacatacctgtcttttgggcttagctagaactctaaatttagtaatcctacttactactaataacaatacaggcagtttccagagtttccaatttacttacataagttctgtcttccaaaattcagttataaaacaagaatttgaatctcacaatacactttcccataaaaaatgttataagacataattaaaactcaggcctacctatctaattatcccaataccttagagaaaaaaaatggtaccgtagatcaccaatcatgtgtgattcatagcacatgctgtgaattctagctacagagatatctgaaacacagctacctccatgaaaattctagggatgagaggcctcatgcctgtactctaccatctttagtaaaagacaacattttgcgggacatgattttcactgggtaacttcagcctcagtttttgggcaacatcaatggcagaagagaatgagggatggcggggtggaaacagttattgttatgtgtatgtaattgtaaagactactttattgctagcgatataaaattgctaaaaactttggcatttgttttattgctccctcttctccctcaccccttaccatcactccacaaatcaaccaaagccaatgtcctaagggatactttcagttgt

SEQ ID NO: 395524 - DNA, 475 bp, Homo sapiens
ggtgagagtatgaaggaatgagtgagaacaagcttcccagaaaaggattcaaacagagcttttatattcagtgctgcttactgtaaaacaaacagtacataaaagtattcctgagattcgggctatcaatttaacacaatcttttccaatacaaaccaagtctgtaaactaagtctgtattttcattttttaagatatgtcattacctaagatatatactgtagaatagaatcattcttacaatacggtaaaaaatcataactttgcatatactctcatatggtatgactgtgtccccacccaaatttcatcttgaattgtagctcccataatccccacttatcatgggagatacctggtgggaagtaattgaatcatgggggcaggtttttcccatgctgttctcatgatagtgaaaaagtctcacgagatctgatggttttataaagggtagctcccctgcacatactctctt

SEQ ID NO: 395525 - DNA, 402 bp, Homo sapiens
aatacagaattatatattttaggaattttgaagaaatgaccacccacagcacttttcacttgcaggatcaggccgagtggtgtggtgagctgctgctgctgctgctcctgctacaacttcggggacattgcacagtagacccttctttaggatctctttccctccctccttccctgcccccggaggtgctcattgatgcataaagggaaagcaagagtggagctgagcccctggtgccaccagccctggtaccaaaatactggctgtgcccgcttgctgcggggtacccttcagccatcatcccctcctcctcccaagctggaaactacagcaggggaggctaattgtctgtgccttctcccttgttccctccttactgaaatctactcagtaaggaccaag

SEQ ID NO: 395526 - DNA, 651 bp, Homo sapiens
  misc_feature (33)..(33): n is a, c, g, or t
acaaacagcctactcacaagtgagagaaacccnaacccaaactagcttaagcaaaaaggaattttatctcacataatagtccaagggtagagcttgatcaagatattaaattatgtcactatggcaagtcatctccccttctgtccttcttgcacattggctgtatctctgtcaacttcccccacttgtggagcaagatagttgccatagttctcgaatcttcaagtgtttcttgactgaagttaagtggggatgagtctcagcttctctcggcagtcccagaaagcctcagtgtatcttactagctttgactggggcatagtcctatccttgagctatccttggccagggggaatgcatatctgattggccaggcctgattcatatgcttactcctggagctgggaatagtgaatgccatctgaaactaacctcgattctggagggagaaatagatccctagaagaaaattgggatactgttatcagaagggaaatggatgcagaatgttcacaaatacatcccttctttactcaatgtttttcttaattacaaataaattcttctggccaatgctctatacaatgccttctctactctcttcaagatccataacacagtgcttatcaaactttaaaatgcaaagaaacc

SEQ ID NO: 395527 - DNA, 382 bp, Homo sapiens
atggagacagggcctccctctgttgcccaggttggtcttgaactcttgggctcaagcgatcctcctgcctcagcctcccaaagtgctgggattacaggtgagagccatagcacccagcccggtgctacttctgactctgtgaaggcagcaaccacatcctccctttcagacctcacataaccagaagattccccttgtgaatggggtagtgtgggcctgtcagccttcacggaggtctggcctcacaggccaagggcttctggctcacagggctccctgtgctgtggggagatgccaaggtgatggtcaggacacagcagccacttggagaagagccccttatgctgacttttggagcccactcccactttgctccctctgg

SEQ ID NO: 395528 - DNA, 345 bp, Homo sapiens
aaccccccgcagctgtcctgcccagacgcccgcccaggcggggtgggggaggctgcaccggcgctcaggtcgcgcagcgcccggcagcgcgcagtgatgtcaaccgcatccgccgcagtccccggcagccctaaaacgcgccgcccgcggaaaccccagcccggctcctcccgccagggccgaggaggagaggacgcgcgggtccccggagtcccccactccgtctgcctaagccgtggagaccgggagtggacgcacggcggtgccgtggacccccggggaggaggaagaagaggagagggaagggagctgtggagtcaggtgtcgatttgacgcccgcggccg

SEQ ID NO: 395529 - DNA, 400 bp, Homo sapiens
ctaaatgccaataaggaatactctctataatggtatttccaaagtaaactgggaaatttgaatttgcaatacacgtagaatcaatgttagagtcaaggatcagaaagctaggagcactatataatctaccacagtcctatggttcaatgatataaagacaaattccagaaatgtttgaatttctctatatctcattctctctaatgtgatcaagtttgaggggacaaagaaacactttcctcctttgaagtctacctgtacctattaaccagcaccatttcaacggcaatgggtagataaaacaaactaaaaattccacactgctcctcttcttaggggatacaatgtattcattcttttcaaaattctcagatgctactttcaagagagctcatattat

SEQ ID NO: 395530 - DNA, 695 bp, Homo sapiens
gggccccttggacttggctggcagccgcctgcgaaacaccgcttctcagcggtctgcaagttcctttcctccctgcgcccaagatgggcctgacaagggcccgggatcagaccagaacctctgggggctgaagacctctccccacccccatcttacaaagtgtgtggggcttgcggagagtggccttggatcctaaggcgccaaggtctcagactctgaagtggaagggaaatgcgcgaagtaggagtcttttgtgtctgtgcagaaggaggtcctccggccgccggcccttgttgcacgtctggatagaccccttattgcattggtggtagactccccatttgccccctagatttcctttcaccttggcttggaggtgcacagtgcaacccggaggagcgcccggggaagacagcttttaatcgactccatccgctctgtccccaaagagtgacacagcccagaggtggctcagaaccctaatccggggtgaccctaagagcccacaggtccactcaggcccagggcttcaacttttcttccaggagacaagagtgcagatgcaagccactttttgattacaaatgctaatttcttgtacaagctgttcttttaatttttccctggaaagaactgtggcagggagaagggcgtcttggtacaaatatgggtattcatctcctttatggtgcaat

SEQ ID NO: 395531 - DNA, 150 bp, Homo sapiens
tcaaaagaaaagcaaaataaagacaatttcacaaaacaaaattcactaacagacttgtggtttaaaaaaaaaaatgtggctcggagcagtggctcacgctggtaatcccaacacttggggaggccgaggcgggtggatcacctgaggtca

SEQ ID NO: 395532 - DNA, 160 bp, Homo sapiens
aactaccccatgagatagtatccttgttttacagatgagaaaaccaaatctaggataggaagctcaagaaacttgtccaaagtgacccccagtttgaacccacatttgctgttacaaagccaaggcattttctactgtgaaaagcagcctcttacacatc

SEQ ID NO: 395533 - DNA, 295 bp, Homo sapiens
gctgttataagtgtttggcatacagtactaggtgaaaaagaaattcttctgacttggatagtcaggaaatgggggagggatccagagagggtaaagtatgtaagaagaatagttgtggggctgtggatttgttggaacttatgcctgtcctctgtaagtaagagatgtctgtgaggagaaagcggaggtaaatagatgggagattaaaatggacaggatttgtagtgattttcaggtgagcaggggagggagtttgaagtcgcgtaatagccaacatttatttacttccgagtag

SEQ ID NO: 395534 - DNA, 677 bp, Homo sapiens
tctgttgcctaggctgattttgaactcctggcctcaagtgatccttccaccttagcctcccaaaatactgggattataggcataaacgaccacaactgcctgtctttgtacttttaactctttgtttcgtccctggctccatgtgagctcctgttcttggttcacttgttctttgctttttcttgtatgtcattgattctgaaatgttacttttagaattgtcttctgagttcaaggctcagattttctgtgcctctgatacctttgcatgtgggtaaatatgccactctccctacaaatctggaaagtctagaaatacggtttaatttttggttttccagatttactgcttcgcatatattctcctatactccttcttcagtttatggcattatcttccctatctctgagactaaatattccttccttgccttctctttcattctacctcttattttttttttcccccctggattacttttttaatctaacacttattataagaaggaaactactgtgctttgacagatcattaattaaaatagaatatattggacagtgtacattataacaataatcacatattatccccatttgacaacagaattgggccttaggaaagcttaatgctggttagtggtagagctgcaattctagccaagatctgttctaaatct

SEQ ID NO: 395535 - DNA, 521 bp, Homo sapiens
tcagcaagctcattggagctggtagatagttggaatatttgtgaataagtggtttgtattccatctcccaaaaagcccgacaactccttcagatgggtttaggttagcgtttttcaaactgtggattgtaaccccttggtaccttgtgaaatgaatttagtgggttgcaaccagaattttaaatcaacagaatagaccaggaaagaaagtatcagagtgcatcctatgtatcaaggataaggcattgttttatgaaatgtttatttccattaggtatgtgtatatatctactgggtcatgatgtaaagtatatttcttactctaggttatggtcataagcgttggaaaaacgccagcctggaccaaaggtccagtgtccctccgaggaattatgcatgtgccacaatcccacaggggctcatagccactactcccattccttccctctccagtctccaagccccatgctgagtggcccggcctaggaactgttcctttttgaactttgctgactctccgag

SEQ ID NO: 395536 - DNA, 328 bp, Homo sapiens
cttaggccgggggtggactcctgtgttttggggtaagctgaatgctttggaccaccattacacagcgggaggaagctctcaccagtcctccttacctgcctcctcgtctccctttgtctatctggcagttgccatttgccaagcccatcttcaatgcagtgctgttggaaaggagctctggattgtcacatggagaacaagggccaccctttgctgtgaccttcagatttccccaatcatctttggacaccgtgcgttcatgagtctccttattgtcccctgccatgctggaggaagagctgggcttccttctgccccacgctgctca

SEQ ID NO: 395537 - DNA, 283 bp, Homo sapiens
ggagacacagacacagaggagaaggccacgtggagacagaggcagagactggagtgatggggcctcaagcccagggatgcctggagcccccaggagctgggagaggcaggaaggaccctcccctagagcctccacagggaggatggttgatatggtttgactatatccccacccaaatctcacctggaattgtaataatcttcacgggtctatgtttattgcagcactatttacaatagcaaaggcttgggaccaatccaaatgcccatcaatgatagactgg

SEQ ID NO: 395538 - DNA, 220 bp, Homo sapiens
ccaacacctgggtagacatcacctcctcctggaagtcctcctcagtcacctcctacagggttggtgatctctgtttccctgttcccgttgcactttgccattgatactaatcaacagtttcaagagtgattccccactagcctgtgcccgtcttgagggctggagacaggattatcctcacatccctgctcccagcccagagagagcacgctattattac

SEQ ID NO: 395539 - DNA, 600 bp, Homo sapiens
ttcgacttcagcctgccaagtagctaggaccataggcgtacagcaccacatttagaagtccctgagaaaattatcttggaggaaaactcgcaagtccgactattggttttccaaggaagccagtctcgcctgtgaggagggatcctgctcgccctgggagcctactcagacaccatggggaatggggggtggggctcagagcgcgcaggcttggtttttttccccctccgaactcctgagttccagtgatctgcctgactcagcctcccacagtgctgggattacaagtgtgagccactgcgcctggcctattacttgttttaataataacaaaaaacagcaaaatcttgcagaaggttggaaggtaaccaagcagcttagcttcaaaccacgttttaaaaactttgtttcttttcttctttctccccagtttctagacatagctttgagacaaactgcagatgtgctttcttttgtcgtcaattactgccttggaatgggcattaaaactgccttccctttcgcatcttatgcccccatgccttatgctcatttatttacctggatgcttgttaagctcataccatgcccacttatctg

SEQ ID NO: 395540 - DNA, 374 bp, Homo sapiens
cagaatctaattcttgttctttcagtgaatttcatccaaatattaataaaactataaattaacagcatgagtttgttaattacagatcatggacaaagttatcaatgactgatgcacatttcaatataaatattaggtcacaaaaatgttatgacatatagttattggtacctttttcacttgcttttaaaaaaacaaaactgggctgggtgcagtggctcacgcctgtaatcccagcaatttgggaggccgaagcaggcgtatcacaaggtcaggaggtcgagaccatcctggctgacatggtaaattcccatcttactaaaaatacaaaaattagccaggtgtggtggcacgtgcctgtaagtcccagctac

SEQ ID NO: 395541 - DNA, 446 bp, Homo sapiens
catttcccagtctttccactgtactcactccctattcccccaccccagggcctttgcacaagcccccatgtgacaagccatgccctctgcctagaagtgcccttcccttggccttccccgtggccggctcctcctagcacatgaggtttcagctcacgttgccttctccaggagagacccccatctcatcacctcatgtgctctggctctgacactgggccccatctgaggtcacctcatttgtgaactctcctgtttgtcttgcccccaccatcggctggctccctgcagggaggcccctgtccccacttgctgtgccttcagcttcccgtcagtgtttttgagtgttcacctgaataaactgacaagcactcgaggtccctgccaggtggccccagcgtcctcccctgggcctgggccaagctgcaggcttcttcaggaagggg

SEQ ID NO: 395542 - DNA, 959 bp, Homo sapiens
agtacagagttactttccccagaaatttggtggagaacagaagacgaaacagagctgataatattgattttcatgagaagtcagatggctgcttaaagggaaggggctgaagaaacagagaaggaggtaaaggatgggaacagctgctgtgggaattgatacagacaggaaactggctagattttctgaaaaggctgtcccagcagcactgagaggctcagcattaagttatcataacttggtaacaacaccaaccagctgggctctgcagctctctctaacagtgccaggcagccctcgagagcaggacgcagaattagagacactagagtctctttgggtggggccagcctgaagtcaggagcactgagcagctgctgaacacgattgcaaaggcacaatgtgggctcccagatgggcaaaagaaggaagcccttgggaggcaggtggatcgggaggacaggcaggcattggctaaggatgggaaggtggatttgcagcaggtctcatgagaatgacatggtaagagaagcagcagctccaagtcatggttagagaggagcatttccagtgggagtttaggtgggacagttttgggcagtggaaaactcctaggtgcggctctgggctgggctgctggggagaaggtgagaggtacgaggaggtggaggctgctggagctgcaaaggtggaggatctccaaggacaggatttcagcagactgaacacggaaagtgcctacagtgctgggcagaggcaggtggaggagaggctgagaactaggggaggagcctgccaagaaggcggcctgtgagaagggagttgtgggaaacaggttggtgaggcaggagctgggctgatcagacaggtcactgggccaggctggagctggaactttaatccacaggcagtgggagttttgaatttgggcagtcacaatctgagccgtgcttgggaag

SEQ ID NO: 395543 - DNA, 525 bp, Homo sapiens
tcagttgataagccctgaaatatcttaaaattttaggattgcaagacatccacatatcctatgttatattagcagaagttaaatttcagaagaaaaatacagaaactgagcttcacgattgtgtctggagtatacaggcaacattcaatttttgtcaagcacaaggtttaaattaagactgctgagtcctagctggattttttttttaacccacatttttccttacagtaccaacatactaatttctccaattcctgaaacataccaaaattgttaaacatttttttggtcaagcttatcactatattataaagtttggtctcactctagatgcagcaaaatatgactggtcttatggtattttcttttttaacaaagataactagttgaacaaatgccctgtgtcaagcaggacttattctgggatggccatgattaatattaaaacagggcaactgcttaaaatatacaagatctttggctaaaatctagaaagaccataagctaacatcacagatggattta

SEQ ID NO: 395544 - DNA, 345 bp, Homo sapiens
agatataaacattaatgtgcaccctttcgtacagcacttctctagcattttgccagggaacaaaggtttcagctagagaaaaaaaattctaaaggttgagacttctgggagaaaatcacagatcatttcgtagtaaagtataaaggcttttcagatactctgaaatcagactttgtcaccttgtgtccccccacaaaaaaataatatttttgagtgataaccagtaccaaatagacaagtcaggctgtttaccagtggaacagctccaggttatgaaaaataatgctgaaggacagggtcctttgctagaagaatgtcacttgaggtacaatactctgtcctaaa

SEQ ID NO: 395545 - DNA, 277 bp, Homo sapiens
agtaaaattctctgatatttcagtcttcagacgtacactatactctccttatatatgcaaaaacatatattcagatacatgtacatagacgacagttgatgactgaaatggtgtacagtataacatctgccaagtcatttcctgagtggtaaaggaaagtggccatgtgttctctgacttcttataactcagggaagataagaagagagcacaggaaaaaaggcagccattcagtgacatattatacctcttcagttaagtcaggtgacataagttt

SEQ ID NO: 395546 - DNA, 719 bp, Homo sapiens
atcttcccttccacctaccccatatcacaaccgacattggattcctcaaactgggcaagctacatgctttcagagacctggacacattacacggaagagggattcccctcattttggccatcatgaacccattagaggaaattgaaagctgaattacactacagccacttaggaaagaataatgagaaggaataatgaaagttcttttaataaggtgacagcaaagtgtctccagccttttttttcttaacattttttatgttttacttttgcctcactttgcatttcaatattctgaatttacgtaaataaaaaacccctagctttgcttttgcatgtgctgggagctttgctgactgtaggcttggaatcttttcatttatgaaaagcattcattgaagttccactctaatgattcttggaaagctcaggggttaacagccaggaggaaaaaaaccagataaaacaaagttaggttcacaggaaggactcaagattggaagacagtgctggaattctgagcttgtgtggacatcaaatcatcatcccattccaatccattatttgtttattcatgcactcatttattcaacaagcatttaaaacacctctgatgggccatttatagcaggtaaatctctcctttgcccagagataggaaattatttaaggaaaatcctgcaaatttaattttccttatattaaaaattgtgaaaaat

SEQ ID NO: 395547 - DNA, 381 bp, Homo sapiens
ctattgaggaagaaccaaccctgaagtcaccctaccaccagaggagacagcttgtgactcagggccatacattccttgtagcgtaagccatctttggttgggtcctgtgttacccacagctccaagcctccttgccggcgaatttcattctgctcctctgaaaccggttttcactgccatctgcaataaccacggctgccgtgcacaggcaccacatctaagacatcatacgtttattatttattatagcaattttcccacagatggcagtaaagtgttttgttctaataaaatcagtgtgttacagtagttttctgatagaagtaaattaccttgaggaaggggcacctttttctaattcacacaagggcacaatctagc

SEQ ID NO: 395548 - DNA, 347 bp, Homo sapiens
tgcagctgctgctgtaggtcgctctagaggtcccccatgcctcatccaggggtaattctttaggtaagaagcagtggaattttgtcaatccagagatgggaccgagtttttgtctgggttcacacctggtcacagagattacacacaattgttaagacccagaaagagcgaggcccgagagagactaaagggtgggaagggcttggatgtgtgtaggcacaaaaactagtgggcttgcaccaaaagttttctgaatctccaaatgagcagggacgccccccgacctctgtggcctgcctggagttggtgccgctttgcacttgccactggatgagggcatggggtac

SEQ ID NO: 395549 - DNA, 375 bp, Homo sapiens
cccccctcccccatgaagccagtggtctggtagtaatgaacccccaacggcccggagaaaactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttga

SEQ ID NO: 395550 - DNA, 317 bp, Homo sapiens
accatggcacgtgtatacctacataacaaaactgcatgttctgcactgtaccccagaatttaaagtataataataaagaactaaaataaagccataccttctaaaaaaaaaaagtcaaaagaactaaaaggagaggtagacaaatctacaatcagagtggggacattaacacccctcttcaaatgcccagagtcaccctgactcccctcatatggaaactctagcttctggaaaatctaagcagaaagctaaccagccctcacatggagaacatcttctttataggaaatccttgctgtgagcaaactgcagatggg

SEQ ID NO: 395551 - DNA, 181 bp, Homo sapiens
tggcggagggcggcctatgttcctagagctcaaggaagcattcaatcacacgctcaacacgtgattttcaggccacttgtgtgttttggaaacaagtatgtgaccaggcacagaggcagccaagattcaaatgagtgaatgtcccatggacataattaaagagaaagggcttgtactaaac

SEQ ID NO: 395552 - DNA, 216 bp, Homo sapiens
aggcaaatgaatactattaatatatgcagacttaggatctaatcaccaaatactagtgggctgggttactactacctgagttagaaaggcttcttttgcttctatttggcaaatgtaagaagccagtcacattcttcctttttttttttttcggaaaggaagttcccttttttggcccgggtgggggggcaagggggcaacctcgagcgggggcaa

SEQ ID NO: 395553 - DNA, 220 bp, Homo sapiens
aaagggtgtaatcatgaggttagaatgagggttagtgccagtcctcctatcacatactcagatgttctccagtagtagaattaaaacagcaagttactctagcagatgttttcaaattagctaaaaccgtgtcaccagagtaaagcagcaaagctggaaatgtgcccagagagaccttcccacaagccgcctgagggagccatttaaatgtctctgagcc

SEQ ID NO: 395554 - DNA, 216 bp, Homo sapiens
cgacactctggatgcattaaaaaaatcaaataatgtgagcaacaacaatctgggattctttaaccttaacagggtctagataagaatttcaggccaggccgggtggctcatgcctgtaatcccagcactttgggaggctaaggcaggagaatcacttgaacccaggaggcagaggtagcagtgagctgagatcacgccactgcactccatcctggc

SEQ ID NO: 395555 - DNA, 215 bp, Homo sapiens
cattgttccattgttcagaagaggaaacaggccatttcgggttcagtgatctagaaccaggctctgaaacctatggcctatgggcccagatcagccaattgcctgtttctgtcaacaaagtttattggagcagaggcacgctcatttgtttctggatggtccgtggctgtttttgtgctgtgactgtagaggcgagcattgcgggaggggtttta

SEQ ID NO: 395556 - DNA, 438 bp, Homo sapiens
agtataggctgggcacagtggctcatgcatgtaatcccagcactttgggaggccgaggcgggtggatcacttgaggtcaggagttcgagaccagcctgctcaacatggtgaaaccccgtctctactaaaaatacaaaaaattagccaggcgtggtggtgggtgcctgtaatcccagctactctggaggctgaggcagaagaattgcttgaatctgggaggtggaggatgcaatgagctgagatcacaccattgcactccagcctgagtgacaagagcgaaactctgtctcaaaaaaaataaaataagaggtttggaagaggtcagttatttaacccctttcctgatatacctaagagctctaaaaggaatgcacctgagtcactgctgtagctaaacaagcaagttgtaagaaaatccataggctatacagacttttg

SEQ ID NO: 395557 - DNA, 277 bp, Homo sapiens
tccctaattagtggaatttctgttgctatgactaagcaattatgtctactactgacagtgtgtggaggcgaggaaagtatcttggaaaagaggattttcttcttactccttaaagtttaaggctgcctcatgtacaaggtctccctcagtctctcaaattcatccatcttcccacacaagtttggtttaaagcaccaataagccctacccttaggcctatgtaaaagcctatcattctgatgctgcagaagccaccaagaaccaggctaagaaccaa

SEQ ID NO: 395558 - DNA, 268 bp, Homo sapiens
atttttgcatctcagtaccaagatttggaacttcacatagatgtattcgaacataaaattttaaagccattgttgccccagctatgtgctacagacccccccaccgaccacctggttagttttctgagagtttctgcgggaaaggtttacaatggctggttcctggtttgatgtcacatcgataaattatggtgctttaaacagatgtgatctcacagcatagaattcttcagggtaaagctcgtgaaaaggttttttccccctcttg

SEQ ID NO: 395559 - DNA, 370 bp, Homo sapiens
gaggcctcccttcttttactgaaataacttttacttttatatctgtatcaactaaggggtaaaagtgacactttagtcactttggacaataaaaataaatttttagataattttaatacccttttatcccatacgattcttgatcttgaatttcaattctgcaatcttaggactgtggtttaaaacattacaggaggattttctttttttttttccaaagactgagtctcactctgtagcccaggctggagtgcaatggtgcaatctcagctcactgcaaaaaaagttatccttctctcctaggcttccaagaaattcaggggtaaatttgtagttcacctatagcaactggggagaaggcgtaacgtgt

SEQ ID NO: 395560 - DNA, 411 bp, Homo sapiens
ctttcatgacctgccataggatttcagacttacctagccagcccccacaattgtgtaagctagttccttacactacatcgcttaatatatacctcccactcgttctgttcctttagttgaaccctggctgatacaacagaacaggtgagataatctgttctcagaggcgaagggatttgcccaagtcacatgactggcaagttgtcggcctaagagtgggaccccaggcaacctgatgcagttgtttcccagctcccacacaaactctcccttgaggcccacatccaatcatcagagtctgtccaacacccgcagtgccttgccccctccactgctgccagagcccacatcctatctcacctggctagcagccccctgcgaccttgcacatcataacccatcctgcctagt

SEQ ID NO: 395561 - DNA, 488 bp, Homo sapiens
gagccaccatgcctggctaatttttgtatttttagtagaggtggagttttactatgttggccaggctgatctcaaactcctgtcctcaagtgatacgccttccttggcctccctaagtgctggcattacaggtgagagccaccatgcccggccagccaatgtattgtttatctcagacattttggttttcatctctagcagctcagtttgagccttttaaatattttccatgttgctacttaacatttccaacatattgaatatagaaacaatagcttttaatgtccttctctgctaattctaatatctgtgtctgatcggggttgatttccatagattgattattctcttccctgtgggttgtgctttcctgcctctttgcatgcctgggaatatttgattggctgccagacattgtaaactttacctttttgagtcttggatattttgtattctttcaatcttctgagcattgttctgggatgctg

SEQ ID NO: 395562 - DNA, 253 bp, Homo sapiens
ggctgcgggcaggggagagggccctggggcgcccttgtaggggctggcggctatgagcgtgtgtctcttccctgcctcagctgttgcaggggcccctgggggcaggagtgaggttcactggccaggaggcttgtttcctgtgggcctgttccctcctggctgtcttgttggtttgttggcatctgccgtctgccttccctgaagcctcagcagagaactgacctcccccggtacccccaccacctgttcctgc

SEQ ID NO: 395563 - DNA, 228 bp, Homo sapiens
ggagtaacgacaggttgctggcagaagcagtttcagggcccggaagcctgactgcagcaggaagccgtggacggggaatgaagacaggagtgcggtggagaggaaaggacatgctctgctcctaggaaccccaagagagctgctctgtcctgacctgaaggagcagagatgaggctgagctaagagcagtacagccaggtgtggtggctcatgcctgtaaccccgaca

SEQ ID NO: 395564 - DNA, 289 bp, Homo sapiens
ctcccagtgtttctacctggagtgttacctcacctcacactgctccatgcatagtgaagtggattcaaatgaatgaaacacccacatcacactcagctgaagaggaagggccaggaattcacacggagttggcggtccgacattacttacctgctctgttctgtggctacctgtggagattgtgcagcctgatgcctcaagggtccaagaggaaagagggaagcctgcctgcctgacctcacagggcctggtggaacctagaggtctgaggaaatatttgaggatcatg

SEQ ID NO: 395565 - DNA, 484 bp, Homo sapiens
aaaatcaaaatcatatcaagtatgttctcagacaaaaatgtaataaaagtagaaatcaataacaagaggaacctgggaaactgtacaaatatgtggaaaataaacaaacagcatgctccagaatgaccactgagtcaagaaaaaaaatatggaggatatcaaaaagttatttgaaacaaatgaaaatggaaacacaacataccaaaatctatgggatacagcaaaagcagtgcttagagaaaaatttgtagcaatagatgcctacatcaaaaaagtaaaaagattccaaataaccaatctaactgttcacctcaaggaactaaaaaaggaaaaaccaaatcccaaatgagtagaaggaaggaaacagtaaaggtcagagccaaactaaacaaaatagaaactaaaaatatacaaaattttaatgaaacaaaaagttagatttctgaaaagataaaaaattgataaaccatcagctagactaacc

SEQ ID NO: 395566 - DNA, 727 bp, Homo sapiens
acacacacacacacacacacacgcacacacttacttgctttttttctctgttatcactgttgatcatcactgtttctcagcaggcagacttttttctagtttctttcattacggtaaaaggaatatgtgtttgaattcagcagtgagtcatctgagatgcgtgttgttatggaaaattgccatagcgttcagctgttacgagacagaagtcaaagctaagcacatttaatggccggagatgagcggtatttccaagaagttctttttattatttttacactttagatgaaatgggtatttggatgggatgagtcccattatgctgcggttgctcacgttggggggatgtgttcacacgtctgtgtggttgtcggtgtctgtgcatgcaatgtgattgagctcctgggtaggtgttcctttctgtcttgaatacaaactggaacagtatgagaacaagctcatgattattatttctactgttatttatctttgatttaagagatcactgtgaatagctttggatgccatactttactgggaattctgacttaccttatttggcaaatacagatcatttccaaaatgtacattcagttgaaggataaatagttgatgaaataggtttaaaaaaactcaaaggacattaaaagcctcattttattgaaaaataaataatgactttttttttcttgaagacgaaccctgttatttagaggcctaaaagatt

SEQ ID NO: 395567 - DNA, 355 bp, Homo sapiens
ctgccaaatgagctcccttggcctagctagtggggacagtgctcaggaacggaacagtgctgagtgagagcacgtcagggagctgtcctcacagttgctgccctttccgagcaaggggacaaaaccagtcctgttccaaacatcaacggcccaacgaaaccgcacctctttcttattctttcaagcaaggttggcgtttttcatattagaccatttgaatttcaggaaaagcaaattaggccaagcgcggtggctcacgcctgtaatctcagcactttgggaggccaaggcaggcggctcacctgaggtcaggagttcgagaccagcctggccaacgtggcgaaaccctgtctct

SEQ ID NO: 395568 - DNA, 659 bp, Homo sapiens
tacaaaggctaaaaaaaaattgctaggcatggtggtgccctgcctgcagtcccagctactccggaggctgaggtgggagaattgcttgagcccaggaggctgcaatgagaaaaacaaaacaaaatggctaaaatggtaaattttatgtacatatattttacaacaataaaaaatgtttccatatagtaccttcacagtcaccttgatacatatatatataacaaggctgtagtaaccaaaacataatatgggctaaaaacagacacataaaccaatggaacagaatagggaacccagaaataaatccccacatgctaaagaatgaaactgggcccctgtctctcaccatacacaaaagtcaactcaagatggattaaagacttaaatgggaccacacctataatcctagcactttgggagcccaagcctggaggatcacttgacccaggaattcaagaccagtctggacaatgcagtgagatcccatcgctacaaaaaaaaaaaaaaaataggcatggtggcatgcactggtagtcccagttacttgggatgctgaggtaggaagattccttgagcccaagagttcaatgctgcaatgagctatgatcgtcctactacaccctagcctgagtgacagagtgaaaccctcctctcaaaaa

SEQ ID NO: 395569 - DNA, 697 bp, Homo sapiens
cacattagaggctcattggaaaagtgatgagctgatcactaattggaactggttagactcaaggattattttttaataatatttattgactgtatataatgggtatgaattggtgctaagcaatgagaataacaaaaagcaaagaagacatcatccctcctttcaagggaatcaacatctactggcagagttttacttgtaagtgtattattatcatactacatggaaacgtaagtagcaatcaaattcttagattaaaaaaaaaaagtccctaggttattctacccataagcattttaaacagctcgcttcacatctttaaaacaaaacaaaatgaaacaaaaacactccttggatcctacataaccttccaactaccttttatatatattcccccctttccttatccaaacttcctgaatgttgtctacacttgctgccaccattatctcacctccctctcagtcctatacccaaattctatccatccagcttcactcaagtgacccataagtggcaaatcccatggacctcatttcagcactcatcctgctacccttcagcaacatttgacattcctggacatgcttgcagacttgaagcactatttcctctctttcctctggctttgctctgtaatgtatttcattcactgtctcttttgcgaatgacttctcctctaccaatcattaatgca

SEQ ID NO: 395570 - DNA, 273 bp, Homo sapiens
gaggccaaaaaaataacaaataggaagggaggaaggaaggaaggaaggaaaagggaaggaaggaaggagacagaaaggggaaatagtaaccctttgtgtcactaaaattcatttcatcatatattaatgttatagttaatgcctaatagaaacttttcatttttttaacaaagggaacatgaaaatgaagttatggaggttgaacttcttgctaaaacatatgccatggtaataagaatgctttatgctataataacaggatgaagttggctg

SEQ ID NO: 395571 - DNA, 444 bp, Homo sapiens
  misc_feature (1)..(1): n is a, c, g, or t
ngaatttagaggatccccccccctccacgggtatgctgggcagtgggaacggcttgagcaatgcgtggaggcaggacaacagaagagtgttcaaggaacagtgtgtactcaggcctagttacagcagagggggtcaggaggagggaaggaagtcgattctgggaaggcgcctggagaccggaggctccaaacgcagcactgagcccctgactgctctcagagagggcacctgagcagacaaagctgggccatggaggcagattctggaaggatgagaaaaaaaactggagatagggaggcctgggagggagacaagttaggaacagatctacacactggagggtttaaacgatgggtttgaaactcagccagaactgagttagaatcctggctctgacttgacgtggccaaccctaagcaaagaatctctcacctctctatgcc

SEQ ID NO: 395572 - DNA, 1052 bp, Homo sapiens
gtttgctttatgtactgtgttttttagtaagtcagttggtgcttacaattcttgaaattttgtatacaaatggatagaaattgaatttgtacttccatcattatgacatgtgttatggaaaaccagaattagaaacctcttgttaaatagttcagcggaggtcctttaactggatgttttaaaccgtttagttcctttttttccgttaccctccatattcttgagtgcgctaataggaattttcctagtgtgaattccttgtggtttcttttgtcatttctttgttccctttgtcagcatttctcaaatggaagtgtgcatcacaattacctgatactcgtttaacatacagattttctggttctatccccagtgattcttactaggtcttcagcatccagaaatttgcatgttaaacaatctctccaggtgatcaaatgcaaatagctctaatgttattctttcagaaagcaatgctttgctatacatggtctctaagtcagagagacataggatccctgaaaaagcatcctcctatatgtcagatgggttttggagaggcataaacagatggtaatacggccctcatagctgaggtagtctcagctatgagccctataaatggctatgaccttctgtttttgccactgaattttaaattggattattgacattagccacctacatgactcatgcatccctcccagatcacttttgatccagacagaaccagatttctggggcagattacaggtaaccattatactacaaagggaggtaattttcttttaagttagatggtttgtgtgagctgtacatttcatcaaataccttttcccatctgtaatttgttcttgagaatatggagctatttacttagaggggatttgaaagaagagttgaattatttatattagtttgattgaaagttggaaagaaattaaaagatactgggaaagtgaaaaatacagtcctagagggagtatacattaattgccaaagatttgaggaaaatgacatgggatgctggagaatcaattcattttctgatc

SEQ ID NO: 395573 - DNA, 167 bp, Homo sapiens
gctgaccaggttgttaggtcctagagggcatgaatagtaacttatctctgtgttatctgtagttccttgggcagggccttccataaagtgagtcattagtaatgactattgatttgaatccattaaattttgattcaaacttttttctgctcttttcctgtaaagct

SEQ ID NO: 395574 - DNA, 362 bp, Homo sapiens
ccaatctgcatgactcaagcatgaagtgggggccagatgagctctgctatggaggccagggaagcttctaataagataaaatgaacaatcaccttttatgcctttcagttacaaatgcattcggtgaatacagttttcagagttatggcttccaaatgtcactgatattgcaaagtttaggaagtattctgataattaagatataaaaggagaccagctcatttgaacactcattttagagggataaaatcaaaacctgttttatgttagttagtctttctttgtgaaaacctattagatgtaatcagcataacttggtcataatgtgttttcattatgtttgattttatttggctatttta

SEQ ID NO: 395575 - DNA, 363 bp, Homo sapiens
aaacttttactaaaaaattctaagcatgcatgaaagcttttaatcagatttaaaataaaataaaattttaaaaaaccagccagctacagtggctaacacctatattcccagcactttgggaagctgaggcaggaggatcacttgagctcaggagtttgaaaccaacctgggcaacacagcaagatcatgtctctacaaaaaatttaaaaattggccaggcatagtgacacacatctctagtcctagctattcaggaggctgcggtgggaggatcgcctgagcccaggagttcgaggttgcagtgagctgtgatggcactactgcacacctgcctgggtgacagatcaagactctgtctctgtt

SEQ ID NO: 395576 - DNA, 279 bp, Homo sapiens
cgatgttatctagactcactgagcttctggctcttagttttttctcacctgtaaaatgggccagtataactacatttgtgtttcctattctaaaaatctttgaggtcagtagccaatttcaatgttcttaaaagccttggggaaattggaaaatcatcactcagaaacgtacccataacaacaaaaatgccttatttatttaggagtcatgggatttatcacacaatcagattacatttgctattccatgctggtaagaaactctggcaatcatataca

SEQ ID NO: 395577 - DNA, 167 bp, Homo sapiens
tcaaactttgacatcaaatatgttgcatatctttattctgtcacctactggtgagcctagattccacatctggaaaatgggaacatatagtggacactattggttatctacccaacgttattacctacttcttccttgttggcagaccaaggggggcatagctgtca

SEQ ID NO: 395578 - DNA, 844 bp, Homo sapiens
ggctgggggcgccacctgggccacattcctcaggccctgccttcatctcattccccagacggaactccttcttaccaactccttcttctacccattcattcattcaacaaacatttatcgagtgcctctgtttgcctgagctcagtttatacactaacatttgatgttagcgtataaattagtgttctgtgtcaaagaagtgcagaacgtactcttggcagaaaggatttaatacaggaaattaagtgcttttaaaaatgtgggaaaggccaggcacagtggctcatgcttgtaatcctggcattttgggaggccgaggcgggaggatcacttgaggccaggagttcaagaagcatagcagacgccatctcaactaaaaatcaaaaaaattagccaggcatcatgttatgtacctgtggtcccagctactcgaaagaccgaggtgggagaatcacttgagcccaggaggttgaggctacagggagctgtgttcccgccactgcactccattctgggtgacagagcaaaaccctgtctcaataaatcaataaataaaatattaatagtaatttaaaaaatcaggccaggcacagtggcttacgcttgtaatcccagcactttgggaggcagaggtgggcggatcacttgaggtcaggaatttgagacctgcctggccaatatggtgaaaccccgtctctactaaaaatataaaaatcagctgggcgtggtggcgggcacctataatcccaactacttgggaggctgaggcaggagaatcgcttgaacccaggaggcggaagctacagtgagctaagattgcgctactgcactccaggataggtga

SEQ ID NO: 395579 - DNA, 360 bp, Homo sapiens
ccggctaattttttgtatttttagtagagatggggtttcgccatgttggccaggatggtctcaaactcttggcctcaagcgatccacccacctctgcctctccaaattacaggcttgagccactgcgccctaccccattttcttgttgtatagaacctcattatgtcactggaacagttccctagtgatggctctttagattacattgagtcttttgctattaccaactttcttctgcatacctgtgtttacatacacgtgtttatatgtggtataaattagtaaaaatagaattgctggatcaaagtctttcccatagattttaagcaaaccccaattcttatgttaaatttgaataac

SEQ ID NO: 395580 - DNA, 811 bp, Homo sapiens
cagacctgtcagctctctgtaaaatggaccaatcagcaggatgtgggtggggccagataagggaataaaagcaggttgccccagctagcagtggcaacttgggttgtctttcatgctgtggttgctttgttctttttctctttgcaataagtcttactgctgctcgctgtttgggtccacactgcctttatgagctgtaacactcactgcaaaaggtctgtagctacactcctgagccggaaagaccacgaacccaccagaaggaggaaactacgaacacatccgaacatcagaaggaacaaactgtggacacgctgcctttaagaactgtaacattcaccacgagggtctgtggcttcattcttgaagtcagtgagaccaagaccccaccaattctggatacactgctacatcgggtcctcatccaatctgcctggtgtccctacaagaagaagaaatatggacactaagaaatacgaagggtgcatgcagagaagagagcatgtgagggcacgcaggaggcggccgcggctctgtaagacaaagcaagggggctcagtagaaaccagctctgggccgggtgcggtggctcacgcatgtaatcccaggcgtgatcatttgaggtcaggatttagagaccatcccggaaatacggcaaaaccccatctctactaaaaatagaaaaattagccgggcgtggtggtgggcgcctgtaatcccagctactcgagaagctgagggacgagaattgcttgaacctggggctactctggaagctgaggcacgagaattgcttgaatctgggaggtgg

SEQ ID NO: 395581 - DNA, 478 bp, Homo sapiens
ctgcagccagagcggcgaggtgtcccgccaagaaacggccaaatccagtttcctccccagccagcctctccttagaagcggcagaaccgcttcaaccactagagggcaccagccaaccctcgatggatccaaatgtgcccacgtcgtgagggagcctcagcaccgggtcgcggctcccagctccaccgtcatagaacacgaatagcttttgtcttttctcaaaatgagccctgcagttgaggcaagctttacattggctgcacagactttactctttttaaacattttttgggagtccatagcagatgtatatatttatggggtatgagatgttttgatataagcatacaactcataataatcacgtcagggtaaatggggtatccaccccctcaagcatctactctttcttcgtgtgacaaacaatctaattatactctttcagttatttttaagtgtacaataaattatcgttgac

SEQ ID NO: 395582 - DNA, 380 bp, Homo sapiens
tctattgaaaggtttacacttatgctaaactaattaagtaacatgagcttgccactcagaactgacctcatccaaacataactgtgttcccagattccatcaccagaccatgaaagccatatgtactccaaaagagtgcttatgtgctctgcttggactatgatagatgctggaaatggaggatcctgagggaaaaagaacaacaggagaactcacagattccgggagtgtagtttcagcagcagacagtctcccaggttttgatcccctggagagtgaaggagcaagctttccaagggaagtggggaggaacagccatccaaaggagctctctgtcaggcctcatatttctcatgttcctgtattcggaagtatgtagt

SEQ ID NO: 395583 - DNA, 277 bp, Homo sapiens
ccctctcccacaataatgcctgtcaaagttccttgtgcataacaaacacccactgagttggacttcctgacactgtacacctagtgctgctctgtgttccaatctgttgctcatcacaccaagctaggttgcctccagtacatatgtctacttctcaaaaaggcaagaggaaagccagaaactcttccaaatgaaatacagacagaattttcaatttctacaatgttcagtatatttaatgctttaaatgtaaactcctctgtgtaacttagtaatt

SEQ ID NO: 395584 - DNA, 366 bp, Homo sapiens
caaatatctatcattatattaatcaatctaaattttttgttacatttcagagtaagttgcagacatacccagatccttaagcattcatatcattagctaagctttaatattttgtttgcagtttttttctctttcgaggtaaaatttatatacagtgtaatgcacaaatcttagatgtgctgtttatgtgttccagcaaatacacattactatacaaccaaaacccatattaaaatataaaatattaccaccactgcagaaagtttccacattcctcttctcagtaaatcctctgcttactaccccagaggtcctattcgtttgttttttattccccactataaattagttttgtctgtcctagag

SEQ ID NO: 395585 - DNA, 412 bp, Homo sapiens
tttgtctttttgataatagccattctaacaggcatgaggtaataatagcccagtgtgattttgatttgtctttcactaatgattagagatattgagcatattttcatctatctgttggtcattcatgtcttcttttaagaaatattcattgagctcctttgcccattttttaatcaagttatttgttttgttactatttagttgtttgagttccttatatactttggatattatccccttatcagataggtggtttgcaaatattttctcccattctgtggattgtgtcttcactgttgtttcctttgttatgcagaagctttttatttggatgtatatgtctgtttttgcttttgttacctgtgcttttgggcttctgagaaatcatggctcagatcagtgttggggagct

SEQ ID NO: 395586 - DNA, 537 bp, Homo sapiens
gcatgtgatcatggaccactggaggaaaataaggttctaagagttacaagagagaaagaaagtggtcacatacaaatggctgctagaccacagaccaatgccttcaaaatttcaagtaaaaatgttatcgaaatacacactattaaaactatcaatgatgggagaagagaataaagatattttcagacatttcagatctcaaaacttttacctcctacacacgtttacagggaacctacgcaaggatgcatgccaccaaaaagagggaataagtcaaaataggaatacacaggacacagaaaataggaaatttaacataagaggcaaagagaatcaccagggtggtggtatgcgaaagtcaatggaactacagagatctcgcacatggctgagaccatgaaggtattatgttcctaacacaaatggcttaaacacaagctgcatgactcttagattatctgagcaagaatgctgtttcctaaactgaaatacagaaattaaaaatctgcctgaattcaactgattctatatagtctt

SEQ ID NO: 395587 - DNA, 230 bp, Homo sapiens
cagggacacaaacaggggaatattaggtctctctagaagatcagaaaggtttcatcaatgaacttgagatagccttaaaagatgagtgtttacctgacaaggaagagatgcaagcatccaggtgagcaatgaaaccccagagcgcattaaaggaactgcaagttcaggacctttcagggctggggagggaaggaaggccacaatgacactagaccagggaggaaggagag

SEQ ID NO: 395588 - DNA, 439 bp, Homo sapiens
gagctcggtaccgatttcgctcctagacggacataaaatcagtaaaactaaataaaatcagggtccttatttagatgagtaacttgctttgtcacatcaagattaaatgtactgttttagtgggatttacctaaaaagaggtaaaaaaagaattggctactactgaaaccgggaaaattgtttgcaaaatgcattaatgttcagtatggaaaataccaaaagctattcttttttgcaggatttcagtactttaactaaatgtttttctataaatactgtctttacctctctctctcttcttttgcaccctggagattttttttttcttcctgtcagtttgtatctcttatcatttactgtctgtggcttcacaatactgtattgttacagtaccatttaaaaaattacagctggaagctctgaaatgcatcctgacaaa

SEQ ID NO: 395589 - DNA, 193 bp, Homo sapiens
ctttgatatgcttcttgatatttaaaatagtttaaatcttctcgtcttgataaagtatttttagccattttgttaaagtttgaagtataaactactgtggttctttaaagaatggagtatgacatatttaatggttgactaatgtacttttatgtaaaactgcttttcaattatactttttttttgagacaaa

SEQ ID NO: 395590 - DNA, 430 bp, Homo sapiens
tcggatagaagtgtggataatctgaggacccgctacatgtcactggtatctgaagtggagagcagtcttgcgtgactgagctcttaacctctggagtccgcactaactccaagtagtgtcataattgaattgtaggacacccatgtggtaaccagagaattggagaattggctggtgtgggaaaaaaactccacacttctggtgtcaaaagtgttgtgtgagagtgtagtagaaaacaggagcaagttttgttcctttctagtgtaataaccatttacaatgtgaagtgaaaggggaacacatttttatttgagggtaatgatgtgtgcttacacatacacagaaaaaaatgactaaatatgtcaaaatgttaacaattttgggtcatgtggttggttaaaaggaagatgtttggccaggcatggtggct

SEQ ID NO: 395591 - DNA, 516 bp, Homo sapiens
ttttctactgtctttctgatttaataccatgtccctcttccaatcatctgttagtctttacaaatgggctcagtaaagagcataaggatccccaaaaccctgaaaaatactgagtttctgacctagttggtcagaactgttggaacagtaatgagagcagtaaactggtacctccattaactgctgacttgttgctgtgtcctcacatggtagaaggggcaagagtcttccttgggcctcttttatgaggatactaatcccgttcatgaggactcctttttcatgacctcatcatctcccaaaggtcccactttttaataccatcaccttaggggttaggtttcaacacatacatttttggaggacacaagcattcagaccataacattagactgtcagtttgttaaaattagagataatgtatttttcagccccttattcctagcatcctggcatagtgaaagcacttaatatttgtttgtttactggaaatcaagctgttagatatggcgagaa

SEQ ID NO: 395592 - DNA, 234 bp, Homo sapiens
catcacttaacattagtagcagaacgggactaagctttcatcactgacagactctgtgtttaacgattgaggaacttacctgccaaagaagtcaccagggactggggagagggatggggagtgagtgttccatggcgacagagtttcagtttgggaagatgagaaagttctagagatgaccgtggtggtggctacacaaccacgggaatgtgattaacaccactgaactgtacg

SEQ ID NO: 395593 - DNA, 368 bp, Homo sapiens
taggtctttgctggcacaaacatgttttgtctttgtatcccctatacttccttgaagagaaaatacttaggaattatttgataaatggaaaagcacatgaaagaaggatgtctacccccaaaaatatatatatatatataaaatatatattagtaataacaaacacaaagaaaaaaacccaggttaaaaattaagtttttaaaaatcacaccaagagcatattacttttgtgttattcctgccaaaagttcataaactaaaactaaacatgaaaaaagcatcaactaaaaacaaaccaagaaacaagctataaaataattggtctccagccttcaaatatctcaaaattgggaaaagcaaagactgag

SEQ ID NO: 395594 - DNA, 349 bp, Homo sapiens
cctctcagcagggctttatattttcgaagggtgggcacttaaattacacagattgggtttttctgttcctctttgaacactgggctgtgtgaggaggaggaggaagaagactgaatcttacagagctgagatgatcagatactgccggatgtgccatggggcctggagagctgacgttgctaatatatcaccccattggtgcctacagtttccattctctgattagagatcatatttctttgacttgatgctcaaatgcctctgagtttgatcctttctcatatcctgaattctatttccagttccccagagttttatcctaattttatccattattgaagttttccca

SEQ ID NO: 395595 - DNA, 349 bp, Homo sapiens
agtgctgggattacaggtgtgagccaccgtgcccgactgactgtggattcttaaaatacagtttctatgtgtgtctcagagtgtttggatggtaaatgcaggggagtggctgtttccatggctatttcttcttcagtgaatttttgttgctgagtcttcagtgacctggctctgggtattagcttcacttgaagtaggtaggtgatggaagagtcattagccagttttaaagacaagtttagttttctctgctgttatatagataaattggcaagtggttgtgattgagcctttccaccttaggggtggtcagaaatccattaacttagtattgcccttcttagaaata

SEQ ID NO: 395596 - DNA, 250 bp, Homo sapiens
ttccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttt

SEQ ID NO: 395597 - DNA, 748 bp, Homo sapiens
tgtttttacatgagggtaaatgtaatactattctacgatttcaatttacatggatcattagaaaaataacaattaaaagtcgaaggtgaatcaatagaacaagcacatgactgtgctgagtctggaaaaaatattcccctcatcctacgtgttgctggaatgagactaggaatccaatcaaaatatttggcaaccattaaaaatagtgaagcacattttaaaagaaggcagaaaagatttgtccgttgtttccaacacagtgatttcaaaaagccacacccttcaagagactgaaagacttctttctgatctccataattactcaagcagtagacactttgccaagatgtttcatgtcgccgaaatgttttttttccccaagagttttgttatgttggatgaaccaggactgaagaaattttgagagcttattttagattagcaacattgaccttatccagatactaatagtcaccatttaacccatttaaaattctaaataaggtcttagattcaagcattagttggttaatttactgttaatcttcctgtcaagtccattatgggagtgaaggtgtttcaaaggggaacagtgatttcattccaaatatatgagggcatatcatatttagggatctccacaaagcactgtttcccatggcaaataattggaaatgagcaaatggcaaacaacatgcatctagctaactgcctttacagtgcatccgtacaatggtatggcatgcag

SEQ ID NO: 395598 - DNA, 440 bp, Homo sapiens
ccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactt

SEQ ID NO: 395599 - DNA, 380 bp, Homo sapiens
cacctgctttcaggaaaaggggtcagagggcccttcttacacctgctgttcttcaagtgccttcagctcaaaataattcttatatcaaatctgcatattttggggaggtctattctgctatcttgttgggagctgaaagcctgagggtcgtgaccaactcagcattccactggaggctatatgactaaacagcaaactgtttatcatgaatgcaggatgtgggcaaactcgcatctgtgcctgccaccagaaggtacgctgagggcctcattccctggctctgtgctccttgaggttatctactgggacatctggagcctactgttcaaagaatgcagtcatgcaggcctgcactaagtcaagcagctgaccacaaccac

SEQ ID NO: 395600 - DNA, 236 bp, Homo sapiens
ggagcctcctacggctcgactctgccttataagcgcgagcccaagcttcttaccacattgtgactcagttctaccaccaccagagacctgaactctgcctttttctcttgtgatgccccctccaggctctcaaactaacccttttcgggttcttccccaaacggcttcccaggaacacgcggttccacacatctcatcatctgaacggcacacaatgtgggagctgtgatcagtcc

SEQ ID NO: 395601 - DNA, 414 bp, Homo sapiens
tggtcattgggagggtaggaggtaaattgccaggcagtactcacactctttccacctcagctcccaatgggagaagctatacagagagagttcatagagtcactactcaatgctctctgaagcatgctgcccaactatggagataaatagagatagctgcgacagataaaacacaaaaaggtccacaacagcaggtaaattctttctaactgagacagaaagtgtatgtaccagcttcttctaagggctaggttgtaggcattagtaaaggcagagcttcaggaaaagctctctgcaattggcttatcaggtaagatgttcaaggaagtcacgtccagtctagtatgggactcagcaaaatgatgctccagaacagaggcaggtcaagcaaagaaatgggttcttacaaagttc

SEQ ID NO: 395602 - DNA, 539 bp, Homo sapiens
ataggattaataatatactaaatgtagatttgttaagctatctttgataattcaggaatagaatatatacacactacatataaaattttgtaaaaggcataaaataaaaaagtatgaatttcaaaaattgagagtttaaagtgaaagataaattggtattctgcttggtgcaaatacatttaaaatcaacaggaaagacttaaatgagaaagaagactaagatgtatcagtggagtataagatagggtgcagttatgatacttgacaaaaaatgcttaaaaaataaagttttttaaaaggccgcaattaatagggaacatatcatgaaatataacaatactgaatataaatatgaccccaacaacataaagcctatatacctgtactgatattcagaaggaggataataagttgagccataattgctttgaaagtctttaataatctcactatctgggattattggactgtatggtcacatccttgttttggtacttgtttcttgtggaaaacattcctttagtcttctgttcctgctt

SEQ ID NO: 395603 - DNA, 364 bp, Homo sapiens
caaaattcatggtttcagtcctgcatgttaaatgagtttcaaataaactggagattgtcaataactatgatacagagctagactgggctggggagaaactttttgtggtgggtggttatttttctgggagtgactttaattaacctctcttctttaagcatcctcattcaaaaggccccttggcactcaagaatgaaggtaacaatttttattgctcagcattgttaatttggttgatattggggcaattccaaagaaaccattaaagctatcagagaaaatgaaggggaacacattcgagtaagattttggaacatttttggcttttggagtggcctgcagttttgacaaaaaggaaaaaaaa

SEQ ID NO: 395604 - DNA, 244 bp, Homo sapiens
actattataccatcctgctgctcaaggagcagaagaccagacacacacaaaacagcaggtcctcatggcacatggagtgagatcatggttaagcaggcagaggctggcctgtctatggggtcagagccccacaggtatttcagagcagggcgggaacaggcactgggttacaaagcgagtagttacctacctagtgaccattttctcttcttcgaaagccagaggagccagaggggctggatgg

SEQ ID NO: 395605 - DNA, 158 bp, Homo sapiens
caccccctactcattccccaacagctcttggttcagagggaggctgagtgttgagttcatgatccccctctgccatcggaagatgtcttccatgaagcattgcagatggcatgtccacgaatgggttctgtgcatggggggaatccaatctaagcagg

SEQ ID NO: 395606 - DNA, 302 bp, Homo sapiens
cagcccaacacctctaatttcttttctatgttgctttcattatgaatcatgtgaaatgcaaaacttgatcatatcatccctaactgaaagctcccccttactttcagaagaaagtccaaactcctaaatatggcaaaaggatttttaatgaactggcccaagcttacctcttcatgcacatcctttgccactttgtactcatcatgcacccatatgccagtcctcatccagctgtctgcattttccaaacatactgtgttgtctcacatgtctgtgctttacacgtgttggggataacatca

SEQ ID NO: 395607 - DNA, 380 bp, Homo sapiens
cctgagcagtgggaacccctgtgtgtgcaggtggcctgccaccctgtttgcagctggcatctggagtgggagcagtctgggggactgagcccttaacctgtggtgtttgtgctaactctgggagttagtgtgagaattgaatggaatttttggacaaccagttggtgttggataattggagaattctgaggaaataacacatatttggtgtcagaaaacaccacacatgacatctgtctttgccagtgcttaactcaatatggtgctcagcctctcttcatattcagcagaaaacgttcttacaccaaagcgtaccgaacagattatgctgcaggtttcagagaagaaatgtgaaggcatgctgaatccacaacatcttt

SEQ ID NO: 395608 - DNA, 390 bp, Homo sapiens
agtgtctctgtggagagagacacctttggctgagctctggcagggctgggccccacgcctgctgctgcacccaggccctgagcagcttgggctgcaggaggttttggaaactccgtcgtggatgttggacaccaccaccagctacaccagagaaggactcgcaggctgcaatttctgaggcccatgggcagggacggaggcagagggaggaaaacccaggctcctggagcgaagcggggttttgtcccaggcgtgtgtctgggtcagatttttgtcatgtgtgctggacacacgtccactctcactgtgagcctcaggcctgctggcagcatgtggaacagaaccctcgctcctgtcgctcttcacttccgagcagtttcgaaacggcag

SEQ ID NO: 395609 - DNA, 231 bp, Homo sapiens
ttcctggcactgttgttctcattcttatgtgctagtcacaactccgtcctcctgggagtttgtggagtgtggtgaatccaggatgagcttccttattttgaggtggctttcactgcagtggtctctttatttggacttgctattggttaaaccgtcggagctattctgtgtaagtgtccatagacatgggttttaggggactgatattttagctgtgtttaaattctcata

SEQ ID NO: 395610 - DNA, 186 bp, Homo sapiens
tgagccggtccaggtatcagctggcatgcaagctggttctttttgttattactgttttaaaatcactccttctccagaaccacagcaactaacattgagctagttacactggagcctgcattttctgaatgagctttgtgttttcagtttccaggcctttctttgcccctaccctctgcttggcag

SEQ ID NO: 395611 - DNA, 1349 bp, Homo sapiens
gttccctcctgattataaaaaatgtttattggaaaatatttttgaaaatacaaagaagtctatgaatagaaactaaaataccccgaagggtttttttctaattatgaaaggacaatacatggttattattttaaaaaataagaaaatgtgagccaaaaaagggaaaaactgtccatccacagacaaccagttaatatactgtaaaatatcaaaacaaaatcttttgagttctttttttaaatcaggctattttttcccctttatttttaggatctagctttagcttttttccccactttcctatcctgttgcagttatttttcctacttcacatttatattttgttcatctttttctggttgttgctttttgggggtttctgtttttatgcttttgaggaacagatatgaaatttcaatttctgtgtatgtgaaatttctcttaaccttttccttctatggcttctcctatttctgatgtaagatgaggggcagaattataggcctgtgaggttgaattgatattagaaggacactgcacgtaagtgaggtgggtgggagtcatttgattggaattgtttaggcagcctcctgatgttggcaagaccttaagctgaagggagggaatagggtcctaagaaagaagacttggctgagggaagggccttcacggttgctgtggaatagcatttgggcccgggctgggctttgttgaccttgtcctatctcttggtcagtgtgtcctcttggcatggtaggaaacaggtagatagccacctaagaggttatgtgttcagcctgtagagactatccaggagggctatcttgggaaagtttgtgtactgtttgttaggagatgcagtataagcaaatcttggaggccactaggcaggtgaactttacccacctctaacactttttttgttccttctaaacctctctttaggccaaagaactccaaacaagcagaaagggaagagaagcgagtcctcggtctggtgctgctgcgaggggagaatctggtctcaatgacagtagagggacctcctcccaaagatgtaagtcagagcaggaagccttgtggaggaggggaggccctactgtgagccaggctctgtgttagattctgtttcattgcagttctcacaggcatcctctggattttgccccctttttcagataataaatgaaatcttaaagaggttaccctgcaagaggccgggcgcggtggctcacatctgtaatcccagctctcagggaggcaagaggcgggaggatagcttgagcccaggagttcgagacctgcctgggcaatatagcgagaccccattctccagaaaaaggaagaaa

SEQ ID NO: 395612 - DNA, 717 bp, Homo sapiens
gaagtggaaaaggggaactagaatttgggtatctcagactttaaagctctacctgtttctcagttgatgtacatagtgagtcagtggaggaagcacctgaagccatctgggtcagttcttaatgtgacgacaaagcctaggtagaccttaaaaagttgtaactccgaaacaataggaaatgtgtgtattttgttttgtacagttacagttcatagttactgagaatctaccttgcgccaaccacttcagtattttatttgatcctttaggtctctttagagataaattctcatcttataaatagaataaaccagggcttagtaacttgcccaaggtgccacagccactaagtggtgaaactgacatttgatctcagacagtcttgattctgtaaacaccaagctacacatagaaatagagcaggctttagagacctagtcaaatttgttttccctttccctttttcatttgaagggttttttttttttttttttttagatttttagatggagtctcgctctgtcgccaggctggagtgcagtggcacgatcttggcttattgcaacctctgcctcccgggttcaagtgattctcctgcctcagcctcacacctgtaatcccagcactctgggaggctgagacgggaggactgctttagctcaggagtttgagaccagcctgagcaacatagtgagaccccatctctattaaaaaaaa

SEQ ID NO: 395613 - DNA, 902 bp, Homo sapiens
ggtgaatcggccgagggtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggcttctttgaccttggcacgagtttggagtgtccgaagggtggcgtcctcggccgttccaccgtgtttgcggcgggccgggtgtggtgtcctaagggccccccggatgtcccaggccgattgggccaccgcgcg

SEQ ID NO: 395614 - DNA, 842 bp, Homo sapiens
acttaggctaggtcgaggctgggtggtaggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggccacctcctggtatgagactcctatgggtccccatggggatccccctggaagagggactccatggctgccctcggaatgggctctccctggatggagcttttgacctggccgagttgcgtctcccagcgggctcctcctagcccttccccccgtgctccg

SEQ ID NO: 395615 - DNA, 569 bp, Homo sapiens
ggactccaagcccagtgttctttccctataagataacccatgggcaaacttggtgacccctgtttctctagtctggattattcctctatgggtttttatagacataggaacccagtcagcctcagagtagtccctagttagcacatatgccatgtatacccctctcctcactcgattactgcagggcgtgggaggctggggcagggttggggattcaagttgcagatcaggcactgactaaacttcttactcttacttcaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395616 - DNA, 926 bp, Homo sapiens
aaatatggctaggtacgaggctgggttttaattcggccgaggcttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatggcgaatgccacccatcagacagaaatgaggactcacatcacaacatgaggaatgaaaaaggaacacaatatacagtagagaaataggacagacaaaggccatagaaatcatataggacgtactttaagatcgtggactgtagtcacgtaacggaagaacaatactacaagaatatattgtggcgtatacaaaatgatttagaataaaacttaagagacaataacaaaaaaataaaaacatagagagcaaaaattaagttacgaaaagaggtactaagcgtcaatgaaataagggatgtagagcaataatgaaaagaaaaaacgaaacctaaatg

SEQ ID NO: 395617 - DNA, 1141 bp, Homo sapiens
  misc_feature (3)..(3): n is a, c, g, or t
aantatgctcagtacgagccgggtgtgtaatcggccgaggcgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395618 - DNA, 1110 bp, Homo sapiens
gaaaacttacggctagtacgaggctgggtggtggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395619 - DNA, 1140 bp, Homo sapiens
tgggaaaatttcctcagagggcactaacttctgctcagaaacccacaactgaccgttccggcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395620 - DNA, 1487 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaaaaaaaaaaaccaaaagaaaaccagtggcggcgcacggcacgggcgacatccaggagaaaggttgtagaaacccagtccggtgggagcggcgggggcgcccaaggtaggtgctatgggagacacgtggggccataagcggggtccacagagggagaacccgggcgcatagacacgggggtgtggggattcccaccgaacattaaaaaagccggcggggggggacaaccggagcgtcgtagacaaatcccagaggggaggtccgaggagtcacagcgggatcttaaccaaggggggcacacggcacgcgaaataaattaacgccgcgctgggagg

SEQ ID NO: 395621 - DNA, 1086 bp, Homo sapiens
gactagttctcggacgcgtgggtcgacccacgcgtcggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395622 - DNA, 1076 bp, Homo sapiens
ggtgaatcggccgagggtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395623 - DNA, 1395 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaagaaaaaaaaaaaaaaaaaaaataaaagaaaaaaaaaaaaaaaggggggggggggataaaaattcccccccgagggggcacccaagagttagcggttccccgacgtttttcgtttgtaacaggggggggccccttatagagggggcgcgatataaagaccaagggcgggggcggggtgtttaaacccacgcgcgcgtgtgtggcgggaaacaccgtgtccgtgggggacactctgtgggaggaacccctctcggtggggcggggcatactggtggcccacactcccacggaaatttgagagctcaggggatctataacctgtcagggtgatatggtggtacccagcgcaatgctggggcgggagttgcttcgggctgtttgcacattc

SEQ ID NO: 395624 - DNA, 1053 bp, Homo sapiens
  misc_feature (889)..(889): n is a, c, g, or t
  misc_feature (944)..(944): n is a, c, g, or t
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggcttctttgaccttggcacgagtttggagtagctccgcaaggngtgggtcgattctcaggcccgttcccagactgttgtctatgcgggtcggggccanggatgtgtcctaagccacccggaaggcccaggcaaatttgcgcaacagctgcgaggacaatatctggcaaggtatataaaaaaacgggaaaggacacctagcataaaga

SEQ ID NO: 395625 - DNA, 980 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggcttctttgaccttggcacgagtttggagtgtccgaagggtggcgtcctcggccgttccaccgtgtttgcggcgggccgggtgtggtgtcctaagggccccccggatgtcccaggccgattgggccaccgcgcg

SEQ ID NO: 395626 - DNA, 1009 bp, Homo sapiens
  misc_feature (845)..(845): n is a, c, g, or t
  misc_feature (900)..(900): n is a, c, g, or t
gaaaacttacggctagtacgaggctgggtggtggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggcttctttgaccttggcacgagtttggagtagctccgcaaggngtgggtcgattctcaggcccgttcccagactgttgtctatgcgggtcggggccanggatgtgtcctaagccacccggaaggcccaggcaaatttgcgcaacagctgcgaggacaatatctggcaaggtatataaaaaaacgggaaaggacacctagcataaaga

SEQ ID NO: 395627 - DNA, 1034 bp, Homo sapiens
  misc_feature (828)..(829): n is a, c, g, or t
  misc_feature (852)..(852): n is a, c, g, or t
  misc_feature (856)..(857): n is a, c, g, or t
  misc_feature (859)..(859): n is a, c, g, or t
  misc_feature (880)..(880): n is a, c, g, or t
  misc_feature (899)..(899): n is a, c, g, or t
  misc_feature (901)..(901): n is a, c, g, or t
  misc_feature (904)..(904): n is a, c, g, or t
  misc_feature (921)..(921): n is a, c, g, or t
  misc_feature (924)..(924): n is a, c, g, or t
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccatggggcatggccctcggaatgggctctcccnnggattgatggcccctcccggatnggcnncnaggctaatctttggctctcantcctgctgttccgtagtgnantancttaatcttggcttgantgnttactactctcaaagattttcgaacaacaaaacaacggtttttgggcaaaagaaacgctattcgtcactttagaggaggcctggataaagcaaaaaggaacacacaacaa

SEQ ID NO: 395628 - DNA, 1070 bp, Homo sapiens
  misc_feature (816)..(816): n is a, c, g, or t
  misc_feature (842)..(842): n is a, c, g, or t
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccatggaagaggactccatggnatgccctcggaatgcggctcctcccnggatgcagcttcttgacctggccagagtatggaaggcccgcgaggggacgaacataggccgtaacacagaccgggactaggacagggcgagcaaggacaggtggccagagggaccacaccggaatggcacaggcaaattggagcgagcaggctacaacagaaacaaacgagaaagagaacaaaaaaaagcgcaacaacgagacgagcaggaaaagagcaggacggaga

SEQ ID NO: 395629 - DNA, 1265 bp, Homo sapiens
  misc_feature (3)..(3): n is a, c, g, or t
aantatgctcagtacgagccgggtgtgtaatcggccgaggcgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgtgtgaggggggagagcttgagtttctggcctcattgcctatttgtaaagctgtagcctaaagggctctcccaatgcagcctggtctgaaactgctttaagaagcctctgaccctcttcagggccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395630 - DNA, 1783 bp, Homo sapiens
gttccctcctgattataaaaaatgtttattggaaaatatttttgaaaatacaaagaagtctatgaatagaaactaaaataccccgaagggtttttttctaattatgaaaggacaatacatggttattattttaaaaaataagaaaatgtgagccaaaaaagggaaaaactgtccatccacagacaaccagttaatatactgtaaaatatcaaaacaaaatcttttgagttctttttttaaatcaggctattttttcccctttatttttaggatctagctttagcttttttccccactttcctatcctgttgcagttatttttcctacttcacatttatattttgttcatctttttctggttgttgctttttgggggtttctgtttttatgcttttgaggaacagatatgaaatttcaatttctgtgtatgtgaaatttctcttaaccttttccttctatggcttctcctatttctgatgtaagatgaggggcagaattataggcctgtgaggttgaattgatattagaaggacactgcacgtaagtgaggtgggtgggagtcatttgattggaattgtttaggcagcctcctgatgttggcaagaccttaagctgaagggagggaatagggtcctaagaaagaagacttggctgagggaagggccttcacggttgctgtggaatagcatttgggcccgggctgggctttgttgaccttgtcctatctcttggtcagtgtgtcctcttggcatggtaggaaacaggtagatagccacctaagaggttatgtgttcagcctgtagagactatccaggagggctatcttgggaaagtttgtgtactgtttgttaggagatgcagtataagcaaatcttggaggccactaggcaggtgaactttacccacctctaacactttttttgttccttctaaacctctctttaggccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395631 - DNA, 1017 bp, Homo sapiens
gcccggtcaggccagggcagagcagctggctcgtgcatgcgaatcccggggctataaccatcgacgccatgacgtgggcagcgatgctgcctttgattacggatgaggtgcatcctgcgacggcggatcttctgcctcagctttggcctgaattgtcctctgtgatggtaatcaatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395632 - DNA, 890 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggccacctcctggtatgagactcctatgggtccccatggggatccccctggaagagggactccatggctgccctcggaatgggctctccctggatggagcttttgacctggccgagttgcgtctcccagcgggctcctcctagcccttccccccgtgctccg

SEQ ID NO: 395633 - DNA, 1056 bp, Homo sapiens
atctcatgtccctttaatgccttgcctgctgaaccctgagtggaaccctggccctttgctcttggtttaactttcacaggagtgcatataggtggttgagttgtggcatgtttctctagacttactcttaagttctaccctgcttcagggataactcatagtcttggatggaggaagaatggtgttggcacacatggagaggtagtatttataagctatttcgatagtatttataagctatttcgaggggctctcttggcaatgatattccaaagtatacttctgatcttcagatcactgggcatcagagcatatttgtttatttttcagactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395634 - DNA, 837 bp, Homo sapiens
  misc_feature (3)..(3): n is a, c, g, or t
aantatgctcagtacgagccgggtgtgtaatcggccgaggcgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatcacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395635 - DNA, 1386 bp, Homo sapiens
  misc_feature (3)..(3): n is a, c, g, or t
aantatgctcagtacgagccgggtgtgtaatcggccgaggcgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatatttttagatggagtctcgctctgtcgccaggctggagtgcagtggcacgatcttggcttattgcaacctctgcctcccgggttcaagtgattctcctgcctcagcctcccgagtagcggggattacagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggggattgtgcccatacggaaatgcgggctcctacccctggatgccatgggccccttcccccggaatgggccacaatgcctacactccatttgggcctcttattcctgctgttaccgtaaggtgacatatcttatgatcccgggcggccaatgaaacggggtcaaataagacctctaaagaagcgtgaggcacaacaccagcgaggcgccacgaataccaccaggagggcaccgagagagaggccgacaccgtccggtacaaaaggggcccacaggaagagaaaaagcacggggccaggccgggactaaagaacgagaggcaacacgaaggaacgagcgagacacccccggggaggcaagacacaaccacaagaaccgcgacaatgcggatggaagaactcgacgagcagagaccgacagagcggaacgatgacagacgacacggactagcgcaaccaggcacccaca

SEQ ID NO: 395636 - DNA, 870 bp, Homo sapiens
  misc_feature (3)..(3): n is a, c, g, or t
aantatgctcagtacgagccgggtgtgtaatcggccgaggcgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaaggccatataggaatcgtccaacactagaggcatgaaaggggtacagatgaacgcagatgtccctcggctactggctgcgtgcgtgcagaaggcgtgagaacttctggtcgtcaactgacaggtcagacggtgactctccttcctcagatagatacctggatattgcgtcgaggattccagcattgcgtggtacggctgtccggtgcggccccacgtggcagtcgcgtcggaggtggccttggctggtcgacgagcgtacattcaccatgctggagggcttccccaatgcgcctcagttgactcccctgcatggacgttgacttgggccattgtcctgtgtgggcttgagcggggccagtcctctaacacggctgcatggacacccaacatagcgaacagaggtagctagtatgcaggccagctgctagacgtgcatgaacacgatgctcacgctgtttgcctgtggggctcctaacctcgagtacgccattcttggacctgtgcgagtggtaccgtacccccgagctatggcgccggaggagctcagccaccttccgaggcaatgat

SEQ ID NO: 395637 - DNA, 1154 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395638 - DNA, 895 bp, Homo sapiens
ggcctcaagcctctatgcggatcgctggatccggcgggatattagacccccacacaaccggcaccactaagggctgggaaatactcggtcatatgctgtcacatcttcattcctggatagacgtgtgtcctgccccgatgcgacggatctctcttgtgcccttcgagcgctcattgaccctgcactgtgtatttgagattcctcctgctgcatgggtcgccctgcaagtgtctactagagagagtccaaggccacacaggaactccacgaccaagctgaaatggcgcaacgatcacatggagttctctggatctggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccatgggcatgccccctcgggatgcggctctcccctgggatgcgaggctctcttgaccttggccgggttgaattctcgagagggtgggtcatctttcggccgttccccgaccggtggtatcgtgccgtcggtctgaatgttgtttctag

SEQ ID NO: 395639 - DNA, 1118 bp, Homo sapiens
  misc_feature (3)..(3): n is a, c, g, or t
aantatgctcagtacgagccgggtgtgtaatcggccgaggggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395640 - DNA, 1106 bp, Homo sapiens
acttaggctaggtcgaggctgggtggtaggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395641 - DNA, 1190 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaataattgcaaaaaaaaaaaagaattcggggacaaaag

SEQ ID NO: 395642 - DNA, 1489 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatggctctgatacctcgccgtccatgtagcggtggggcaaggagctacgcatatgatgcgtgcacgccatattcgattacatgggcagtgacgagttgcaagtccttgtcaggagatcgagtcctgtgagtcctctccactttgaggcatcccttttcgaaccgggcttttccggaacaagggcgcctgttgacatttttgactctctcttgttgacgcttgttgagtgacgttatcagagagaaccctggagtctaaataggtccgaattcaaggaaaactttcctcgaaaagccaagaaggtccagtatacaggggcgcgacaacgccaagtaaaacgggccgaaagtttccctttcggcggttcctgggttttgtccttggccttgtccgcaacgagtcgggtcacgcaacacttccttgggggtccctccgacaagttggccaactcagtcttaggcaaggtgtgtgaaacccgttccctttccccccgtatatagtcactttaccctgggggttaatccggccttctggaaggggtttcc

SEQ ID NO: 395643 - DNA, 1008 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395644 - DNA, 994 bp, Homo sapiens
tgggaaaatttcctcagagggcactaacttctgctcagaaacccacaactgaccgttccggcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395645 - DNA, 928 bp, Homo sapiens
ctccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatc

SEQ ID NO: 395646 - DNA, 962 bp, Homo sapiens
ttttatttaggggaggacataaaccccggttttttttccaaccaaggggggaaccccataatttttttggaacaaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395647 - DNA, 1118 bp, Homo sapiens
ggctggaacatacggctaggcccccgaggacgctaattcggtgagtatggtaatcattgtaacctacgacatgcatggtgcgtgaatagctgcttggatgtctgcaccattatagatacaccgcgattgagggatgccagtacgtgtacggaaagcgacagtcactactacggttgtgcatcgatgtcgtcagtgtatcttggactcatagtcaaactagagatgttgcaatacctcatgctgcagatgattgatgatgtatcaccacacaggaatctgagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395648 - DNA, 966 bp, Homo sapiens
tgcatttacacaaaaactggttatttagctaccattagcaaacgcatacatacacggagactaaacagatctggtttccacagttttgaatcaagcagtgccaagtttcattcaaaatgtctctactacaaacagcaaagaggagacctgagcaagccaggcctggcttgctcaggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395649 - DNA, 1355 bp, Homo sapiens
gaagtggaaaaggggaactagaatttgggtatctcagactttaaagctctacctgtttctcagttgatgtacatagtgagtcagtggaggaagcacctgaagccatctgggtcagttcttaatgtgacgacaaagcctaggtagaccttaaaaagttgtaactccgaaacaataggaaatgtgtgtattttgttttgtacagttacagttcatagttactgagaatctaccttgcgccaaccacttcagtattttatttgatcctttaggtctctttagagataaattctcatcttataaatagaataaaccagggcttagtaacttgcccaaggtgccacagccactaagtggtgaaactgacatttgatctcagacagtcttgattctgtaaacaccaagctacacatagaaatagagcaggctttagagacctagtcaaatttgttttccctttccctttttcatttgaagggttttttttttttttttttttagatttttagatggagtctcgctctgtcgccaggctggagtgcagtggcacgatcttggcttattgcaacctctgcctcccgggttcaagtgattctcctgcctcagcctcccgagtagcggggattacagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattaaaaaaaaaaa

SEQ ID NO: 395650 - DNA, 417 bp, Homo sapiens
  misc_feature (3)..(3): n is a, c, g, or t
  misc_feature (376)..(376): n is a, c, g, or t
aantatgctcagtacgagccgggtgtgtaatcggccgaggcgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcgtctggtgctgctgcgtaccctgacancctgaaagctttgcagtccacctgctgcaaagtgtggactg

SEQ ID NO: 395651 - DNA, 438 bp, Homo sapiens
ttaataacctcttgcagttagacagaaatccggcaggaccacctgtgccctaattaacagttttactacaagacataagatagtagggtaatcaattccttctgtcaagctccagatgtgccagctatcattttaaatacttttttatttgatgtatattagcttatttttcttctcctttaaaaagtattcaatagttttaaaaataagaagcatacatagaaaacaccattctgcagctggaactctacttaattaaggccatgcttaatggttctgcgtttgatcacctcctaaaatcacaataagaagtttacctttctctgacagtcactgactcattaatgcattctatttatgaaacatatgctatgattttaaaacagcaggggccatacttgtccttgctcactattgtatcctgtgtcttacactgca

SEQ ID NO: 395652 - DNA, 108 bp, Homo sapiens
acccccacccccaacacacacatatacattacgtccatgtgtgacagtgtcaaggtcaatggaacaagctattctgccagaggggtttcctttgtgatctgcttccct

SEQ ID NO: 395653 - DNA, 445 bp, Homo sapiens
cccaaccttcacctacccgcgcctaacccgcaaccctcacattcgttcttgattccttgggcaatggcagcagcaacattggcttctttttcatctgcctgcaccagaagtttctttccatcagcttctctcgtctccgcttcaattttcaccatcatcttggcagtttcctcggaggtgaggatgagttgaggttgaagagctgtcagttctctttgcataaccgctacctgagaagctgcaaagtcgagtttctgcaagcctgtcaggtagcggttcctcatcatagccacctcttgcctcttgctattcaggagcgtcttgaaggttagaatcaattcaaggtaggaggtgggggtaacatagttgtgtcttcgaagtttgttgtaataatcgagtgacagcttcttgacgctctcttggaaatatttgcacatggacacga

SEQ ID NO: 395654 - DNA, 541 bp, Homo sapiens
gcaggaatccctcactaggtaacttagagcggcggatcagggcacagacttgggagacagactgtctagcttcagatttaggcttcttactagtctgaagtagaatggttgtttgttcctccactgcttcatctggaaaacaggggcaggcatcccagggtgtttgagagatcatatcagatggagaggccagagtttttagccgatacatcatagacattccccaaaggacagttattgttatcattgggtggatggggaatattgagcctccagccctaggcattgtggatcaatttgttcttcagttatctttggaataatttaaatacactggattgggaagacaaagctatcaccctcctgatgggagagtgctgggtacctagcaggtgctcagtagttagtgaatgaatgagtaagaacagaacaggtcctaggccctgccctgaagaggctcacagtgcaggacaaggcctggagtcaggccagggttttgtggttgtctttaaaaagaaacaaaacaaagaactacttccta

SEQ ID NO: 395655 - DNA, 408 bp, Homo sapiens
ctacagctgtgacagtttagcatttatatggaacttgttctgctacttgagataatgggactaggaatctaggagggctagaagcaagaagccagcaagtctagacacattccagaggacattatgcaagccctgcctcagtttccctcccaaccctcagcttttttcccaacacaagcaaaatcctgtccctaaaaaaaaagaaaaataatattcatgcaggagaaagaaaatatcatttggcataaactttgaatttttctaccactgccagaaaaaaatatagagatgaaacaatcatcttcccaccttctcttgaactaatagatttgttgtgctctggcagtaaagcacagagactagggacaaattccaatgatgccactggtgacaatttctcccaaaatc

SEQ ID NO: 395656 - DNA, 371 bp, Homo sapiens
aagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacc

SEQ ID NO: 395657 - DNA, 335 bp, Homo sapiens
gtgtgtgaaggtgtgtgtgtgagggtgggtcagttgtgagtgaaggcatgagtgaggtgtgagtgagcctctatgtgaggttgtgaggttgtatggccatgtgtatgagacgtcacagagacaacgtgcacacctagcactgaacagagactaatacaacacacatgcagcattattctgagtgacttttgatgctgaatgaaatttgagttcaagtccaagtctgagctgagttcacactcctagtggtggtggacgaccttggatgcctatctcagtcctcgccctccacaaggtggggactcccagagcccacctggaaagcttggacaagg

SEQ ID NO: 395658 - DNA, 468 bp, Homo sapiens
gaagggactgctcctaccagggttagctgattcctagagaaagcaaatgatgcggccaggagctagtgtgagctttcccattccagggccttagtcccctgccctgatcaccccagagccaggcaccgagcagctggggacagcgcctgtgccctagagctcactgcaatcactcaagccagccaatcctgagcctgctcactccccctcacccattccttcccatggaaaccacaggaaaggctcttggcccacgtattccctgctgcctctgccaccaggcaaccccggtgcttcctgtgtggcgtggcgtgcccaatctccaccccgccgggatctgtcacagctatcttttcagtagcagttgtctcctgatctattggcttcaccatacctgaaaaataatatgacctatattttaaaacacaagcagagggagttgctggtgtggctccaacaggagcgagt

SEQ ID NO: 395659 - DNA, 427 bp, Homo sapiens
tgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccgccggagacgccgtgcggaccccaagccagtgcgcggaagacaccgtcctaccctcggcatggctgcctcccacccggtcacgtcggtccccgcgccccacgccgacgcgcaggcgacccggggacgcggagacgcagacagctcgggactcaggttcgtgggagcagcggccg

SEQ ID NO: 395660 - DNA, 445 bp, Homo sapiens
taggtatgttaggttattgttttccatttctatgtctgaaatgattgtttttcattttaaaaaatgatggtacagctcacagatctaaagcaaagtgaagttttaaatgaatgcattaagtacaatcagtaactacagaatgtgatctaaaaatacatgttcctcatgttgcagggtgagaatggaaatgaggagtaaattgtaatcgtgccagggaagccaggtgtctcagcagatttggaatctttgcatggcaggtggatccaatttatgtaatgcttgggttaagacagctcaggaaggcagccttgcaatgaaacgtgaacctgtgtgcgtttttagcagtcaccacatggtggcagcctatccaagaaaattcaagggcaatagtttgcacttgagagcccagaaattttgatttggaagctcagtggaagaggaaaat

SEQ ID NO: 395661 - DNA, 335 bp, Homo sapiens
cccgccgacccacgtctgcaggggatgtgtcaacaactacatatgctggctcccatcccactggccactgctgctggatcccacacgaggctgcttctatccaggcaggcctagaaggacaatctacggaaatgaactgcaaagtcaccagcccatctttcttgtgcaacctaatctgcaaaacacaggggctcagaacctgtcccttgcttcagatttcaaggacccccccaatgatacagtttctggcttttcaagaagcttcatggatgaggctggttcactgaagggcaatcagggctcagcatccagccttctgaagaagctgtttactt

SEQ ID NO: 395662 - DNA, 381 bp, Homo sapiens
cctcgttgtgtgttcatgcttaggtggagtgagtgagccagcatgaattccttgtctgatgcaatgccttcacacaatctccaagtcaccaaccatgctagtttcagcattcctgttggtaaaggagttctactgaggtttagttcacagcagtccatggtagagatgtgaactgctaaagttctgtcacttatgctgtccctgtaatatggagcccttctaggctcccacccagtcttgaccaagcgggccacttgcttccttttccttctgtgcctcaaatgttccctgtgtgttctccattgtactctagtgttctttcctagacgttctatttatagtatgattatctattcataattgtggttcttctttctggag

SEQ ID NO: 395663 - DNA, 327 bp, Homo sapiens
ggtacctgagcactttttccaggggccagggtccattcaactgaccactatcaccaaagctgacacccacccacatgtgggcacctgcagcaggcctggagactgatttagtcagcctgtcacaacctctgccaacaccaaagtgaaatgcttgggttccagggggttgtcttgccactgctactgacatcaactatgccacgcctaccgcccagggcccagtaacctgcccactcattcaccccactactgccattcctggcacccaagcaagctgcctggaagcccaagaatcgacctgcacagacccactaactctggtggcag

SEQ ID NO: 395664 - DNA, 296 bp, Homo sapiens
gctgccctacccctacttcccagggccaggagggagtcccctctgctagttgccccaggaaggcgactcagaagttcccctcctgtggaagggaaggccaggtggattggatactgcttgagggttggggagagcctcaggagaggaaatgctgagttctagaacctcctagccagacagaacctcggaggtcttcccttttctagaggcaggactgccgtctcgctgccatcactcctgctgagtgccctccagtccctgcctggccatttccaggagcagggccctctcttgtc

SEQ ID NO: 395665 - DNA, 648 bp, Homo sapiens
tcccaacacatacaagacagaacagaaagtgcccgctccatcgacatctcctctaataatctgacttccaagtgttaactgtacaccatgattactgaggtaagacatgtccctccagtcccgtggcagcaactgattttgcctatgcaaagccgtgctattcttctgctggtggttagcctttgctttagaggacttccctcctattccatgtgcttggaagtgatgagcagagggaagactttcaacgtaaatcctggtggtccatctggaccactgccaccaaccaaggtggtcacatggccagacagaactaatctgtgtcctaccccagaactgatgtagaaatgtccaaagtttaaagccttggctgggcgcagtggctcgcatgtgtagtcctagcactttgggtggccaaagtgggtagagcacttgagcccaggagttcaagactaaaacctgggcaacagcgagaccctgtctctacaaaaagtttaaaaattagctgagggtggtggtgtgcacctgtagtcgtagctactcaggaggctgaaatgggaagatcacttgagcccagaaatttgaggctgcagtgaactaaaaaggtgctatggtactctagcctctagtctgggtgacaaagcaaga

SEQ ID NO: 395666 - DNA, 678 bp, Homo sapiens
gcagtcggagggagaacaccaggcgcggcgcgggcggctccggctccggccccggcccaggcccgggagaggcgatggcgagccgcgatagcaaccacgctggcgagagctttctcggctccgacggggacgaggaggcgacccgggagctggagaccgaggaggagtcggagggcgaggaggacgagacggcggcggagtcggaggaggagccggactccaggttatcagaccaggatgaagagggaaagatcaagcaggagtatatcatatctgacccctccttttccatggtgacaagtccaaagggaagatacgtgggataacctgggaaacaattcaagtagatcttctactccttgggcttcacgaagaaagtcagactactggtgtgtgtagtcgggaagggtccacctgttgaattctcctccatggcaaagtgtttccatttattgtgggcatgacagtgccaaacaggttcgggaacaacggactcatcacgtcacaagcatggttcacccatcaatcacgccgggaaacggcaacgcggacacacgaacccttcttttgactcccaagactgtgccaaaaaaacaaaaaaagggccagtcctttcagcttcagcaagacaaggtactaacacggaagaaagagcagtcatactactggcactttatg

SEQ ID NO: 395667 - DNA, 396 bp, Homo sapiens
aggaaactggaagcagatcacacaatgtaacaggtgcatgaaaagatcaccatgatagtgaaagtgaccagactgagtgctttctgtgtgcccttgagtgttgagcacatgacctgtatctgctcattcaccctcatggtattcatggtggagacactaggatgctcccattttccagaaaaggaaattgaagttcaggaggggttaggtaacttgtccatggtcacatggccatttctccctggctgtaagagctgcactgttaaccttcctgctttaacgcctttctgtggcaaatgtcagatggacagtagtggcattaggggccttgagaactggagggagaaaggaggccccagctggcccttagaggagagaagccctggtctccttcca

SEQ ID NO: 395668 - DNA, 340 bp, Homo sapiens
ggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagtgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaag

SEQ ID NO: 395669 - DNA, 231 bp, Homo sapiens
taagctgagacctgaaggcagaagttaactggccagcctcatgggtggggctgagggatgagcaagcttaggcattaggggcatcaaagatgttacagatgaaggatcagaggccagagctgagtggcctgtcacatctcatggtcagtatgtagcacagccaggcgtttgcactcaaagcctttttcccacttctagtaacaccggaaggacaaggtatcttttaggtgt

SEQ ID NO: 395670 - DNA, 299 bp, Homo sapiens
attgtattaagctggtaaaatcttggtataagacaaagaaagtacaagataggaacattactgataatcttacttttgaacataagtgaaaatatcctaaacaaaatatccacaaatggaatccagcaatgtataaaagctatcatgcctcacaaccaagttgaagctggattcctacctcctgctatataagaaaattaattccacatgagtttgtcagtcatagcttcatcactatgagccttatggtgttgtgccatagtaagtatacaatagcacctatgaagtgttcttgcctt

SEQ ID NO: 395671 - DNA, 320 bp, Homo sapiens
tgatttgactggtaaattgcgtcttcactgggagaaactaaagtatccaatggagaccctacatcttaagtgcaatgacataagaggcatatgtctcaggaagcttagaagctatgcctgtgggtaacaggtcataaaacttttaaaaccaggtgtcttgtgcacttgcgtgatgtggatctcacatctcagacctaagttgtattgctgcgtgaactgctacaaggatccctgtggaatgcctggcactgccctacttgctgcatcctatcctgtatttttctaagtgaatatgccaaatgtggactaacggttttcta

SEQ ID NO: 395672 - DNA, 603 bp, Homo sapiens
catagcaagctgctgagtagctggactacaggtgcgcaccacatgcctggcttttgtgtaattggcactcaggacagagagagaagataattatattcactagtcacattcactggtccctcttttaatttattccttgcaaataatttatcccatataatatcccatccccttccccccattttgtgcatgtcctaagatagtgttttgcattacttttaatttatttaaatgttactctgctgtcgccttctcataatgctttcaaagttatctatattgtaacatgcatcaggatttcattcttgtacgtggctagataatacttcattttatgtgtataccgcgtgttgtttattcattcgtctgttgatagatacttgggtttctaactggctattgtgaataatactgctacaaacattggtctgtttgagcctctgttttaattctttggggtctatgtctagtcatggaattgctggatcatgtggtaattctatgtggagactctgaactgttttctatggtggctgcagcatgttacattctcaccaacgatccacaaggattacaatttcaccacacccttaccatgaaagt

SEQ ID NO: 395673 - DNA, 542 bp, Homo sapiens
tataaaaaagtggaggagcttttcagagcattctagaataagagataagactagagtctgggaacggagtagaaagatgctcaaggaaggactcctcttccttgtttccacagctgggccacaagcccaggtctcttttgcctttgactgtacaacctgctgcctgggagttcctgggagggacaggtttcagagtgtgtccttgatggacacatagtagagccctgggatccaggaagtaacaagagggcacttcccagtccctgaaagcaaacaccttaattttgctaggtaattttggggaggcaccaaacctgaaggttcaggatctgaagtacttgcttcatctccataaaacgttgctcttgggctttttcctgttttattacttagcattaatacctggcagcttatatctgagctctcattttattttcgtaacatataatattgcctctcctctggcagccttggtgcttgcgaagggtttagtggcctcttgtttttttacattgggaggtaagaaaaaaagaatgcggccg

SEQ ID NO: 395674 - DNA, 878 bp, Homo sapiens
aagtgctgggattataggtgtgagccaccatgcctggctctttcttttttttgagatggagtctcactctgtttcccaggctggggtgcagtggcatgatctcagcagctccaacctctgcctcccaggttcaagcgatgcctgtgcctcaggctcccaagtagctgaaattacaggtgtgtgccaccacacccggcttatttttttatttttagtggaagtgggggctttaccatgttggccagaatggtctgaaactcctgacctcaagagatccgcccgcctcagcctcccaaagtgctgggattacaggtgtgagccgctgcgcctaaggagggttgtgaaccttctggcaaaactgacccatatcaaacgagtcagagggactcctgccagaaccagtttccaaccagcttttcaaacagatgtcacaaagtaagcagaaagttaggagggcaaatatgattactgtatatgtaccaagctccagccacgagctttgccaacagcagctcatttaaaccacacagaaatccctggcagtttacctatgtaactggaggcaacgaggctcacgtgaagtccagggccagggagtacaagtgagggaaccaagcctcaacacatgcctgggcccaaagcatgtgcttttcttacttaagggttcccataaatcactatgatctccattaaaaccacttctccacctgctcttctcttagccagggcataaggcaacagggaaacttcttcaaagtttctttgtgattgaactggacaggggaatagattggtctctctctgttaaggagccaatggatagaagcctttattatttttaagttttcatttttactagttttttaaatgagatgtgg

SEQ ID NO: 395675 - DNA, 596 bp, Homo sapiens
aaagtgaaagacatttgggggaaacattaaattttttccataagtggaaattcttatcaatggcctaaagatctaagatcaattgctggaagtagtacttcttttaatattatgctaaggtttaggtctgctctgaattccaaagtgatcacattatgctcaaaggaagatgctgaaagtggtttgaaatcagtgactccctgaacagagagagggatgtgagacctgttaagaggacagaaccggtcagagaggaactcttaggtgtgtcaattacataaagggagaaatgatgccaagttaggagaagcaatgtgtgtgatgttagtaaatttagaaagcgctccctgcccctagttcctgtgcagagttaggcaaaaagaggagaagcctcaaaacaggcatgtgaaaggttttcttcctctcctatcaacctcagaaaacacaactagagtttaagtttttgtaactgggtagagtctaagtgagacgccagtggctggttcacttctcagtccaagggactccaccttatgacaatggcatcatcatgaggacacaggtgtatgtggaatgggcagcaaacctatcagaca

SEQ ID NO: 395676 - DNA, 630 bp, Homo sapiens
gttttctcctatctctgcttgtagtggttttacagtttcaggtttatatttaagtctttcatccattgctaattgatgttggtataaagagtgaaataatgatccaattttattcttctgtatgtgaatagtcagtttttctctacattatttattaaagagaattttctttccccattgtgtattctttgtccttttaccaaaaatcaattgaccacagacacatggatttatttataggttctatattccttcacactggtctaggtgtctgtttttatgccagtgctatgctgttttaagtactataactttttaatattgtttgaaatcaagtagtctgatgcctctggctttgttctttttgctcaagattgctttggtttttcagcgtcttttgtggttccactcagattttaggactaatttttctatttctgtgaagaatggcattggattttgatagtgattgcatttaatctgcagattgcttttgttagcattgaaattttgacaatattaatttttcaaatccataaatatgggatgtttttctacttatgtcactttcaatttctttcaacaaggctataaattttcagtatacaaatatttcacatccttcattaa

SEQ ID NO: 395677 - DNA, 619 bp, Homo sapiens
gttttctcctatctctgcttgtagtggttttacagtttcaggtttatatttaagtctttcatccattgctaattgatgttggtataaagagtgaaataatgatccaattttattcttctgtatgtgaatagtcagtttttctctacattatttattaaagagaattttctttccccattgtgtattctttgtccttttaccaaaaatcaattgaccacagacacatggatttatttataggttctatattccttcacactggtctaggtgtctgtttttatgccagtgctatgctgttttaagtactataactttttaatattgtttgaaatcaagtagtctgatgcctctggctttgttctttttgctcaagattgctttggtttttcagcgtcttttgtggttccactcagattttaggactaatttttctatttctgtgaagaatggcattggattttgatagtgattgcatttaatctgcagattgcttttgttagcatttccctgatcattagtgatgatgagcattttttcatgtctgttggccatttttatatcttcttttgagaattgtctatttaagtcctttatccattatttgaagggatcggttttc

SEQ ID NO: 395678 - DNA, 359 bp, Homo sapiens
gactacttttttcttgatcaccctaatccttaacattggtccttgacttcaccaatggtactgggctgctttccttggttttaaattgctggtaagccagtccatttcttttagtcttttcgtttagttttaaaaattatcttgttccattaatttctttaatggtgcttcttggagctatttgggaatttcctgttcataattgtaatcttaagtttatttttcactctagtggcatcactctctcatggcatcttttgtgagcattcattgtcacctttgataaagggggtattttagaataattatactgagttttaaaatatttttctctgctgctgattcactgacagtatgca

SEQ ID NO: 395679 - DNA, 512 bp, Homo sapiens
ctagaggatccccgactgagtaaatctggcttgtcctacaaggcctatcatatatactgttcagccttttgtggaaaaactttgcagggtctctcctctagtctttttatagcattcttttcagatactatttggaaacatattaaaatggaaactaaaattttatgtttatatcatctatttattgtttttccatgaggaattctactaggtatcctaccagtcattggatatacttagtataagttgtttttaaaatatcctttagccaggcgctgtggctcacgtccgtaatcccagcactttggaagaccaaggcgggcggatcacaaggtcaggagatcaagaccatcctggctaacacgctgaaaccccgtctctactaaaaatacaaaaaaattagctggccgtggtggcgggcacctatagtcctagctacttgggaggctgaggcaggagaatggcgtgaacccgggaggcagagcttgcagtgagccaagatttactcatcg

SEQ ID NO: 395680 - DNA, 130 bp, Homo sapiens
caatttctgagcccacaggacacttggagaggccagctggggaaactgaggcccggagaggcaccttgtccagcatcacataataagaccctctactctaggcatgtgtttctcactctttgattctttc

SEQ ID NO: 395681 - DNA, 611 bp, Homo sapiens
aaaaattgaaatgggcacagaaattagagaaactttaagaaaacttgtagaacacaaaaatcacattagactcttctataattctcataaccatagaaacttaaccataatggagcttatatttgaatgcttcatatggacgagagagagtttaagcattttgcatatattaactcacatgatcctcacaacaattccgctgggtagatactattaccgcccatttgaagcataaggtaactgaaggaaatctaggttaagtaattcccagggcttgctcttgtaagacaactgagcttggattcacatccaggccctcagctgcaaagcttatattcctcagcccatgaatactgcctctgggtatgcaaaaatcacctttgccttcaggaaataaggctcacatttttaagtgaacactcaagttgatatagtggggaaggcggggaaggcagggaaatctggagctgagacaaaggagtggggaaacatactatgggttcagaggacctatccacaaacctgttggtctctgtacctcttcacgctgttgaaaattgactacaccgaagagcttgaatttctgtgcccattcaggtaccgatatttaa

SEQ ID NO: 395682 - DNA, 689 bp, Homo sapiens
ctatagatgattcttctatttccgctgcttgctcattcttgacctacccactggcttttctgtcctcttgtttattcattagcagagaacatattcaggtgaactggttgcccactccatcttgccaccctttcacatgatgcttttctgaaatttgacattttaaatgtggggaaacgtttcagatgtatttggctaaccaatatttattgtgctaggaattattttttataaataaatatttactgctgagttagatcatacagccattaacttggctcagtaaataaaatgcatttagctagttgtcctttaatcgattctcccccccaccatttctgttttctttgcttttctgtgagtggctcacacagaaaattaccattgttcctatttcaggcccgtgttattgtggagagtgttttaacatcgtcagtccttggccccttctgcttttaatcagcctccttgaacagaacccgatagaaacttcatttttaattttgtgggttttattttctttctttatttatttttgatttaaactgaaatactaatggctatcaaattgtttcatgattctattacaaagatcacttctttggaatccagaaagactcagatcactttttcttctccctgttatttcatttttatttactggtattaaaaaatttccctattttctg

SEQ ID NO: 395683 - DNA, 590 bp, Homo sapiens
atcatgtgcaccatctgagtggttttggtggctggcaggacttaagtcggtactggtaagaaatgaagccagagatgatggcaggggcctgttcccagagcactttctgggccatacaaagatatgtcacttttaagtagggcagaaataaaatgaggtatgcctgtacttgccaaagtattttcactcacctaaagtgcccaactttttccttattctaaagcctaactctgtctgacatttggactgagactactttctttaaagacagagggaaggccggacacagtggctcacacctgtaatcccagcactttgtgaggctgggcacagtggctcacacctgtaatcccagcactttgtgaggccgaggcaggtggatcacttgagttcaggagtttgagaccagcctggccaatatggtgaaaccccatctctactaaaaacacaaaaaattagccgggcatggtggcgcacgcctatagtcccagctactcgggaagctgaggcacaagaattggacgaacttgggaggtggaggctggagtgaggcgagatctcaccatggataaagctgggtgaagagcgag

SEQ ID NO: 395684 - DNA, 330 bp, Homo sapiens
tgaaaagtgggaaatttacccaattggccatcattaggctaacataattgtttagatgaaacattttatttaacttacacgagtaagtgaaacttggggctgaggatattgtgcacacccataattccagcttaaagagaaagcaaagtagacattagattgatttcatcaaacaattagatgatttgaaaacagctagataaattaaattacatgactgacttcaaacatgggtggccatactcaacaagtagttttccaagaaggtatttgtattcctcaagccacatgttataagaagaaaaaataggaggaaagtatttgttgaag

SEQ ID NO: 395685 - DNA, 512 bp, Homo sapiens
atgtattatgtatagaggagtcattttctgattgtattttaaaaatcacaaagcagatatctaaaggcaagtattgcctttcagtttcctgaaggtgtttagcaagtgtttaggaacagatttgttgttttttcaaaaccacatagttctttctctgaattcccttttcaaaattttctctctccatcctcccatgagcccttttacccttcttgcatgtttctgtgcatatgtgcggacaagtaaactgttttgaaggtgagactcttggcagaaaagagatgagattgaggcatttgctgttctacaaaatcaccgttatcagatttccagaatcagatgtcagtgatagatcagacactaggcctgtgaatttgcagatagtattgccttgcctaatgaattagatataagacctggacttagtatatatctcatgctccgtttctggacaagattttttttcttccagtggctctgcttattatatataataaaattattttaaaaat

SEQ ID NO: 395686 - DNA, 451 bp, Homo sapiens
tccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggc

SEQ ID NO: 395687 - DNA, 339 bp, Homo sapiens
tatctagagtatcccggtcatctgctacaggacgccccaaacaacaaagaaattagaattcacataaaatcctttgttaactaatgtgcaaataatgttaaaagttggcagtgttaactgtgttagtgtagaggggaaaatcacaatcatgtaatacaagtgtaaatcagtacatttctgggcaatagtttgatggaatgtaccaaaagctttaaaaagtgctcattgcttttgaaagaacaagtccattttcagccactccaaaggtaattgtggatgtatgaagggcttttacgacaaagacattcaccagtgttgcttagaacaataaaacactag

SEQ ID NO: 395688 - DNA, 866 bp, Homo sapiens
tcaagatcagcctggccaacatggtgaaaccccgtctctactaataatacaaaaaaaattaggcaggcgtggtagctgggattacaggcacccccaaccatgcccagctaatttttgtatttttagtagagacgggatttcaccatgttggccaggatggtctcaatcccccaaccttgtgatccacccgcctcagcctcccaaagtgctggaattaacaggcgtgagccaccacgcccagccataagaatcaatttttgtttgattttgtgtcttgcaactttattaaattcacttactagttatggtagtattttgtattagtaggatatgtagggtttctatccatcatgtcatgtcatctataaaaacaaagacagttttcttctcttcaatctgtaagcattttatttcattttcttgcctttctgcaatggctagaatgtctagtatagtgttgaatagaagcagggagagcaataatccttgccttgttcctgatcttagcggacagcattttatcactaagagtgtgtgtgtgaatacgccctccatcgggctaagaaatttccctttcatttcttgctggaggtggggaggaatatttacaaagaatgtgtaggtttgtcttgaattggttaagttgctgtatgtgaaaggatgtatatgtgtccatgagtattggttgattaccaggaagcatctagataatgtttcagggaataagtgaaacacattataaaatttgattaaattgcactctgggaggaaaatagatttcaaagggccttggaaagagtgcggagaaaaaagttaacggaaaggaaagttggggcgcatgcacagaagtttggagatgcatacat

SEQ ID NO: 395689 - DNA, 212 bp, Homo sapiens
acctgggggaagaaggggtcacttaatttttttgggaaatcaaggcaaaattgtaattctttaagggtacgtagatgggattaatttgttatattaaggccgagtatagtggctcaacctgtaatcccagcgctttgggaaggcctaggcaggaggatcgcttgaggccaggagtttgagagcagcctgggcaacacagaactcctctcttt

SEQ ID NO: 395690 - DNA, 105 bp, Homo sapiens
gacagagcgagactctgtctcaaaaataaataagttacttagaacattttgataaacttttacagtgaaactcaggatagctcaatacccagaacatttattaat

SEQ ID NO: 395691 - DNA, 400 bp, Homo sapiens
ataggtacatttattatctccatttacatctgaggaaactgaggcacaaaggggcaaaataacatttccaagcctgctgactggtaagtggccagcatttgactgaggaggtctgtctctagaaaccctgcccctgctgccccttctgtgtctgagtgtggcagtcagaccccagagggaatcccacacctgtaaaataaaaacaatcagctggccctgctgacctcgctggggagcgaagcccagcctaaaaagggatgagtaccctgaaaaggttctgcttgggtgtggccgtgcaggaaacgctcctgctttcttgcctgcctgtcatcgatgacccgaataatctctgcaccagatctgtgtttgtctcttccctgctgtaggtcgctgtggcctt

SEQ ID NO: 395692 - DNA, 316 bp, Homo sapiens
cctgtagcgatctgaggtacctgcactgatgatacatctccgctatccagacgttagtctggccatttcttccaaagaccacttctgattgactctaactcaggagcccgtgagaaaattagaaaggaatgtaagagacatgcttatttctgacccctaatctccctacagataacacaagttggagtgtccttcacagctattcaggagtgttaaatttctaatccctttcttaaggaaatctcagtgtgaatctcatagacatttccacttattcccttatttcgagtcctgcaaaatattggcatatagataa

SEQ ID NO: 395693 - DNA, 587 bp, Homo sapiens
tgactgtctcccatgttgctcgtcttgggtgccttagcatccctcggtgggtcccttggctctgccttcacttctgtcaatagacctccattagctgctcttcattggaaacttttgagcatgccatttgctacctgcacatcttgtctgataaaattactagcaggatgaccttgggcacattacacaacctcactgtacctcagtttccttcatctataaactgcctccctagggttgctgatgtatgttgatctattacaaaggactgaaaacagccactggcacataggaagccctcacgtaagtgttcaccattatttgtatgattaccatatcctgtgcaaggtccctcctaaggatgtaagctgccttaaggtctccagggggtcccctttgggaatgtgaagccccttacagattcaagtaacttaaatttctgggctttcgaggcaaagaccagacattggccaaaagggaagaaaaagcagtaatttggaaaggattctccccaagaacctaattcaaccaaaagtggagaccaaaagcaattgtgggtgaaaacctccttcctcagtaaccaagct

SEQ ID NO: 395694 - DNA, 358 bp, Homo sapiens
ccctccccgggtaccatgtgatatataataaatgcatccaatgttatacatcaatttaaaaaacaggtaaatagctaaggaaaagataactactagccactgtgctcagcccagaactgatgttttctaaatgctgggattacaggcatgtgccaccacggcaggctaattttgtattttaagtagagatggggttgctccatgttggtcaggctggtctggaattcccaacctcaggtgatccgcccacctcgacctcccaaagtgctgggattacgggcgtaagccaccgcacccagccaatccttttattctttcaacacctatttactgagctaggaactgaatttgcaaggta

SEQ ID NO: 395695 - DNA, 488 bp, Homo sapiens
ggtttgatgtgttgggagagctacttcagctactgtgatgattttgttaagagtgtgaaaatatttgtatgtgtttaccaattctaccatttaaacctctggtattcaaagaggaggctcccggtgacatttctttatatttttatgacagtatgcattttgtttttcataacaacaaacatttattgaaattttcctgtgacacatgtttaagaaaatattccatattttaaccatacaattataataaaagccttgtaagataggcactattattttccccatttatcaatggtaaaatggaggcctagagaggttaatacttgcctaagatcagttgaataatgcatggcagaggcgagctttgaattgaagtcatcttcctagagcctgtgagagctatcctcaatgctaacatgaagatatatctgtgacaaaaaaaccaagtacacgatgcatagttctaccatcaggatgcacacacacac

SEQ ID NO: 395696 - DNA, 423 bp, Homo sapiens
tgagcttctaacggcgaatttaacttgtatgttaatacagaagaaaggttacaaaacctatcgaaatggttttttgttttaccaaacatattacaactcaagtcaaaagttcacagccccagcaactcgcgtacgaatctgaagcaggtccagaccattaaagtcacagccccagactagaaaacggccggtgggtggggggaggggagagggcgcgtcccgaagatgtccacccgcagcaccgcgcaggctgacgcctcccctcctctcgggctggaggtgagagcgcccttcctcctaccacgtccctaccttcccggcctcggattacgccacagctggcaaaaggactttttcatgagaaaacagacaagtcaaccagcgcgccgcacactcgacctcccaggctcgcacgggcggccg

SEQ ID NO: 395697 - DNA, 423 bp, Homo sapiens
aataccaaaatgaggcaggtggtccccagaaaagccctgtctttcaacaggacaagtgccaagcatcctgtagaacgcaccagaggctgggcacggtggctcacgcctgtaatcccagccctttgggaggccaaggcaggtggatcatgttggccagcctggatgttctctcatttttaaaaagcagtttcactttagacaccaaaagcaagtgtccaataaatgctgaagaagaaaaatattttattaggttatttgccctttcctctctaacttgaaaatacattttctcaggaaaaggtagaatcctcagatttgtccataaaccaagggtcccttaagaaattttctttgtgttacagtgaaaatgactattttgacaacttggaagataaggagctaggctaagtcttattctagtct

SEQ ID NO: 395698 - DNA, 626 bp, Homo sapiens
agggtagggcggagacaggaggcagggtagtgagatgtgctttgaatctatctatgtccaggagtaccccttgccctaggagatttggggaacaaagtaagaggatgtcaactctccatctcctggcaaagagccacttgcttgtgcagtttaattttttgtttgtttgtttgcctttatagggactgcacattatctaccttgaagtgctttttctggcagcatagttactgttaaaaaggagaagggaaattgagatgagaggggcggggcagaaacatttttaaatattgctttatgggtgagaaaggaagaaaatatttgcagacaaaaaaaaaatctgccaggaaataatttcttcttttataaaactacgaggttagtctaaatatgatctttgcaatctcttttagttcaaaactgattatttgaagattagtatgtaatcttcctcgttcattgaatggcgttcttcttttatgtgtgttgcaaaacaacctttttagaaaatatctgtgaagcttatcttctgattaatagctatgattgttctttgtaagacaccagcttgaatgtcctgaaaccagaagccctagtccactggatatactcagagtatcttacca

SEQ ID NO: 395699 - DNA, 157 bp, Homo sapiens
ttgcttattgaaaattattggttaataagttccaataattctgctttgtgctgtatataatctgttgtctttcctttttgtagttcaacttctaaaatatctagttattttggtaattgggattgtgctcccatgagtagatcagctattacgtcag

SEQ ID NO: 395700 - DNA, 103 bp, Homo sapiens
ctcagcaccccaacacacaccccagatttcctaagacacagaccaactgggaagggcaccctctcagaaagtctctgatcattcgcccatctttttttttttt

SEQ ID NO: 395701 - DNA, 260 bp, Homo sapiens
atgcggccgccctgtgcaccgcaggaggttgggcagcatccccaccttctgctcaacaaataatcactttcatcagtgacaaccccagggtcgtgacaaccaaaaatgtctccaactcatggacagatgtcctctgggggacaagattgccccaggtggagaacccctgctctggatgcctgtcactaaagctactgatgaccaaccagagccccatacaacatcatctaaaactcttcataggcaacaaaagaaaaaaa

SEQ ID NO: 395702 - DNA, 513 bp, Homo sapiens
ctaagcacagtgccatatgccctaggcccaagtaattcaagagtaaatgagacagacatgatttctgccctcatagagcttatttacattctaaaaggaagaaacaagtaataagcaagtaagctaaataattttagattaacagcagataactgctattaaaggaaaatgaaattgtgatgtgttagtgactgggtgagggttatttcagttttctgactagaaaggggatggctgcattatctgtaatcaaaagaggtatggggtagaatatagagatctagattaaaacttcaggaagcctttcttctcacaacacagtagatattcaataaatattcactgatttaatatttaataaatatttaaagtctatattaagtttgcacttaacttcaggtttctgcagaaagctgctggatccacaaaatatttgctatgcaggtatttatgtatttaaggctacacatattttaaatccatatttatgactatgttatgcctaaggcactt

SEQ ID NO: 395703 - DNA, 360 bp, Homo sapiens
tccactattccagtctatcagccccctctggattccacttgactccttaccagcctgtatctcacagtcaagcttttcaaccttacacatacagcatcgtgaattttgtctcctttccttcccacactgaacccttcccatacctatccgccaatcactacctctgctgaaaccaactgatgtctctgtttctcctctctgattcctgagaattgctggagaaaagtcacttaactgataaaagaccaggtgcttagaacatagacatctcagtctgaaacccggctctgctattaatagccgggaaagatttcgcaaattctataatctctctgaacatgtttcctagtctgtaaaaag

SEQ ID NO: 395704 - DNA, 411 bp, Homo sapiens
caccctctcactgggagtcggaatcgtcgtttcccagaagctcctttgattctctgcagggcatggccaagaatacagatttctggtgaaaacaaaatctagtagccttaaattaatgttataaagtgggctgatgtgacggtgcaagagttctaaaattagacgctgcatgcttcctttctccacctacttgttaaagagaaatctaccccaaaccccaggcctggtaccagctggccctgggactgctcttgctatatctttttcctggatgttccatattgacatccacccaactctttcaggaaaacaatcttaggattcaatggacagaagtctccactgccacactccttcctagtgctttttattgtagctcaattacggtgttgctcttgcttagaaacattc

SEQ ID NO: 395705 - DNA, 81 bp, Homo sapiens
gttctctggcatattgtcatttggagacttcatttggactctattctctgtacctttttaaaataaaaatgggaaattttc

SEQ ID NO: 395706 - DNA, 894 bp, Homo sapiens
aatggtctaaaaagaaaatagggtcaaaagagtgctgtctgtactttatagttcttcatgtttaaaaaaaagttatgctatatagtgaaagttttctgctgttttaacatttcagattttcctgttattacaaatactatgtttataatactgcattctatgatttatttaccttttatatagggtattcccaggttttttctctgtaatagatactgctgctatgagtatctttatgtagagctttgtttctccttggcagagattcccaggcaggcatgagtgttttgaggctgataaatacaactaaattgccttgcagagggattgtgccagtttaggccccactagtggagagtgccagccttgccaaaccattacctgcatttttccttccttggccttctttgttgagatgtgtatttttctctggcttaggatactggttgtgcataccaattgtaatttaatatgtaggggaagaaagccgattttccggaaaaaggctaaaactacaaagaagattgtgctaaggcttgagtgcgttgagcccaactgcagatctaagagaatgctggtattaaaagatgcaagcatttgggactgggaggagatagagagaagggccagtgatccaaggttcttaagtgtcatcctttttattattgagaccacttaaaatcttgaggtttctgtttcaacaaaaaaacaaaatacaaccaaatacgaaaacaatgaacgatacaatagcaaatacacaaaaacacaaaaaaaaaaaaggggggggcatatatcgggggacaaaccttttataaagtccatgtataaaaataagacggcgacaattagaaaatgtttgaactcttggtgacaccctctttttttctgttggga

SEQ ID NO: 395707 - DNA, 182 bp, Homo sapiens
gacgagactaccacatatattttttataattctctgagaaactttcagttttgggcttctctatctgaggcaccactggtccccaaaaagccaatggaaaaccttagctgttacgccccctttctttccaacccccagaccatccctagctatggagctggagacctcgggacagtatttct

SEQ ID NO: 395708 - DNA, 191 bp, Homo sapiens
tcccacgggccagctcttaacatctatgctattttgcctctccaggccttgaagtagagaacagaatcccatgccccagcacccactccaaacacacacacccatcaccatcctttctgctgttcccaaggccctttccagtctgtacggagccattctccactgtgactccctttttccatttcaccctt

SEQ ID NO: 395709 - DNA, 147 bp, Homo sapiens
catctcactggtttaggtgctttctttatatgtctactgtttcctttttctttttgttcttctttctctcctcttcaaacttttttctctgccatctgaacacttttagtttcttattttttttgctgagaaacaactgaaattgtc

SEQ ID NO: 395710 - DNA, 352 bp, Homo sapiens
gggagaaaaagaaaagaaattacaaagtggtatatttaaactcaatcattgtcaattatattaaatgtaaattatgtaaacactgcaattaaaaagcaaagattgtcagactgaacccaattatttcttgtttcaaggcaaataaggaaatatttttaactttatgaaaatgtaaacagaacaagctaaaatttatagaatgcagctaaagcagtgtttagagggagatttgtaaccttaagtgctcctgttagaaaagaataaatttctaaaatcagtgatctaaacttccattataagaaactaggacaggaagtacgagtaaacttaaattttgtagaagaaagaaaat

SEQ ID NO: 395711 - DNA, 464 bp, Homo sapiens
ggcatctacgtagtgaaggcttcccttcccttgtcctgcagcgtgctggacagtgtcccggctcagggaccccttctgtccccttcctggctactatgggtcggccctgcgtcctcaccactttgagccaccctttgacccagcgtctctcccgcaatgggacctggtgggatggggacttggagcatgctacaggagaggtagaacttttgagtctcttcttcccaaggttctccccagagtcggagagcagagacggatccaggggcactttctggccgctgcctgctcgggctcaacagatggagtccaatgtttcagtctcccccaagaatgtgtatcctcattgctgacacgggagctgggtgcggggagagatgtggtggtggggacccttgcctgagcagcccattgtcatgagtgttattgccattgtgataatatgttagcatgactctcctccc

SEQ ID NO: 395712 - DNA, 422 bp, Homo sapiens
tggtcatgatgcataattctttttacatattttagagaattttcttggataatattttgctatggatctttgcatgaggaatgatggtctgtgttgttgttttttttttaactttgcctgattttgatatcaggatattactagcttcataaaatgaactaggaagtatttcttcttcctcctgttttccaggagagattgttgtagattggtgtcaatgtttctttttttctgacttaaatgatattatatatttacttacttttattttacattgacagattatagtcgtatatatttatgggatacacaatgatgttaaagtttatgaatacaacgtggaataattaaatcaagctagttaacatatttatcacctcaaacacttatatttttgggtgaaaacatttgaaatttactct

SEQ ID NO: 395713 - DNA, 283 bp, Homo sapiens
tcttcagtctatttagagctcccttgagccttctctctctggcaaacttctttttataacataagcaaaataacggaagatgtacattccttgttgtgtgcatggcatggatgggaaggatgaacggagtttatccatgaaaagtatggctgtcaaaaaagggaattatgaagacatgttgtatgcaagatatcttgaagttaactttttaaaaatatgaaacaacttatttccagcaaagtgcaaaatgaaaatcacagaaaaagtcaacctgacctgaagc

SEQ ID NO: 395714 - DNA, 635 bp, Homo sapiens
gagagggagggagagagaggagcaagcatcttctctttccctgctggtaacttccaacagacttcctggaaatcggaaatactcaccgcacccgagccctacgggtatgaaacccagaatgccaggagccgcacgcgcctgctcggggcggcatttctttggctggccgccgccctggctacggggatttggacacatggacctggggttgttgtctcgcttggcacatgcatctttctccagccactcctgagaagttgatggcgcaggaaggtcgggaagcttcgagagccgcctcccgttttccgcttcccgccggagccagatgcaaagctgccgtggaatagcctgctcctttctcctgctttaacagaacttatgtggctgggacgcagggccctcgggtgtcaaaactttgaagattaatggattactttgttaatgactgcaggcgtcagactgaggtgcttaaatgatttgtgaggtgcgaggcgtcttcccgacagtcccaaacaatgcgcggagtgtgcgggggaggcagagggcagccaccggcgggaccgacagcagggcttacactcgcgcacattcacacacacacacacacactcccaggcacacacactagatagatc

SEQ ID NO: 395715 - DNA, 362 bp, Homo sapiens
acaggaaaacccaaaagatggaaaaaatataatgtcccctatgaaatctcactactcagagaaagttattcatattctggtgtatagcctcaaagccacttttctagaattatagagataagtggtaaacattattccacattttaaaaattattttaaaaaattttttgtaaagatggaatcttgctatgttgcccaggctggtcttgaactcctgaacttaggtgatccaccctccttggccccccaaagtgctgggattacaggcgtcatctactgcacctggccttaaatgttttcttctttctttctttctttctttctttcttctttcttttctttctagtttctttttttttttt

SEQ ID NO: 395716 - DNA, 278 bp, Homo sapiens
tgcagaggcgtttaggcctgcaaaggttgggaccaggatgtaagcatggggttcaagttcacagtcccattattaacaacactgagcagtaccactgctgcccaagcaaacaggaaaggtccgggccaaaaatgcatatccttctttatttcccagaactggaattcccattcaactgattttctggaaaaataaagtttcattttacgtcgtcatggtgattttcttgagaatataatgccaagagtacagcttcaagatcatcttgtgtctaacgc

SEQ ID NO: 395717 - DNA, 242 bp, Homo sapiens
ttaatctctacccctttctttcctagtaccatcaaataggcatgattaagtacaaatgtatcacttactatggcaagaaatattataaacaaaccaaatattataaaacaagccaaagtcacataccaagtaagttgtacatgactttcagtgatattcaccgactgaaacatttatgcatagtgagttccagcatactctgatccatctgtaaactttcatcaacagcagatttgtatagg

SEQ ID NO: 395718 - DNA, 444 bp, Homo sapiens
ttggagaagcattgcattcctctaagatttgtctacctcattccatctccctgtctatttctctctctttgctttctctttcctggtctctatcccttcctttcattacatgtcatgtaccttgatagagatagatgcctgcactcccatgtctagaggtacatggttgccaatgaatgcaaaactcagaaaggagactagaactctagccttctctttcactcctcctctttcctggcaaggtcgcaagaacagtcatctatttcatccaagtgtttgcatctaacacaatcactgcattcagttttgagatttgtcatcaaacaaactgcacccttgtctttgagagttcaggccctggtccgagaggattcaatcctgtgggtatgaactgcttggtaagaacactacccaaagccagcagcatgggccttaacagacctt

SEQ ID NO: 395719 - DNA, 621 bp, Homo sapiens
ggaataacttgcaggaaagatacaggttgattcacagaaagaaaagaatatcagattttctttgtgatgctcccactggaatgacttaatatgccaatctttgaaacaataattgtgctagggaaggggctaaagtgattaacattcccaactaccccaaagtaaggaaagaaatgcaaaacaggcaaaattaacaggtgtgtatgccgggcacggtggctcatgccttaatttgttatagcagccctagcctgactaatacattccctctccactgggagccatggtttgttcaaagaaatgataccaggccctcaccccacatgccatggaggtgggttcccctgcatactcttagacacccacatttgctgggagacattttacccatcaataacgaagctgcaaagccctccatcaatcccgtcaagagctcttacctcaatcagatgtgcccagcatcatgaaagcagagaggccttatcctgaattgtcagatggcagtcaaggttgcaaaagcagagacagactaacgatcttacatattacccatgaccacaaatccaggatgacagactggaagaactgaactgaacgtagagagaaaaaagaggacgggtg

SEQ ID NO: 395720 - DNA, 450 bp, Homo sapiens
tcaccaagtttatagtatttttttttttttttgagatagagtctcactctgttgcccaggctagagtacagtggtgcgatctcggctcactccaacctctgcctcccgggttcaagtgattctcctgcctcagcctcccgagtaactgaaattacaggtgtgtgccaccatgcttggctaatttttgtatttttagtagaggcggggttttgccatgttggccaggctggtctcgaattcctgacctcaagtcaaccacccacctcagcctcccaaagtgctgggattacaggcatgagccaccacgcttggccatttatagtaatttgttatagcagccctagcctgactaatacattccctctccactgggagccatggtttgttcaaagaaatgataccaggccctcaccaagtactttttgtcatttctacctctccttttaagcc

SEQ ID NO: 395721 - DNA, 354 bp, Homo sapiens
gtatcagcgctcgtactgctcttgtgtgcaacggtagtgctgctttgattatatcaaagtatatccattgaaatatcctatattacactatctgaagagtcattgattactgatgtatttttcaatgtgctagccttgaaaaaattacaaacaaaatggatagtgtggatagtgcgatgagtaagttattccggcttctccagtgtgaactttcacttaacccctgacacaaagccacgtggatgatagcaaaatggtgacatgcatcaagccaagaggggagcagcctgttgcttgagtattgctgatgtagtttctcttcatacagtatcacgcttttccaggcttttaaaa

SEQ ID NO: 395722 - DNA, 213 bp, Homo sapiens
ctcagcccaacagggattggcttcacctaaaaatctaaatgcagtcccctcacagcaagtccccaggctgtgctctctgcctcccattgccaccctagagggcacaaagctgtgaggcccagaggaccagaacgcaccttcccaagtggccaggagtcaagactgcatatttggggaggagactattgtccccagttgccagggtcctaaaga

SEQ ID NO: 395723 - DNA, 227 bp, Homo sapiens
aacttcagggagatcttttgggaactactaatttttgtggggaagaaacatctacttcagtttctttttctcctgttagattcacataaaattagattcagaacttttctttttaaaatagcattttaatataagcatttctatttagcattctacctagaaataccttagacatacctagaatgctgttcacctaatgttagtagttatctctgggtggtttttgg

SEQ ID NO: 395724 - DNA, 104 bp, Homo sapiens
gaaatcaccccaactttctccatagaggtctcatattgaccataagataatggggcccagaatggataattccagggtcatgtagagtttcagccttgtatccc

SEQ ID NO: 395725 - DNA, 373 bp, Homo sapiens
tgcttggtaaatccactacccaggccccttctttctgataccatggtgcctgccttgggttagcctttattatctcctttctggggtcctgatcccatcttcaccacacttgtctcccacattattgtctcttccttccctaagtcattctgcccatagtgaggacagtcatcttcctgaatcacaggtacaatcatgacattctagtgcctatccctgccactctactgaaactgctctaggcaagacttccagtgacgttcaaaggacacctttctattttatttggcattgctgtgacatgtgacactgttagctcttcccttcttgagaagttctccttctttccccttggcccttatccgaggggtac

SEQ ID NO: 395726 - DNA, 581 bp, Homo sapiens
attctgcccatagtgaggacagtcatcttcctgaatcacaggtacaatcatgacattctagtgcctatccctgccactctactgaaactgctctaggcaagacttccagtgacgttcaaaggacacctttctattttatttggcattgctgtgacatgtgacactgttagctcttcccttcttgagaagttctccttctttgtccttattcactctaccttccattgggattttctcctgtttctctgatctctcctttttagtctcctctatggctgtttctttctctgattaaacattaatgttattacatcagagagcagcaccctgagcaccctaatcttatgctgcagttcttaacacccctgggagagccatccacagccaagattatagctacactgaaggattgctgacttgcacatctattaatctctaaaccatttggcctcctgactccaagacctgttccattgcttaaggaatttctccacatggatggccacaggtatgtcaaagttggccaacgtcaacttatctgttcttccttccaaacctgtttctcttgtctttcatgttga

SEQ ID NO: 395727 - DNA, 499 bp, Homo sapiens
acacacacacacacacacacacgtacacacacatatataatgtatatatataatgacacacagataaatgtgtgtatatatgcacacacatacacaaatgcgtaaagatgtgtgcatgtgtgagtacacatattattttgtagccctttccactgagtgggcctagaagcaatgacatttagtaacaagagacacagcacccaaatcttgggtcttaaataccgttctccaataaaaggagcagggactccttggagaaatagttgattccagtgaggaggcaaggaaacttcaagataaacctggaacatctgactctacttttgtagagtcagaaagtaaggaagtgcttataaaatgatggaggcatgttgaaagaacacaggcatcaggtgaaggagctcccaacggccaaatctagggcatttgagtaacaaaatagagtaatgaattgtaatccacagagtaaaagaaatatccatgagtcatattaatataa

SEQ ID NO: 395728 - DNA, 429 bp, Homo sapiens
tctctctcagagcctcaagtaagatggagctgatgctgtctactccacagagtgtgggaatcaaacgtgccaatgaatatttctgatgctttgcttcatgtgtggcatgtagcaggtgtctgaaaaaggtttgttgactgactgactgactgactgactgactgaaaaatgaatgaatgaatgaatgaatgaaaaataaatgcctctgtaaacacctcaaacatcatttttggagactaagttacatggggaccctatagcatcttctgtcttacacagcagtctgcttcatatcttctaaccctcctgttgactttaagggagatagaattctgctcatttacagatgtgttcccaagacctaaagggaaggtggcttgtccaaagacacacagctaggaagtggtgaagacaggatgggaccctgat

SEQ ID NO: 395729 - DNA, 409 bp, Homo sapiens
ttgactttagatagcctcatattcatataaatgaaatcacatagtatttgtcttttcatgcatttcaaacatttttaagtgtacaattcattggcattaaattaattcacactgttatacaaccatcaacactattcctctctggaactttttcatccttccaaactaaaactctgtgatcattaagcaataactccccattactctgtcccccaggccccagtaaccactattccactaattttgtctactataggtacctcacacattatttgtccttttgtgtccaactcattttacttagtaaactattttcaaggcgtatccatgtggtagcatgttagaatttccctcccttttaaggctgaataatattccattctatgtgtataccacattttgtttatcc

SEQ ID NO: 395730 - DNA, 284 bp, Homo sapiens
cctttccagtgctcagccctgggctgccatccacagtgggaacacacatggacagacaagcccagtggcttgctgctggtgcagagaggtgcaggcactggtccctggaagggatgaaggactgtggggctgcctacaaggggaagggagagtgggatttaaggtggcctcatgcagtagttagtgcctgaactcagacttgaaggaggaaaggaggttggagagggccttccaggctataggaagggcatgggctagagcctagttgctcgggtgatgtgagg

SEQ ID NO: 395731 - DNA, 411 bp, Homo sapiens
tacactagctgttatgggttgaattgtatcccctcaaaagatatgttgaagttctcaccccctgctacctcagggtgaccttatttggaaacagggttattcccgatattattagttgagatgaggtcatactggagtaggatgggcccttaatccaacgtgactaatgtccttataggaattggaaaagacagataaacatggaggaaatactgctaatgtaaagatagagacagagactggatttattctgccacaatccaaagaatgccagggactaacagtggctagaataggcatggtggtttccttccccagatatttcagagggagcatggctgtgccaacactttaattttggatttcaagtcatcaggctgtgagaaaataaattcttgttgttttaaatca

SEQ ID NO: 395732 - DNA, 394 bp, Homo sapiens
gttgttaaaaagttaagttacttttcacagcctgcaaacccttcaaaggcaagaactcaaatagaaacttggaaaggcagataagccagaaaagtgtactaataaacgcacttaatatgattattttttgatgccaggtccaccaagtgaagattggaggatgtatttgtttcttctactcaacaacaattgataaagcatgagttccatcaaggactgtgttctaggtggagaaagggtgactcacccagtcattggatctctttcacttccagtctctggaaggcagatatctttataaaatatgcagacagctaggctctaaacactggacaagaggtctgtaatcatccagtcacatctcaggtcagagggtcttggactgcttaagaaa

SEQ ID NO: 395733 - DNA, 260 bp, Homo sapiens
tgctaggattataggcatgcgccaccacacccggccaaaaagcactgttaatatttctaactttgaaagccatcactaagtattttgagtactctaaatttttttttcacttcataactaaattagtgaaaaaataaaacttgtccttaatttaaaggtatattagaattaacaagttttttaaatctacccttccagtgagactaacattattttagttatttatttgtttttagatggaatcttgctctgttgcccag

SEQ ID NO: 395734 - DNA, 414 bp, Homo sapiens
taattgtatgtctccttatttagtttatcaaagtaggtctgtgcatacattaatgaaggtatacaggtaattctggtctttcactaatattcagtacataatcttccatctaaaatctgcttttttcttctgtgttgctacgttagtaaatgttcccattttctaactagttgttctgcaagaaacaggattctcaggaattttttgttgataatacaactttttaaaatttttatcaccaatagaagaatgaatttccagcagtcaggaatctaacacattacaggggggaaaaagtacgtgaaaagtggtagggggaaattaacaaatgatcttgaaaaatctatggcggctagcaaagtattcttgaaaacaaagatctctgcattccggtattttagggatcctcaaaaa

SEQ ID NO: 395735 - DNA, 140 bp, Homo sapiens
aggagacatttgagtgaagcctggatgataaggaatcagccatgccatgttctagacggaaaatataccaaccaagaagccagaccaaatgcaatgatcctgtgattctgggactggaataaatttaatttgtacaggga

SEQ ID NO: 395736 - DNA, 692 bp, Homo sapiens
aatttttctatttaaatcaaaagcacccttttaaagcccctaactaagccttttataaataaagtaaatcatcttgcagtgcattccttgatgatggcttatgttgtttttctaaagaaagtttaattaagatttgattttcttctattctgtactttgtttattcatcacagaatgaaacataggtctttaatgtcaatggtaagtctgactttttgggtcattgatgaccattgcagttttcaaaaaagcagctgaatatttatcttttgggtatgattagaacataatagagcataaaatgggctgcctatgaccttagcatgggcttctgtcattgcaggagaacatttctggtcagtggccactgtttatggtttgttaaaatcagcacaaatgtacaaataactcatgaataattgtgaacacagtatttaaatggatgtttaataaatatgcattaaaaatctcattacagtaatgaagtttacagctgaaattttaatccagccctttagaaatattaaagtgcttttactgattgtgcatttttctcacagcagttgggtaaacattttaaactggaaatctgaattccttatatagttttgatttcatttaactaagcatgtgttctttttggcaaccctcttctttctctttgtgaagaagtgaagctcctttattccata

SEQ ID NO: 395737 - DNA, 298 bp, Homo sapiens
agtagagatggaggtctccctatgttgctcagcctggtatcaaactcctgggtttaagcaatcctctcacttcagcctccgaaagtgctgggactgcaggtgttagccaccgcaccctgccttattctcaattttttcattgttggtttttgttgttttttttcctaattaccagaatgcattgctatgatggaaacctcaggaaacataaagactgtgatttaaaattctccacaaccactagagagtaatactaaaagtaatagaatggacaaaaagccacaatcccatgaaaaca

SEQ ID NO: 395738 - DNA, 620 bp, Homo sapiens
accagaggagccaacctcatactaaaataagatatttcaatttgtaagaatattttttaaaattaaaaaaatctgatagcaactttaatgccttaatttttaccagactactcagcaatgccgtaagcgtaaactcttctacaaggttccctgtagcatagcacggaaaaagcacagccttcacatggacttaaacctggccacaaacaagctacacttactgactatatgatttctaactttctattatacacattacttgtttttcatatctggcttaaaactttgaattcaagcacttgactcatgtatctatgaggctccgtgtgggcgcctaagtgctctagaagaaccatggttggcttggtttgtttttaattatgaaagtaatctacttacattacaaaactataggactgaagaataaatatgtaatcacacgtaatactaccacccttacagaagctacaagttttgtctatttcttctaacctcttgttcttgggctgtttttcctactaacaagctgaaaaattcatagctttttactctgataaacataattgttttttaaaaattcaaacagtctagagaaggaaaacacttttctcaaccattat

SEQ ID NO: 395739 - DNA, 175 bp, Homo sapiens
ctggccttagcctcccaaagtgctgagattacaggcatgagtcaccataactggccccatttgacttttaaataaacccagttatggaaaatggaaaaatattcaggctcttaaatcaaaatttttaacaaagaaatggagacaaacatttttaaaggatttattatttcgcata

SEQ ID NO: 395740 - DNA, 327 bp, Homo sapiens
ccatacacgatagtgaaccaggaaggcccactgggaggcattttcagtttttcagttgggatgacctaggaactcatgctactgacaagaagagagttgtcattattcctgcccctttcaagattgctctgctttccatgatcttttgtccaaatgggaggtttttctgttgtggtttcctgttttttggtgccccaaggtatgctgctgtaagggcagatgactggccatgatgaggagccatatatgtacatgttagagatgaatccccatgaatcagagatctaagacttgctgggctttgaataacaccctcatgaggatacc

SEQ ID NO: 395741 - DNA, 377 bp, Homo sapiens
ggcaggatggtctcgatctcatgacctcgtgatccggcgtgctcggcttccaaggtgctaggattacaggcgtgagccgacgtgccgcggcccctatctagttatttttacgctcccatgtaattccaaaatgaagccagtttgagaatcactgatagttcgttgccctgatagttgtcaggctcaggaagcctacagtaataagagcttatcgtgatggcttgtgtccgtgatggatgtggtcaccacagtatataatacacttgggtattacagttaccagaccatttctggcatgactgaaacctaagaaagatgctccctatacggtgtctactagtgtaactttctgcagagagaatctgggaggcagagat

SEQ ID NO: 395742 - DNA, 502 bp, Homo sapiens
gtttatattagagtcgaaagacctaagtttaaattcaggctctgtctcttattttgagatctcagacaagtcactttaatctgagttcctctctttacctgaaaataggtgtaatagccataaccctcactgcctagaccacatgactgctatgaggattaagtaaggaaatgtgtaaaaacgcttcataaaactataaagtgtaatacaaatataagggctcctggtattattcttaaaataagtgctaagagtaaatccctgtctataagaaatcagaatacaattgaattatttctgcatacttttcccaagagaatttatgtctgacatgcaaaactgtaaataactcctaaaggggaaattaccaaaaaaggaagggaaaaaagagaagaaagaaaacttggggtgggactagaagagggaggtaaattaaagagaaaaggagaagtttttgtagtaaaataatgcaatgtaagagagagcaaacctgatctgaaga

SEQ ID NO: 395743 - DNA, 239 bp, Homo sapiens
caccaattcagcttctttcctacccagtttgctttgccattttcctcctaactaaatgcctcccacctctttccatgttcctgacacatttttgggaggaggtgggttgctttttcctgcttagcgtggattttacaattggctgtcagcccacagctttccacgctctctccctgaaaacctgatgctaagtgacgggtcatccattggtgctgatcccaccttccaggagtccttgg

SEQ ID NO: 395744 - DNA, 404 bp, Homo sapiens
agcagagtgcaccaaattcaggagaagtctcttcctgctaaggaaacagggaaggcttcctggaagaggaggcatttgagctgagtcataagactggacagagaaatgtattaagtgaatggggagaggctattctagataacaatgtgatcagaggcatggaagtgaaaaagagaaattcagtttgactggaataggaaacaggaagtgataagacagggacaagaccacaaaggccttcaatgctagaccaatcaaaaacccaaaccaggtctgtcttccttaagtgtctgtgcttgtcacaatttgaagaaagagaaactcaatccattaagaaatagacagccactctagcagccttgggtggaacccacagactcatctgcaatgggctgaatgtctat

SEQ ID NO: 395745 - DNA, 412 bp, Homo sapiens
actctacaggatccccgacgagttgtccgagttagggtgctactgcttatcagtttcacttctagctctgtgccttatttttctagttactgtcaaagttagtgtcttctgttatgtaaaaatgttcgtaatttattagtaaaaactacattgttcagcacccagcagatggtgggtgctaaagtggaatgaaaagagttaccaaacaaggaatacaaaataattcctatcttggtatcatttaaagtgaatctatgctagaaagattccataaagaaaaaaaatgaatctatatacctacatatacagggaatctgaagtaatttttaaaagcaatgtcagaatggttttcttttcttatggccaagtaggcttttactggacctgaccttcctgcatataactcggacaa

SEQ ID NO: 395746 - DNA, 299 bp, Homo sapiens
aaataaaagcttgatgcaacattctactgaagttaacaaggtctaggaccctacatggtactgaggaaagggatggcatgtaccactagggtgggatgccctggaaaggaacacagacacggagtaaagagaatcagaaggatccccatggagcactggggaacacaggacaagaacggctcaaaatccaggtaaaaaactattagcagtggattcccaaaaaaataagactgaatttttgtggagagccacttacattttctcctacaaacattgctgaatttttatttttttaacat

SEQ ID NO: 395747 - DNA, 372 bp, Homo sapiens
cagtaactgatttagactgcaccagttgccctgttctatttcccaaggatccaaaatcgtttcacttcaaacctaaagaaaaatttaatttcttctctcccctatttctcataaatcccttacttactgtaccagccattccaccaaaaaggttcatttgaactaggctctgggaaaggatatcagtaaagaagggaaaatatatcagtaaagaagatgatggaagaaggtattccaggtaaaggaatcaacagtgtgagatgtgaaacacataagaaaacatagacctattttaggaacagtaagttcatcaatttgtctaaagcagtagtattccctgatgaagtgagtactactgtaaaatttagtagt

SEQ ID NO: 395748 - DNA, 253 bp, Homo sapiens
gtggagatggggtctgctatgttgcccaggctggtgtatattttcaaatagctagaacagattttgaatgttttcagcacaaagaaatgtttgaggtgatggatatgctaactaccctgattttatcattatatactgtatacatgtatcaaaatatcacactgtgcccaataaatactaaatacctacaattatttgtgatcattaaaaacaatgaaagcaaaagaaagggtgctcagtctcattagtcaca

SEQ ID NO: 395749 - DNA, 327 bp, Homo sapiens
acaatactgtcctactatgtgtgttaaccactcaaaagaggtcaaacacacaaaaagacatggctaaaagaattaaaatgctaactaactaatatcctcactagtccttgatcttctagtgaggaagaggatgggtgcagccaacatgagtcctctgctgcagagccacacccttgacaatggagataaatgtgcacgtatgtccccttgaaaggttgcacctttcctgctttggctagagcctctgtcatggtgccacgtggtttctatgtaaatcagctggcgggtagaatcatttctgaccagtttagggaggttctgggcaat

SEQ ID NO: 395750 - DNA, 261 bp, Homo sapiens
tagtacattctcctaaaatatgcacattgaaatcagataatagtaatggtctagacctcagatacggattttttaaaccatatgagataaatgattatcttcttcttcaaaatattcaaagacagaaacttctaacctctgatgttttaatatttcatgcccccaaaactcttaagtccaaattaacactctcacttaaatctaagctgattttcttcaacaattgaatagtgagaaggttatgttgcctcctcctaaatt

SEQ ID NO: 395751 - DNA, 700 bp, Homo sapiens
cctaagtgtgaaccctactaacacggttatgtctgtgatcatcaaaaaacaactaggtatccagcaagtacctgctcttagagacaggcacagctcctgtcttcacagagcttacaggctggttgaggaggcagccattaaacaaatacctatgtctgtgatgatcctacaacaatatagaatcgtctcaagtgatctcttttattatgcccaattttaaaaattgaattcaggtgagacatggtggctcagacctataatcccagcactttgggaggccaaggtgggaggtttgaggccaggggtttaagatcaacctgggcaaaatttttaaatttttgaaaaattgaattcaagcttgtagagaatcaagcctaaagggactgttgaaaagagtgagatgcccaaggccacacggtaatactgagagagcaagaactgacttggagctagtggtctcccaacgccaatgcgcttctcctaaacactcacacgctacccacgctttctacatcaactttaaatacactcctttaaatcataaagtttttcaataacagctacaactgattgataattcctcttatttatttatttatttagtctcgctgtgtcacccaggctggaatgcagtggcgtgatctcggctcactgcaacctccgcctcccaggttcaagaaattctcctgcctccacctcc

SEQ ID NO: 395752 - DNA, 167 bp, Homo sapiens
tgctcctctcctcagaagccatgtcatggctgcccactctctccaaagactccctccaccagccacgcggcccgcagccagagttcttcctgtgaagagccctcaccgcttcacttttcatgtgaagctggcaaagccgcttcagcgatcattttttaacacggcag

SEQ ID NO: 395753 - DNA, 614 bp, Homo sapiens
agtgactccatcttgaccagaattgcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggcctcccaaagtgctgggattacaagcgtgagccaccacgcccggccaccctcttgtttcttacacattacttccattctcaaaatgcctcatagtctaaaatggctgccagagctccgggtctcacatctaagttccaggaaggaggaagaaggaaagaagggacaaaaaagggggcactcctccttttgtaagggttctcctttctggaagtcccataaagcacttctatttatatcacattagtccgaacttcatcacatgactacctggagaggctggaatatgtagttttcgacaagatctatgactgttctagataaaatgagggtcttatgatgaagggtgaagtagagaatggttgaatgcctgctatttcgggcaaatcccatcttagtccctcattcacaatctgacatctgacctct

SEQ ID NO: 395754 - DNA, 236 bp, Homo sapiens
aagtcatatggatttatctgagtgtaaggagagctggaaaaaatagtttctagcaggtcagccacctcccagtgagggctgcataccatagaaggggagaatgaattttgggagaacaggtaattatctctgtcacagaaggggatgaaaagtatggtagttacacaagttagacatctgtatggaaaataccacttggttctacaaatgtggttagaatatttgaaaggtatggg

SEQ ID NO: 395755 - DNA, 517 bp, Homo sapiens
gcctagggattgcacaagtttggggaggaatcataactgatgcattctgtcaccttccactccctggggactggcagagagcagacatctgtaaatgtttgctgttgttgaagtacattggaacatgcccccgaaccaccaggatccaggatctgctgagcagccagaggggtttaagtcagtgccactgacttgcagtgtggccctgggcaaggggtagaactcttctggcctggcttttctcattagtaaaataaggggtagttttaggcaatttgacagctaacgtctgtttcctgtcttggcccaatggcccttaggagctctggtccaggtcctcacagaagaagagtctgtggtggtctctttgagaatgcctctttccctctggtctcaatggcctactactggcccaagtgccctcccaccacacacacacacacacacacacacagattcacacacacatgcatgcatgcacatatgcacacacgtgcacatagcatgtgtacacaca

SEQ ID NO: 395756 - DNA, 673 bp, Homo sapiens
gtagccacacatccctctcatccacagctccccggagccccagccaggctgctcaatggctgaggaattaccacactgccacatacatgccatggtctggcctgcttttgacttcatttgttggtgtgggtgggcactgtcacctgggcagaatcccaggatgattctgtgaataaccacagcagtccccagggcaaccaggtgggtgaagagaaccccaaccagtccttccagaggcccagccacaaacaacggatctggggcccggctggacctctggggtcagagttctaggacttggagtcagtctcacgtctgtgaggtgagggccaccagagacaggagggaagctggggagactctaggaagggatggcaacgctgcctagaagaacgtcccataggaagaagtttcagggatgtctggagatgaggcgtggtctggttaactctcccttggccagagccgtctgacccttcctaaaactctggggaggctgtggtggcaaacgtggccttgggagtgcagctcctctttgcaatcatccctgtgtttggatttccctgctttttcaatagcgtccactaatgcttagtgacacagctagttttgtcattagtcctattccatttcggtgatctcacgatctggggtccgagtcaatcgtatctgc

SEQ ID NO: 395757 - DNA, 126 bp, Homo sapiens
tatggtaagtctttctaatttatttaggtctgatttccttcatcagcattttataattttcagcatacagatcctgcacattataaatgtatagctaagtatttcttttttttctttttttttttt

SEQ ID NO: 395758 - DNA, 1218 bp, Homo sapiens
ggagtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagagcggagctgttcctattcggccatcttggctcctccggcttacattcttgtatgctttcagacttgaactgaattataccaccaactttcctgatttcccagtttgccaacagcacatcacaggacttctcagcctccacaacattgaaattaactgttcactaagaagcagaatgatcttcactggaacaacgaaataacggatgatctgcctttaataggataaaagccagtatttgcaaatataaaatactattttgagatccttgtggagttcatttttgtgtatggtcagaggttattgtcagtgttcattttttgccatatagatacctggttgttctaccatttgatgaaaggtattatcatgtccccattgaattaccatgacactttgtcaaatatcacttgaccctatgtatgaaggtatatttctggcctctgttttgttccattgatcttatgtgtatcactgtgccaatataaccctaccttgattactgaatctttacagtatatcttgatatcgtctagggtaagtgatctaaatgtatacttttgtttctaagtatttttgactttggttctttgagttctccatatacatttgataatcagtttgccaaatttctcaaaaagccctgctggatattgaatggaattatattgaatctaaatatcagtttggagataactgacatcttaataatacatcttccaatcaaatgcatacaatatatctcatttatttagataggtttgctttaatttattttagcaatgtttgcagttatctgttcagtattttatttaaattattcctaaatatttcttgatttttgatgctatgggaaacagtgtattttatttttttcattaatcattacttttgtagagagagacaatggatttttatatgtgaagcttatatgctgcgaccatgaccacgctaaactcactttttagttctgataaatttttttgtacatttcataggatttttggcatacataattgtgattatgtcacttataaataaagacaatattacttattt

SEQ ID NO: 395759 - DNA, 349 bp, Homo sapiens
acattctagttagcaaagcgcctcaggtgattttgttgcagatggttcaccagccactggttttcaaaacacccagtagaaagtggtgatagccagacataaagtgacagaaagaaaattttcaggaggagagggaagatactgaatctaattttggacaacagtgctagaaaagacatcataataaagaggaagaaagcatcacctgcataattatctataggaaaaaaatgaagataactatgccttcactattgtttgtattcttgaagtcctgtttttaatgtctcctgatactagtacatccttggatggccaattaggccaaaatcgttttacccccaaaaaa

SEQ ID NO: 395760 - DNA, 273 bp, Homo sapiens
aatgctgcaaacatccagatatttttgctagggttcaaagagtgaagacagttgttagaacagcaggcctggaaatgtgtgtagaacacataaaggacatggtgctgggtccctgatctgagggttcctagaccaactatctgtgaataatggtgaggctcaggcccatgagctgggggagaaccagcctggaccctgtgaggtggctgatcctctctggaaactgattcctaattcaaactctgagcagcctggctggaacctaaggttaac

SEQ ID NO: 395761 - DNA, 984 bp, Homo sapiens
tcctcttcttgcgttaaacaatagccctgaaacctcagcctctttctttcacctccctgaccatctgaaacctgacttttgtctgaagctcctctgtctccctcaggagtgggggtgagatcatggtctttcttttctcccatgccaattctagacatcagccaccattccctctgtggaaacctctgtcccttttacatgccatcttctacctcctggttgctgccatgtcttttgacctcctgctcgcttgccttccccccatcccccatggctttgttctctcctagcccttttccttcatgccaagttacccatcaacccccaccgcaatcctctgtgcctcaatggcttcagacactgatctctgtcttgaccacatcctccattctcctgatctttgacccaatcacttccaggtcgcctgatctttttttcttatattaaaaaaaaaatatttatggggggtggttaacaatttatacacagtaaattacatatcatttaaaatgcacattttgataagttttgacataggtatacatatatgaaatcattactaccatcaagataatgaacataggtactaaccccgaaagtttcctcgtcccccttggtaatcccgctctcccatcttttctcatctcatcccccagtccctaggcaaccactgatctgcttttctggcccttgtagactagcttgcgttttctagagtcttacataagtagaatcatgaagtatgtactcttctttgtttggcttttttcacttggcgtaattattttagggtttatttatattatttcatgaattaatagttcattccttctaatttctgagtagtacagtattccattgtgtggacatgtcataattccataatttattcaggtattgatggtcatttggattgtttctagcatctggggctattataagtaaagctactataaacatttatgctcgtctttgtgtgaacat

SEQ ID NO: 395762 - DNA, 368 bp, Homo sapiens
ttccaaatgaaagtgagtaaagcaagcaaaacaaattactctgggtgacaaggagatggcctggggattcctgaacaagaggatctgggggctccaactgccttgatggttttgtccatcagcaggagctgcatgtactccagactaacctcagcatcagcaaggccaggcgctgtctccctccctcccactgctgctctgttccaggcactgagggatctggagcctacgcccaccggggccccaggctccactgcctgctcccatctgggtcagtcctggcctgagatagaagatgatccttccaccatcccgacagtggatgggatagcccttggagtccaagaggcctcactgtggaatgaggc

SEQ ID NO: 395763 - DNA, 228 bp, Homo sapiens
gagttacatgggcggttgttttatatttatgcattatattatacatatgtttattttctctatgtatgttaaatatcacaactttaaataaagctaaaagtgttcctttatttttatcctccttatgttctattattttcattgaacagatgtaaaattctcacccatattgaaatcttcttatttctacctgagtgggtgctttatgcaactgtgtttctgttaatt

SEQ ID NO: 395764 - DNA, 375 bp, Homo sapiens
gatcatcccgccagcagttattaaccctagggtgctgagcagcatccccggcccccacccactccatgccaggagctccctgcctagtcgagacaatcacagacatccccagacaccttccagtgtcccctgggggcagaactgcccaggtgggcagtgtgggtctgggtgatggtttctctgctgcaacctctggccagagccggcagtcccggtggacaggtgtggaagggactgaccctgccaccccacggatctccccaggcttctgagttgctggcggttttccttccaactgcagtcccgcagtcctctcagccatgggccacacccccgggtctcagaccccgtgtttgttttcatgccaggaggcag

SEQ ID NO: 395765 - DNA, 588 bp, Homo sapiens
ccccttttagttttttatgtaggcagtcatatcatctacaaatagtaagaatatttcttcctttctaatccttatgattttgcttttctggtgttactgtgctgactttgactgatagaatctttgatagaatgttacatagaaagaatgatggtgagcactattattccttattttattttatttttattttttgagacagagtttcactctcgttgcccaggctggagtgcaatggcatgatcttggctcactgcaacatctgcctcctgggttctgattgcatttagacggtttgcctttgtccaaattccttcttttttaaacatggataaaagtattacatgggtccactgttaaaacagacaacatgtggcaaattaattctggtatcatgttttccgacaaagctcagaaaataaaggtgttgaggtggctttggactaagtttaatagtcatctcctctgctgacaacttctttacatgttgggcgcaacaggatggtatgttcaaattgcgctgtatatgatccttttatgtcacataatggtggatatggatctacaatggtctaaatgcaatcagga

SEQ ID NO: 395766 - DNA, 385 bp, Homo sapiens
agctcgccatttcacctgacagtccatttcttgcttagtttcagaattgtcaccactcacatcttgaccacattactctgagatgttaaaataattgacagcctcatccaaagccagactgactttagatacatcctcagtgcatctcccatgtgtccagctggtcagtcctgccaggctgctgtgtgttttgtcactattgcagagagcattcaagtgtgacagcgagtgggacttagttcttgggaaacaggagtattaagttaaaccccatgctaggtccaaatttcaagaccaggtgtaaggccagcggtttgcttttatgctcactcacagatatttgtttttaggcaaataaacaagtcatttatttatatgctgtttt

SEQ ID NO: 395767 - DNA, 319 bp, Homo sapiens
ctgtttgtttgtttttcgagacagagtctccctctgtcacccaggctggagtgcaatggtggcatgtgcctctaatcctagctacttgggaggctgaggcacaagaattgcttgaacctgggaagtcagaggcggagactgcagtgagcagactgcttcacaattatcgttagttcttgctctgcttcatttcattttgtttttctattggactttaggtgtagaactgtacattgggcaaaagtcatggtaagaattgagtgcctgaagctcgtagcttagctcagtgcctagcatggtatgagcactgagtcatcca

SEQ ID NO: 395768 - DNA, 394 bp, Homo sapiens
gctgggattacaggcatgcaccactgctcctggctaatttttgtataatatttttagtagagatggggttttaccgtgttggccaggctggcctcaaactcctgacaccaagtgatctgcctgccttggcctcccaaggtatggttataggcgtgagccaccacacccaaccataatagttttattttaaggtatcagtattcataaactcagaatttattctttgcagctttttagactgaaaattaaaagttttggatgtcaacttaaaaatatgcatgttatttttcagaaaaatcttagtaagtgtttaagcaaaagagtttgaagaacaccgttctagtttatactttgaaaaatactgtatccgaatcacctgtgacaatgttaaaaa

SEQ ID NO: 395769 - DNA, 292 bp, Homo sapiens
gaggaagtgtgacagtattgaaaaacaaaaaaacaaaaaaacaaaaaacaagtgcagctcagagaatcctaaacggagaacatactgaggaaaggtctttgcatcagaaaggggaactcacctccccccagtgtatgagttaacattgaggctgaggtggaaatatcttgttgctactagtaaatttaactaccagagatatcactcagctgctctgtggctttctagatggtgtcaaggatgcctatggaggaaacctcaagaatccagaccagtgcttggtaataattga

SEQ ID NO: 395770 - DNA, 477 bp, Homo sapiens
ccaccgtgcctggccaaacttcttttcttatcaattacccagtctcaggtgtttctttttagcagtgcaagaatggtctaatacaggagtgaaccatgaactgatcgttctctggtggacaaaacaaaggcatgctagcgaaggcagaaactaatatcattcatctgctttccaaactccaaagaggttaattcagtatcaaaaaattaatttctcaaaattcacagctgtttgctaaagttactcactacacttaacttcatacttgaatgctgttactatttattgacatcaaaacaaaacaagctgagactaaaagttgctatttaacaggaatagacatcggtgcagtttccttcctggagagggtaggcactcagatcatgagacctaagatcaaacaaactagattgtcaagaatccaacaaggactacattttacctcttaataaaaaaaatgctggagacaaaacaaga

SEQ ID NO: 395771 - DNA, 625 bp, Homo sapiens
tctaaagaggaaaggaaacagatgaatgctaatggcaatcatttaccaaccctatcctgggtaccacagaccagactaggccctctttatgcactatctcaatcaatctttacaacaagacaacacctcattaccccgttcacagcagagaattaggtggcgtgcacagggaggacagagaacaaggtgtgcagttggaaccggagcctggggactcaggatcccttccttggtgttcaccctgggcatgtggcccccgtgccggagaccagggagagccagactatacggtgcagccaggctacatggctgcactgaccctctcttctcacaaagtaagggctcaggaggaaaactgtcatggtctctgtcaaatgctggtgcaaagacacatctaatgataccacatgaacaaagatggtgtttccaaatgacagatttccttattaccagaagctacgctgaccaaaggaaactcttgggagggattcttacaaactttgcaaaatgtagtgtttgagtgtttctctcactgttaaaaaaaaaagttatgtcattaatgattttcaatcaaattccctgatcctgtctccatagccaagaacatagtggcaagatggcggag

SEQ ID NO: 395772 - DNA, 548 bp, Homo sapiens
cacgatttcattaatttggatcttatttttattatatccttcctcccactgactttggattatttcctccttttactgttttcctaaagcgaaggctgtaatcattgattctgaacccttcagcctctcttaagataggcattcaaagctgcaaattttcctctaatgctttagttgcatactatagattttagtgctacatatttatgatcattcatttccaaatattttatttgccttatttttatttttctcataagttatttagaagtgtattgtattgtttaatttccaaatatttaaggattttctgaattgtattgttattgaccctcgttccattgtggtcagaaaacatactttgtaaaattgcagttctttgagattatttactgagacttgttttctggtcctgtgtatggccaaacttggtaattcttcaatgtatacttataaaaataatatattttgcagtttggagctgtaatctcctctaaatctcatttaagtcaaggtggttaataaaatcactcaagtcttctgtatct

SEQ ID NO: 395773 - DNA, 1049 bp, Homo sapiens
acactataagactgatgacaaaaggtactataaacaaatatttcctaaagtcagtttgtcacaggggtctaggttagcaattctaaaaccatcttacatatacactaggatgggagcaatgagtatgctgtggagaatgagagcattttctcacttctggagaatggagtttcaaatgagcaaagggcaaataaacttgtggtgttggattggaactggaactgcaactgccagtgagtatccctggtttttaacatatacatacaggctggccgggcacggtggctcattcctgtaattccagcactttgggaggccaaggcaggcagatcacgaggtcaggagttcgagaccagcctggccaacatggtgaaatcccatctctactgaaaatacaaaaaatagctgggcgtggtggcaggcacctgtaaatcccagctactccggagactgagacaggagaaccacttgaacctgggaggcggaagttgcagcgagctgagattgcaccactgtactccagcctgggcgacagagtgagactctgtcgcaaacaacaacaacaacaacaacaacaacaactacacacacacacacacacacacacacacacagaggctgatgtagaaatacatatagatgtatacgtatgtatgttgaggtccatatattctctatctctctgtctgctaagtgggtctaggaatgatgatatcccatagcaggagcaaacctagcactcagatcttggtttctaaatgcctttctccaataaaaggaatcagggctctttggagaaatggttggttccaggtctagggcaggaaaattttaagatgagccatgagtgtcttgtggtaccagaaaataaggaagcacttaaaaaaaatggggataatattgaaaggacacaaaaacaaacttaaaggagtttccaatggtcaaatctgggacaatgtgaacaacaaaataaataagaatagtaatgaataataacttatggaataaatatacacagatccataatgatataaataaactgaataaat

SEQ ID NO: 395774 - DNA, 232 bp, Homo sapiens
caggagtcggggtgcaggaggctttctgcttggggcagtttctcagccctctccataaacctccagcccaagggctgttgcaattggaatcaaaggtggggtcagtgaactcctaggctctttgaccctgaggtggcctgttagaatctgttatttgtgttcatttgagtgagtggatggactcagtgggtaaagaagtgactctgtatgttgtatatgactttaagttgtt

SEQ ID NO: 395775 - DNA, 491 bp, Homo sapiens
ttcccttctctaaatcctggttataaccttttatcaataagcaataatttttttgtttaagacagggtttcaccatgttggccaggctggtctcgaactcctgacctcaagtgatctacccaccccagcctcccaaagtgctgggattacaggcttgaaccaccatgcccagcctatatatgaaaactgatcatgataatagctttaaaggaaaataacagattccacgcaaggatgatattcaaaatgtttcgcagtgcacacagcttaagcactgacccataaaaacagatgtcagtgtaatttgaatgaagactctgtgaacaattccacctggtatgaagtaactaaatagtactgctggtgctatgaagggagtacacctgtggactctgtagactttaattttgattagggaggtgaagtaagtgatatttgagctaaagcaaaaagatgagaaattagccaagcccaggagggaagggcaggga

SEQ ID NO: 395776 - DNA, 984 bp, Homo sapiens
cctatttaaattatgtatcttgacttaatatcttattgctttctaccttctataaggctaacatggtattttggaccaatccccttgctgaggacaaccaaaaagattggatgaagtataaaaagcacttacttgaaagcatcaaagacgtccaagatagtgaggaagtttaaagtcaagatctaggaaaagacaagaaactagagaaagaaacccagccgtaaaatcactttttttcccccctgcgggcttctgccaagtctggggaagcagctgcaaagctaaactatattttttgatgattcctcagagccggacaaacagaagtcagaaactaaaacctgccaggaatagggattcaggagtagggatttaataactcaagcccccttcgagctgagaatctgaaaggccacactctcaatatgaggagtagctgctaggaaaccagccctggcacagaattgtagtcagttttgcatcatttaacagtacaagtaaacttcaactctgacattatattaagatatttctggaatgataacacacactgctatttgcagcagcaaatgaatatcctctcaagagaaagacatcatcataacaggcctcagcacttcctccatatgacttataaaatataatttccatcatacaatgaaaaataagggtttacaaggcaacaagatcactgaatgagtaacagaagacagagaagctacaaaaaaagcctccaaaacatgaattattgaaatgatcagatatggttcacaaaataacgatgctttttacatttatgaaataaattccaagcttaaaaacatccgtgaaaaggaaactctaaaatttaatgtgacatattaagaaaaaaatccaaaaatataatactcaaaattaagatgggcttaagagcaaatgaaatgtagctaacatttttaaatggaagacaagaagaaaacatcctccagaatgcagcacacagaa

SEQ ID NO: 395777 - DNA, 349 bp, Homo sapiens
gctgctggaggctggagggaggaaggaaggagggggtgaaggctgaggggctggctgcctgtcaggtgctgtgctcactgcttgggtgacaggattattggtactgcaaacctcagcgtcaggcagggttcccatgtgacagacctgcacatgtaccccctgaatctgaaataaaagttaagccgggtgcgtggcttgtgcctgtaatcccagcactttgggaggccaaggcgggaggattgcttaggctcagaagtttcagaccagcctgaaaaacacagtgagacctcatctctacaaaacataaaagaattagccaggttgttatagcatgcgcctgtagtcccag

SEQ ID NO: 395778 - DNA, 405 bp, Homo sapiens
tatatcccaggaataaacatcccaagagacccacatatacacacagagagggagaaagagagagattgattttaaagaattggctcatgcatttgtgggagttagcaagtctgaaatctgcagggcagaccatcaggctggaaactcaggcaggagttactactgaagtcttgagttttcgtttttcaactgatggtacaaggctcacccatattattaagggtaacctcctagacttgaagtcaactgattgtagatggtaatcctagctacaaaataccttcagggcaacttgtggatttgtgtttgattaaatcacgggaactgtagcctagccaaacagagcatgacctacaaaaaggatacactgattcatgtattggggatagatgaagaataggaagg

SEQ ID NO: 395779 - DNA, 332 bp, Homo sapiens
atatattgtttaaatttcttccaaaaccaactatgttggtaataaagtatgatggctaagaacaatccactttgaagtcagaaatacctttagctaccgctaaagactgaatgtttgtgtccccccacccaaaatttctatgttgaaacttaatccccaatgtgatggtatttggaggtaggggccaatgagaaatgattaggtaatgagggcagagccctcatgaatggattagtcccttgtaaaagagacctcagagtgctcccttgccccttctgctgtatgaggacaaagagtgaaggcagttttctatgaaccagagagcaggctgt

SEQ ID NO: 395780 - DNA, 560 bp, Homo sapiens
ccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgc

SEQ ID NO: 395781 - DNA, 505 bp, Homo sapiens
gggtgagaggatatgcggatgaggggtattatcttgaaatgtggttccgagagtaaaactcagcaagccctctccagctgcagcctcctggagtgttttaggactggaaccgacctcagatcatttatgaagtctatgctttccgttatagaagagaaaactgaggcctatacaaagggctatgacttggcccaggtggcttaggccaggagctggggctagactattccaagctatccgccagttgagtttgtccacaaaccccaggcaggaagttgtctgacatacagacttagctgaggaattcctatatcctccacaccagagagaattctggaatgagaaagagtgccctttcaaatatgggcccttgctgggggaaggacagggccccttctctgggctggaggaatctgcatccattgtacttaccttcacagcccttagggctgcgtgtgcccatgcagtgtgagaacccaggagtgaagtcaccatgtgcttggtt

SEQ ID NO: 395782 - DNA, 183 bp, Homo sapiens
ctgaaaggatgttctcagatggcagaatctgaggatcttcagattattgcatctgaagattattatacaggatgttcagttattttgttcaaaaacacaggctaggattctgccaggaatattctttcaggaatggttagcttttttggatgataacagtttttcattcacctttcttcctca

SEQ ID NO: 395783 - DNA, 355 bp, Homo sapiens
tggtgggagaaccaggactcctgagcagcatgagaggaaggccggctggagggcagtgggattgcgccgtgctggatgaggtctgtttgcccctccacatctactctccacccggttcctgccccaggaggctgacctgtatgcatgcagggagcccttctatgcagtccgttcaggccctctcctggggtgctgtccctaggccaccttgactgcaggcacaggtaactttctcaatggatacgaacaccaccccaagtgctccggccagcacagtaaaccctgaattccttttcctgaagttggactccagcaagccttaggatccattctcctcctcctgacacccttagga

SEQ ID NO: 395784 - DNA, 313 bp, Homo sapiens
aaaaagttacaatactaaaatttttaccattagcgaaatgatttttaagttttaaatacatttaagagctgcctaggtagaaatatttgttaaagtaatacgtggttttgtggtcattgactattttaataagccagtatatcaatttaatcaggaacacaattactactttttcatggttctcctttcacaaatccgaaaagttcttcccagtccacacggtttggacacattttcaagtgttaaaacatattgttcatacaaaacaaacaagctctttagtcacaattttagttgaagactatttgttatt

SEQ ID NO: 395785 - DNA, 103 bp, Homo sapiens
cacgtaagcactgctcagcctctcccggatcagtatcattctgctgttgcagttcccagagaatcagaggtaaatggaggttaagaagctttcccagactcta

SEQ ID NO: 395786 - DNA, 489 bp, Homo sapiens
taagcggcctgcagaaagagctccagccgggtagtcaggagacctttgccagcccgatccgtccaaggtttctgtgaccttggaaggcaaatagctctatgggccagcgtcagcctctgcgtctgcagagaggagtgcttcacaggtcatgcttggggctttcaggaagcatgtaatagatatgcaaaggcattgctgttggtgaaacatccgtggaacaccaggcaacaaaccactaaaagcagcatttttcttgctccgatcctttaaaatatcgatggagataaactgatgctgctatttgtgttttccttgactatttccttacgaagccctgcagtcaccgaatgctcactcaaccttccttcaaaagtgattcaacgtgtggcctgagaagcggcagcatcagcctcacctgggcgttggtgagaacggcagcatcttggcctctcctgctgaatcagagcgcgctgcttaacacgctcccgg

SEQ ID NO: 395787 - DNA, 493 bp, Homo sapiens
ctgtataatcacagtatgcgttaatcttctaagatattaaatatttgttctcatcacagctaaaatgcaatgcaaatcccatctcagatgtgggtcagatacctatgaatctcctgaggtagtcattgaaatgacttttttttttcttgagacagagtgtcactctcaaccatgctgaagtgcagtggcgctaccccggctcacggcaacctccacctcccagattcaagcaatctgcctgccttggcctcccaaagtgctgggatcacagacatgagccaccaaacccaacctcccaaagtttcttaaccctaactgaatcacttgggagattttaaaacatacagatgctggggtgctacccctaactcaattctgaggatgggacctggacatcagcattttgaaatttttccctgagtggctctgatgtaagactcactactgagaagcagtgttctagactgatgcatcttacattttaatttgcata

SEQ ID NO: 395788 - DNA, 2534 bp, Homo sapiens
atggggcagccgagagagttctggcatctcaggtcccaggttccagttccaacctgccacctgctcaccgtgcagccttggtgcctgcttcctcaccccaccccagctggagggcgtgagcgcaggcacagtgcttcctccctgcttgcggctctgtgcctgaggaaggcggttctgcggccccatcctgctgtcctgcctggagttggagggtgtgtggtcctttcctctgggcggatgaaggctcccttgaggggcggcctggctctggggacagggccagctcccacgaagctgcagcttctccatgactggcagagcgagcctgggccgagtggctggcagcaaggcccttctccgcctctcttcccggcaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagcaaaaaaacaaacaaaacaaacacacacaaaacaaaacaaaaacaaaaacatacaaaaaaacacacacaaaactacaaaaaaaaaaaaaataactaacgacacaaacacaccgcgcaacgcgccgtcgacggtgcgaacgcgccagaccagagcccgcgagacagacaggcgggaggacccccaggccgcagcgagagcggtgagcgtcgtccgccgcgagctctggagacgggaaggcgcgcacgcgccggaccgcaggagcgggcggcggcagcgcgatgtgagcgcaacaacatgactagcacaacgagactgacaataggaactcctgacctgctcgacacgttgaacgtcggcactacaagagaccgtgtagccactctagcgacccacccactatcgtacccgtgagtgtgggccagcgggggtggtcaggagtagtcggtattcggcccagcggtgcgtcctgctgtcgtggaagttcgtagctgagaaggaagtgagcctacgacgggcgagagcggggggtggtggctcgtggtgtgccgccagggcgcgttgcttgcggcagctggcggccgcgcacgaggttgggcgctgtggtccaagagcgcggtcgggtggtggaccgtgcccgagtgcgcggctataggcgcccatcgagttgtcggaaccgtggtcgccgggtccccttg

SEQ ID NO: 395789 - DNA, 1840 bp, Homo sapiens
atggggcagccgagagagttctggcatctcaggtcccaggttccagttccaacctgccacctgctcaccgtgcagccttggtgcctgcttcctcaccccaccccagctggagggcgtgagcgcaggcacagtgcttcctccctgcttgcggctctgtgcctgaggaaggcggttctgcggccccatcctgctgtcctgcctggagttggagggtgtgtggtcctttcctctgggcggatgaaggctcccttgaggggcggcctggctctggggacagggccagctcccacgaagctgcagcttctccatgactggcagagcgagcctgggccgagtggctggcagcaaggcccttctccgcctctcttcccggcaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 395790 - DNA, 163 bp, Homo sapiens
  misc_feature (125)..(125): n is a, c, g, or t
agtgctgagattacatgtgtgagccaccacacatggccattatgcatactttgacatgtaaatgaaaaacaggaatgttttagacttcagtcttatttcgtatggccagtatgaaatgtctaatnggagttttactgcttaacaatgaaactgaagactccta

SEQ ID NO: 395791 - DNA, 247 bp, Homo sapiens
tcacctatatcagcctgtactcaacaattatcaccaaactttcaagtagactactatagtttctctacttcctttcactttatgctaagagatctaaacccagctcaattctggctcatcctctaaagagttctagaaaagaggcagctacatccttattaaaaggttgattgtggactagctaaagaaagaatcttaaagagaggcttgctctatgactgcttgttttcctgttagaatgatatct

SEQ ID NO: 395792 - DNA, 401 bp, Homo sapiens
ctgtataaagccctgggctcccaagacaaggaatattcacaatataaatattagacgtttgttttcatttcttctagattacttttcacataccttcagagttagatctatagcatctagctatttgtctacttaattaccgtcattcaagaagaccaaatattacagcccagaataggtccctagcttaatccctagatgataatataactagatcaccagcatcctagatattttcacttcaaaatgtatggaatctacaccttggaggtggctctaggtcaaaaagccagaaccattggatctacttgccctttgtaaagactcatttagattcctaacattaggctaagaactcaggatcctttccattccatatcaatacaaaacaaaaaaaatga

SEQ ID NO: 395793 - DNA, 406 bp, Homo sapiens
caaatagtaacatttcaagaaaatatatacaccttcacagtatgtggtggtatccacttactgtctactgcctccataactcctaaagtcttctgaagatttattaatgctttgaatatatgagccaccgtttcttttcacagccttttcacaactgggaattctttagagaaaggcaatcttacctcatttacttacttcatcagtaatgccattactatgcctacctaagaagaaaatatatcatgtggcagaggactagaaagaaaaaacaacaacaaaaggctgtgaagatttgatcatatgcctacgtgtgtggtgaatacaatatttctttaatcgcaatcaggaatataaatcttattttgatgctatgacataataaagtgcattattttcctgaaat

SEQ ID NO: 395794 - DNA, 116 bp, Homo sapiens
tgcgatcaggctgaatccctgctgaggccacatttccttccctacctccatgcctctatgtggtttactatacctagaatgctgttcactcccttcgcctgactggccttaacacc

SEQ ID NO: 395795 - DNA, 609 bp, Homo sapiens
ttcctgcatttttgtcagtccttttccagtctttagttaggcttattcattaattacattaattatatagaggacctgctccaaccccaaaatatacttaaaatccctatcattatgtgttatatttttaaaatatataactgaaccataatcagaggggccaaacttcaaatattctctaccttaaaaacctgaccaaaactctgtgacaagtcttcaatattgagggctataggtgtttttctttttctttttccaagcagcattgtgaatatattcataaggatttgaattgtgatttcttgataaggaatcaagacattgctgttgttcttgtcatttgaagatttttccatcaagtgtaacatgaacagcaaatgaactattaccctaatcttcacatttccacttgataagttcacatgtgaccattctgatgtgttttatagtataccatcaagaagatccagtaaagaaggttcacagcttcaaaagctttcaaacttttttaatgtctgttagttatgagtgaatttgcccaaattaataaacataactattaaaacacatacatagcaccactaataaaaaagactcgagccgggcgcg

SEQ ID NO: 395796 - DNA, 552 bp, Homo sapiens
aattacaatagtaacataataggtcactgatgagagatcaccataacagatgtaattaataataatgacaaattgtgaaatattacaagaattaccaaaatgtgaaacaaagtgagtacatactgttagaaaaaatggaaccaatagacttgtttaatgcagggttgccacaaaccttcaatttgtaaaaagaacagtatctgtaaaatgctaaaaaaaaaaaaaaaaaaaaataggcaaagcacagtaaaacaaggtatgtctatgtaagaaactgggtgaaattataagaaaggtatctgatttgcatagagcatataattgtcgtatatagaaagaaaaactcttcaaattcctgttgattcaattgtgaacagtataattttttcacattattaaattactcttttagcctgtgactaccttacaattgaatttgataattgggctttgtaatgcatcttattataggctagttatattgcataccatgagaatagaaacatatgttgaaaggagacaaattagaatagacaaaaattattacctatt

SEQ ID NO: 395797 - DNA, 418 bp, Homo sapiens
ccttctagatggaacttctcctatccactcacccaaaaagaaactgaaaggtactcttgactcctcctctcattcctttccacctctaagaaaggcctggcaaatctactttctaaatactgctacaatctactcacttctctccatcccatgtgtgagttccacagtccaagtcatctttaattattttcattcacttcaaaagcctcctccagaaccctcctcacctgcctgctgtaaagcccttactctgtcgcatcccctgattaacttctgtaattgccctcaccaccacctggaattgctttgcgtgttgatggctgtgtctcctcctaaaacaatgcttctgagagaaggagaacatcttgttcctggcttctcaccactatgtccccctagaacagcattcatggtacta

SEQ ID NO: 395798 - DNA, 124 bp, Homo sapiens
agattcagggaatatgctattttattcacagataggctctctgaaatgtttgcctgccagcctgaatccacattaaaggatgtccttaaaatgttgattaataaaattgaagctgctccagtct

SEQ ID NO: 395799 - DNA, 518 bp, Homo sapiens
gaatatgactcataaaaaatatggagttcaaattctaattcaaatgccttttcatatgaattggaattttaataaactagtaaatgttttaataaacattttaataaactagtaaatgtaccatgtaggtagtgttgtgaaaattaagtgaaaaaaccaatgaagtttgtaatacagtccataaccatggtatttacagttgctaaatatttattttctcttatatcctctctttaacactatctcagcagactttgtacctgaggctacataatgacaagaaaaataattagttagaaatgacactatgcaatattaaataattatagtcaatttaggcatgaattatatgcaataaagtagaataaaatgcagatataactattgtgtacttctagtgttaacttctaattctccctgattaagttatgtcaaaatgctgagccaggcatagctgaaggaaatagctttgttatgttcccagttagatcatcttctttcattttctggctcttcat

SEQ ID NO: 395800 - DNA, 476 bp, Homo sapiens
gccgcccagctgtgtgggagccaaacgtggatgtgtcagtggccacgccaggaggtaaaccctcaaccaagggcctctaggtgtccaaggccaagtcttgttcaagaggtgcgttcagctgagccaaccatggcagaaatgcataagggagatcccatggttcctctgtttaaatcctctgctaatccccacccgactcagagacggagccaagtcctcacagcagcctgccacccctgcctgactcggcctcctctcggctctgttctccatacccttctatccctctctgtctcttctcccaccagagaggagatcctgcacatttatcctggtggattcaaacccatctttgccatacagatagtcaccggaatgaacaggtataaagagtccttttgaaaaagaaaaaggcaggccaggcatggtggctcatgcctgtaatcccagcactttgggaggctgaggtgggagaa

SEQ ID NO: 395801 - DNA, 777 bp, Homo sapiens
acttccagttgctatggttacgagttgcaacctccagaaagaattcgtggtttcacccgggaaaacagctccccggattaaacggataggtttacacatactgatccacccagctattcatcttctgtttgctgctttaattgggtgcggttaaaaggccacgtccctaggcgttcaccggctttcttgccatctgctgcatgaaaactgactttgccgaaaaaattaacaaagaagagcgaaaatgacagaccgcaaccgggataagaaaagtacttcaccttcaaattcagacacagaaatgaaatctgaacaactgcctccttgtgtgaaccctggcaatcctgtgttttcatgtatgttggatccaaagacactccagacagccacctcactatcaaaacctcaaatgattatgtataaaaccaattcaagtcattatggtgaatttctacctattccacagtttttcccctgcaattatactccaaaggagcaagtattttcaagccatatcagagcaactggattttatcaaaataacactctaaatactgcacctgacagaaccagaactcttgattttcctaatattcaacacactctatgaaaatatattcctttgtatattgaagagaaaatatactcgggaaaaatgagtgttaaatctaagggtagaatacctaataaagaagataaaaagttttgaatcaatttttaaaataagttaaataaagtatttggcctcgttggcctcagcggtggagctctcggccg

SEQ ID NO: 395802 - DNA, 843 bp, Homo sapiens
acttccagttgctatggttacgagttgcaacctccagaaagaattcgtggtttcacccgggaaaacagctccccggattaaacggataggtttacacatactgatccacccagctattcatcttctgtttgctgctttaattgggtgcggttaaaaggccacgtccctaggcgttcaccggctttcttgccatctgctgcatgaaaactgactttgccgaaaaaattaacaaagaagagcgaaaatgacagaccgcaaccgggataagaaaagtacttcaccttcaaattcagacacagaaatgaaatctgaacaactgcctccttgtgtgaaccctggcaatcctgtgttttcatgtatgttggatccaaagacactccagacagccacctcactatcaaaacctcaaatgattatgtataaaaccaattcaagtcattatggtgaatttctacctattccacagtttttcccctgcaattatactccaaaggagcaagtattttcaagccatatcagagcaactggattttatcaaaataacactctaaatactgcacctgacagaaccagaactcttgattttcctaatattcaacacactctatgaaaatatattcctttgtatattgaagagaaaatatactcgggaaaaatgagtgttaaatctaagggtagaatacctaataaagaagataaaaagttttgaatcaatttttaaaataagttaaataaagtatttcaactgataactacatgacagtgactttttaaatgaaaatatgttcaaaatagcaaaataaaaggtggcctcgttggcctcagcggtggagctctcggccg

SEQ ID NO: 395803 - DNA, 646 bp, Homo sapiens
caggtgtatgtgattttaagggtagtcttcaacgtcaagagaagagaccaccaaacaggctttgtgataagaaaagtacttcaccttcaaattcagacacagaaatgaaatctgaacaactgcctccttgtgtgaaccctggcaatcctgtgttttcatgtatgttggatccaaagacactccagacagccacctcactatcaaaacctcaaatgattatgtataaaaccaattcaagtcattatggtgaatttctacctattccacagtttttcccctgcaattatactccaaaggagcaagtattttcaagccatatcagagcaactggattttatcaaaataacactctaaatactgcacctgacagaaccagaactcttgattttcctaatattcaacacactctatgaaaatatattcctttgtatattgaagagaaaatatactcgggaaaaatgagtgttaaatctaagggtagaatacctaataaagaagataaaaagttttgaatcaatttttaaaataagttaaataaagtatttcaactgataactacatgacagtgactttttaaatgaaaatatgttcaaaatagcaaaataaaaggtggcctcgttggcctcagcggtggagctctcggccg

SEQ ID NO: 395804 - DNA, 391 bp, Homo sapiens
ataacaaagctgcacgtgtaccccctgaacctaaaatataaattaaaaaagaaaaaaatgaatatcaataagatacttagtaaacacacaagtgtttggaaatcaaacaacaaacttctgaataattcacaaagaaacatcaaaataaaacttagaatacattttgaattgaaagataaacatctgaagtgctgaaagaatagagatggctttagtctcgaaacttacatataaaaacattgaaatttcaatcagatggcaattggtatgtgatttgataatctactttaaagtttatacgaaactgagaacccggttaggtgcggtggctcacgcctgtaatcccaggactttgggaatcagaggtgggtgcaacacgaggtcaggagtt

SEQ ID NO: 395805 - DNA, 166 bp, Homo sapiens
attagccatctttaaaatgtgacattttcatgtaagcatcctctaactgctcctccctcaaatacatcagaaacttctctcatatgctgtataatcttctgtgaaatacagttccacaatttgcaatcataaacgctgataattatttgattaatgttgatcttcc

SEQ ID NO: 395806 - DNA, 573 bp, Homo sapiens
aagtcaataaacttttactgaacacttgtcgtgcgctagtcattgtgatagtggcgatgatgaagtgatgtatggttcttcttttcaagaagctttcagtctagtggtgaaagagcacagacatgaatgatacttggaatacaatgggatctcttttacagctgagatactttccaggcaggctgcagggagttggtgccagatagtcctggattcataatccctattgcttctaacaataaaaggatctcaaccagatactcaatctcatccatcatcaatttgcctctctgttagagataaacaatgccacctcataggactgttttgagatgcaatagacatcagaattgatatatgagatttaccagactcatatcatcaaggtgatctgccataacttgcttaaccattgctctgtgcctgatgaaaaaactttgccagagtagtctctctaccactctgaatcccttgtcccttgctcacctcctcaatggcaaccactccccttaacccctgtatatcactccagagatattttaatatttaatatatatgtatatattttttaaa

SEQ ID NO: 395807 - DNA, 794 bp, Homo sapiens
accccgcctttagctagtggccaagattcgcaaagcctcgcggcgaggaaagcacgagtattcaagcgcggctgaggccctccttggctagtgctgggacatggagccccggcagccaaggccaaccttgtgcattccgcccacgtaggcgcctggggccctggtcttcctcgactgcctctccactgcctggaggtcatcaaatgcccctggaccacctcctacgtgccacacgctgtgttggccatccaaggttccatattgagcataaaacagccctctgccctaaaggagttaacctgttggaatcacatacaaaggattctgactaccaagcgccttgaagttaagttgaactctgaagacagattgcctggctacaaagctcagttccactacatatggtccaggaacttaagacaaattattttaatgtctttatgtttcactatccgctgtagtgaaatagaataatacctactcatggcctgacgcggtggctcaagcctgtaatcccagcacttcgggaggctgaggcgggcggatcacctgaagttaggagttcgagaccagcctggtcaacaagacgaaaccccgtctctactacaaatacaaaaaaattagcagggcgtggtggtgcgcatctaatcccaggtactcgggaggctgaagcagaagaatcgcttgaacccaggaggcggaggttgcagttaaccaggatcgcgccattgcactccagcatgggcaacaagagcgagactccgtctcaaaaaaaaaaaaaaaaaaaaaaaagc

SEQ ID NO: 395808 - DNA, 854 bp, Homo sapiens
ttactgactgacttgagatggagttcatcttgtggccaggctggagtgcaatggtgctatctccgctcactgcaacctccacctcccgagttcatgcgattctcctgcctcagcttcccaaagtgctgagattacagacgtgagccaccgcacctggcttttttttgtattttcactagagatggggttcaccattttggccaggccatctcgaactcctgacctcaggtgatccgcccacctcggcctcctgagtagctgggattataggcgcgtgccaccatgcctggctaattttgttgtatttttattagagacagggtttcaccatgttggccaggctggtctggaactcctgacctcaagtgatctgcctgcctcggccttccagagtgttgggattacaggcgtgagccatccgtccggctggaatgctattcttaattgacctgcatttatttatttatttatttatttggcaagccttgaggaagggatttggggaatgaacaatggtacttgatcaaataatccttgtactaggcaatcacagtttctagggccactgtacctggccatgggggttttattgataataatctgtaaggaacaaaagggttagtactatcggaatttttgattagatgtagtgagcattaaggacatatggaaagtagtttgaagtaaaatatatacagtataagagtcagaatcagccaggcgcggtggctcatgtaatcccagcacttcgggaggccgaggtgggcggatcacctgaagtcaggagttcgagatggcctggccaaaatggtgaaaccccatctctagtgaaaatacaaaaaaaagccaggtgc

SEQ ID NO: 395809 - DNA, 648 bp, Homo sapiens
attgtccatttcctgggttcaaatgattctcatgcctcagcctcctgagtagctgggattataggcgcgtgccaccatgcctggctaattttgttgtatttttattagagacagggtttcaccatgttggccaggctggtctggaactcctgacctcaagtgatctgcctgcctcggccttccagagtgttgggattacaggcgtgagccatccgtccggctggaatgctattcttaattgacctgcatttatttatttatttatttatttggcaagccttgaggaagggatttggggaatgaacaatggtacttgatcaaataatccttgtactaggcaatcacagtttctagggccactgtacctggccatgggggttttattgataataatctgtaaggaacaaaagggttagtactatcggaatttttgattagatgtagtgagcattaaggacatatggaaagtagtttgaagtaaaatatatacagtataagagtcagaatcagccaggcgcggtggctcatgtaatcccagcacttcgggaggccgaggtgggcggatcacctgaagtcaggagttcgagatggcctggccaaaatggtgaaaccccatctctagtgaaaatacaaaaaaaagccaggtgc

SEQ ID NO: 395810 - DNA, 539 bp, Homo sapiens
cttttcccctcaaacatgcagtcatgtacaaaaccttacctaaaattttagaggacttctggcccctctgaagccctttgtagggccctggtaaagtaatcctggtatgtaatagagaagtcctgaaccagaatcttgggagaggcatcttttagggagtgaagataggaaaggagccagaaaacggaatggttacagaggcgagggaagagcctggaaaggattaacaggatgtcatgggtgtcagtgctgggagagctggggagatggatcacaagctccctagggacctgaccctaactgacctgcttaaagtcgggacctccttttattatctttgcaactctagtgcctagtccagtgcctggcatacgtttttgttttttggggtttttttttctttttgagcctttataaatcttagaaaatgatctcggggtgacggggtcaaacaccagtttgcaggtgtttaaaggaagcatagttggtttaaaaaagagtggcaggcatgtcgagggaaggaagtttttaccttagaa

SEQ ID NO: 395811 - DNA, 371 bp, Homo sapiens
ggcgctcgggtgccccacattcccaactgctacagacacaaccaaagcctccccatcccttcccccacccctgccggcaatcgcgtacaggagtgagcgtgtgacttcttgtccacatttttgtccacaagtttggcgagtttgcatccgtgtctaataaagaaactaccgtttctcacgcaggcacgttctgaacgcccgagtgcgggagccacgtaagacccggctcagggaccccgggtgaggccagctgcacatgcaggatgcaggtcctcaccactgcctccgctcggctgccagggctcttcctagaagacacgggcctctcctaggctctcctgactgaggccctacccctgcccccgagtcac

SEQ ID NO: 395812 - DNA, 286 bp, Homo sapiens
agggaaggtcacttcatctgcgcagaccatttccaaataaggccccattctgaggtttctgggggcatgaattttgaaaggacagtgtcaccccaggatgcgaggtgacaagccaaccctccggaggtgcttggtggcataggtgaggtctcagtggccctagaagtatttgttccgtaagagcctggcgaaagcttggccaaagcttcccaaacccattcagggctggccgcggccctctcccttcttcttccaacccacattcaccaaactctgactgtggacc

SEQ ID NO: 395813 - DNA, 221 bp, Homo sapiens
tactaatcaagatgaacagaatgcataggatataaagcatactgcatataaagcaatctcccctccttgacatatacatgaatgggcatgggtgtctatgtcttatgaacatgtaatttattaggcagtatgcaaaggggttacattcttattggcagaagaatagacatcctgggagaatacaataatccaaaattagactgatttaaaaaattaatgta

SEQ ID NO: 395814 - DNA, 197 bp, Homo sapiens
gggcagggaagccacattagcctttctgagggccaggattcccaaagtcttctgccagggacaggacagcttctgcttaaaacactttctgcaccctccaaaggccttctggtcacccagaaacatccagctgaggtcagagcaatatcagcactggatccaagaagggatgggctgagtagaagcctctggtccag

SEQ ID NO: 395815 - DNA, 463 bp, Homo sapiens
gggggtccactagctgctgggcactggattacaggtcttcaggggtgtgaggggagcaaagtgggagaaacccaccagcatcaccacccgtgttcctttaggtcagggtgctgggtccagtcctgattccatcttcttacaagttagggagctgggtccaggcctggatccatgttattatgaatcaggaagttgggtccaggcctggctccatgttcctgcaggtcagggcaggtcttcccccgagtgatggctcttggactgtgctcctctggggccctctcaactctgtgtctgtcatctgtcacctgcctggccattatggttttgatggcagtggatgggctccatgggacttcaggcctggggtgagactcaggaccctggggtgagcatggatggggatattggacccctgaaagaagggaagctgagagactttttttcctttaaagacttttcc

SEQ ID NO: 395816 - DNA, 101 bp, Homo sapiens
gggagtcatattttgggagtatgagtggggcggagacaattcaaactcttacagagaacaaaaggcaggttaggggaagggttacttctgcaagtgggttg

SEQ ID NO: 395817 - DNA, 428 bp, Homo sapiens
tgttctccccccaggctgtcagctcgggtgtggtcagtgcctgccctggatccacccctcacccccgctccatcacatcacctctgccctccagctggcccctgggaaagatccagaacactcactcaccgtaaggcgcgggtggctaaggatggctttagtcttcatcgtttccgtcatgcctacttcctgaaagcacataacacgtgcaaaggggcaggtagggagaaacaaaagaattatctaaaaccaagaaagagaatacaaaactatgccaagagccacaaaaaggtaatatggttgtgcatggtggctcatgcctgtaatcccaagactttgggaggctgaggcaggaggatcacttgaggccaagagtttgcaaccagcctgggcaacaaagcaggatcctgtctttattttaaaaatta

SEQ ID NO: 395818 - DNA, 302 bp, Homo sapiens
agccatgcaaaccctagggaacatcttatctgacagttcttgggatccacagtggcttgggtcataatgataatactgtaactgggagagctgatgtatatggagcactcagtatgtgtgaggcaccatagattctctcttcatttaatcttctcatgagaaatacagacgttaaataattttcccagggtcacataagctggtactaggaatgaggcttaaagcagggctctctaagaacaaaagctgtgatgccttagcatcattgacagcagctcccaggtcttactcatcctagtgca

SEQ ID NO: 395819 - DNA, 591 bp, Homo sapiens
ggatttttatgaggagtaaatcgaagcgcagagaggttaaatatccagaagtggaggagctgggattagaacccaggcatcctaatttcagtgcagagaggctggtttaggtggagtcagaactgtgaaatgtcttagagagattccattttatcttggaggtgtttgagttgcctgttgactttttcacatgctttctgcgtattcagcacctctgccttaaaaatctattgcttccagggctcactaggcataggctggtgggtaatcatgggatggtttcaagcaacaaatatttattgagctgtgggtcagtcagcgggcaaatagagaagcataagacatttcactgccctcaacagggaattgacgtaatatattaggttgccattaaaaaaaaaattggcaaagaccacagttacttttgcaccaacctagtaaatgaaattttagtatgattgttctggcagaatgaatttggagcagaggaaactagcagtactgtgattgtgaggtgataaaagtctgacctgttagactggaataaatgggcatatttgagaaatttcaaactttttcccatctgtgaaa

SEQ ID NO: 395820 - DNA, 350 bp, Homo sapiens
ctcaacatcggggtagtctgaatgctcattcgctctctcttcctctcatattgagccattgaagcttaatctgaaagtacctatgcacccaaggaaaatacagggacaaaaatgaacgatggaaaaaatatatggcatctttagaacaaaaatcaatttaaattaaaaccatgtaatattaacacagggaagaaaggagagtgagtagaaaactctttaggtttttggcttgctgcttttaaaattcacattctaatagtgtattgtttcagttattagaatgatatataataaaaattctccattcctctgatatctgattaaattacttcacttcctccttttttttg

SEQ ID NO: 395821 - DNA, 607 bp, Homo sapiens
cttttttttcttttttttttttgcttttcagaaatttggacacagtcatactccatcttgctttcatccactcagtgacttctccagcctaaaagccctgctttcctccagtggttccctgaagtttccagaaccctcttccatcctgcccaccgttcccctagggctctccagtttgcttcttaaaggactcacgcagccattctgtgtggttggacccaggcagggcagagtcctggggcaattaccaccaagatccctacgcaaatatttgctaagtgcccaacatgtgccaggcacttaaaaatgagtaagactctgtacctgccctcagtaaggtcacataattccattcatgcagcctaattaatgattttaacatttgtcttagggtcgtagctcatatggaacttggagtgaattaaagttcacatacattgcagtcaggccacacttatttcttccaacctaagttcagggctttacagaggcccctgttaacttttattatttattattgttttgatttttgccctattcacataaccaacataagaactatggcaagatattgttaaaactacagcagttacatagaaaaaaaaaa

SEQ ID NO: 395822 - DNA, 241 bp, Homo sapiens
cagtttttgtagagatggggtttcaccatgttcccaggctgttcttcaactcctaagctcaagtgatctgccagcttcagcctcccaaagtgctgggattataggcatgagccactgcgcccagccaggaatctgtatttttaatcttaagagagtctcgtatccagtctgggagcatttgggctacatgcccaaaggttaactgacaatcaaataaattaaggttgtacctttttttttt

SEQ ID NO: 395823 - DNA, 331 bp, Homo sapiens
aacctcacttgtgggacaagacttagaaattactactgccctgagacaccatttcttcacgcatcagattggcaaaaacttcaaccgtaagatgacactgggtcgatgagtttttgtgaaaacaggtactactcccagacactgctggggggagtgtaaatgggtagaatccctatggagggtaacttgaagatatctaccaaatttaaatatagacttgccccttgaccccaactcctactttttggaaatttgcccttcagatatacttataaaaaataatatacatataggggttttcatgaccatttcggaggcagttgcaaaagag

SEQ ID NO: 395824 - DNA, 296 bp, Homo sapiens
tgagaactgctgatctaaacaaagatttgatatttgttatttttctgcttataaacctttgatgaccaaggataatatctaaactctttactgtagtacataacggtccttcatcaatttcttacagtctattttcttttcttttcttttttttttttttttttggggggggggtttggccttttgccttgggggacggggggggtttctttttaaaaaaaaaaaagtttgatggaatggagggccttagtttccaaagtttttaagccatttccctaaatagggctaaattttgc

SEQ ID NO: 395825 - DNA, 795 bp, Homo sapiens
accgcctccaccggcggactcgtgagcgcgccgctgccgggaccgctcctgggccttagagaagacgcggataagggccaaggaaagagggaggtagcggttgctgagctccttcggcgcttcggctcctgtagctctgactattcggaccgtcaaggtagaataggaggcggccagttccccgctctaagaagttgcctgcgctctgagagacaggtgccgctgtgttgcctaggatgatctcaaaccactaagctcaagcaatcctcctgcgtcgactttccaaagcgctggaattatgggcgtgagccactgtgcccagactcgttcaaaacaagccatgactcctcagcaaaacagctccatcaagcgtctcgccaacctctcccttggggctcagtcaagggaatgaaaaaacgaggctagacacctgtccccaacggaaaaaccaagaacacacctggagagcagctcagacaaagggagccaggcggggaaaacagtaattggagaggagaccgtgcttccagtctgttgctggtttacaaggtaaatctattcctggacgaaaggggtacaggaacagcacccgaaaaccggcgacaggctgtggcaggcccgacgtctttcaagcccagctcctagcgtcgacgcccctccttccaagacgtttcccagcagggccctgcgcccagtttggatcaagacaatctatgcaggaagaatgaatggggtgattgctggcatcttgaaaagttgaagctgattgaattgaagaatggggattacataccg

SEQ ID NO: 395826 - DNA, 832 bp, Homo sapiens
accgcctccaccggcggactcgtgagcgcgccgctgccgggaccgctcctgggccttagagaagacgcggataagggccaaggaaagagggaggtagcggttgctgagctccttcggcgcttcggctcctgtagctctgactattcggaccgtcaaggtagaataggaggcggccagttccccgctctaagaagttgcctgcgctctgagagacaggtgccgctgtgttgcctaggatgatctcaaaccactaagctcaagcaatcctcctgcgtcgactttccaaagcgctggaattatgggcgtgagccactgtgcccagggttattttaaaagaagaggaagaagaggaggaggaaggaagaaaaggaggaaggaggagaagaaatcatatgtggctcacaaaatttaaaatatttacactcctggctctttgcaggaaaagtttgctagtttgctgacccctgaaaactatatatcacattttgaattttttgtattctgctggtgtattaggtgtaagaaaaagaaccactcaaactattttcagcaaaaatgaatttaatgcagggtatcaggagcttataaaatcattgggaagtctaaaggaatggtcacttagcaggcctccagaaatgattcctagagcaagtctgctggatggtctactgaggagctgccatctctgcaataatcagaaaggcaggcaggcagagacctccagtggagtgttgagttcaaagacatactgctgtacctgtgatccaaggatcaagaggccactgctgcccctgctacttcctctaaacaggcacaggggtaggacctagac

SEQ ID NO: 395827 - DNA, 299 bp, Homo sapiens
tttttaatccaagcagtcgtgtgcttctatactttatcttaaaataaaacatcaactccatcacagcagacgccagcttctctatcctttcatctgaaacaactgggctgggtaaaagaataaaaggtggctcgttaccttagaatgatcacagtgacaccagtccaagcagagagcagagactgcttatgtccagtctccagaactagactgtgagctccttgaaggcagatagtttttgttctatttccttctaatatctcattttctattttctgcgactgcttggattacaagtt

SEQ ID NO: 395828 - DNA, 520 bp, Homo sapiens
aagtccacaaaccagactcaatttcgagttcaaatgacttaatctaggcaagatggtagctcgataaatattaagcacatttctgatttgcaagaagcttccttcaactgtcatctgaaacttaattgaagcaggaatttatattttcagaaaccactatactaaattaattccatggaacacttactactctcagaatttgtcttattacatataaccaaaccgctgaaacattgttcttagaagcctagaatttgaatacaacaacacgaacaacaacaaaaaatatagttttttttcccccagttcctaaatttctgacttcggacaaaatatgacagaacacccacactcattttccctcgatcaattcatcctcgaagtcaactggtattcaccaagtgcctggtatgagccaagcccagttctgaggctgcgtagatgcatttcccacttgtcacggagctcacaccttatgtcaaccaatttgacaaacaaacaaacaaaaaatcaacgtctt

SEQ ID NO: 395829 - DNA, 585 bp, Homo sapiens
ggggagcctccacacatccttccaggcagatctaaaatggctactcttgagacatgagcaaacatttgtcacatgatggagacagcaaggaaaagggctaagtaggggaagcagaaaactactttctcccttgggaaaaaactgagcagaaagccagacgtcttctggttctgactcatctcttgggcatactctgcaaaagctatggcgaagagtcagtgaattagaagattcactcagagtaactttttcctaccctgcaagtacctaccagccctggaggtgcctatatgagtagtacttcttaattggattcactctatgtttaaggtaaatgcttgatgttaataggttagttctagctccctactgggtataactcactgctcttctttctatcattattattattattattaaggcaagggtctcactgtcgcccaggatggagtgcagtggtgcgatcacagcttgctgaagcctctacctcctgggctcaagcgatcttcccacttcagcctcccaagtaactgggactacagggtatgcaccactatgcccagctaatttttatttttttttgta

SEQ ID NO: 395830 - DNA, 251 bp, Homo sapiens
ttaaccaggaaaaacagagtttggctaaaattgagaagtatctcaaattgatttttaaagcctattgagaaacacaagaagaggtatatgtgtgaggttcttctttgaaagagtattatgttttgaattacttttgaaattaaaagaccaataactcatgaaataagcagtgagtatgtagttagaaatataaaagagacttataaaagatggatcgtctatatgacaagtttttgtcatacctccttaga

SEQ ID NO: 395831 - DNA, 374 bp, Homo sapiens
ggtcttgaactcctggactttggcctcccaaagtgtgtgagccaccatgcctagtccatgttgtttttattttgtattacttttttaaattttattattattactttttgagacatggtctcactctgtcaccaaggttagagtgcagtggcagaatcatagctcactgtaacctccccctcttgggttcaagcaattctcctgcctcggcctcccgagtagctggggctacagatgcacaccaccacccctggctgtgttttttattttttgtaaagatggggtttcaccatgttggccaggctggtctcgaactcctggtctcaagccccgccccatgtcttttttttgtttttttggtggtgctggttttt

SEQ ID NO: 395832 - DNA, 464 bp, Homo sapiens
atcatcccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggagaaacccactaaaaatacaaaaattagccaggcgtagtggtgggcgcctgtaatcccagttacttggggagctgaggcatgagaattgctggaacctgggaggtggaggttgcagtaagcagagatcgaaatc

SEQ ID NO: 395833 - DNA, 235 bp, Homo sapiens
atcatcccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatagagattaaggatagagagattaaggatagagagattaaggatcgagaggattaaggatagag

SEQ ID NO: 395834 - DNA, 636 bp, Homo sapiens
accactaggccctgacccgactacatacttccgaagtgtcaacaactgctcacctcagggcatctgctgagaacaccactccagttgaaataagtggacaaaaaggaaacaaacttccctaagaagcaggtttcagaagcccccgcaagtccacagtgagaggcaatggaaaccaccctgtgcacagatctcaacgtcactgcccacagactgcagaagctctgctcctaacacagcttccataccactagcacaaaagtgccgggagatgccagaaacaagggcccaaggaagaaacagaaatccacacatggaaaacagaaggaaggcaggccgagtatgtcggctaccgccaggcaaatttataaactctgagggaaggccagagcatctcaggtgccccttcctgagtagagcagtggtatgcacaggtggctcctctctaacccccaaagtacccagattagcctcctgactaatggtgatctctccctgccaagcgttaagtgcaaaggtctgagactccacaaccagcatgaattcaagcggaaaccaaggtgaggctctctccaacttccttccctctctttggtaaatcgaagtactagcggaagtatgtagtcgggtaccgagccg

SEQ ID NO: 395835 - DNA, 271 bp, Homo sapiens
tgaaggttttattctccagaatctgttcaataaaccaatttgatttttataacaaaaaatgtgatacataatttgctcccccattcagtagagattctggacaatggcatcacagaatattggagctagaaagaaacttaaagattactttcatgttattttactgatgagaaaacagatgcccaaagaggaaaaataataactttaaggtcaaaggcaccctgtgggagaggaaaagtaatcaggatggctaacaggccctgtggagaag

SEQ ID NO: 395836 - DNA, 325 bp, Homo sapiens
agaaatgtagacatacgtatacaaaaagctcagaagtacttgtaagatacatttcaaaatgaatatcatcaaggcatatactcatcagaccatccaaagtcaactgaaagacaacactctaaaatcaagagaggtgcatcaaatcacctctgaagaatattccatcagactaacagtggacttctcggcagaaatcttacaagccaaaagggaatagggccctacttgtattcttcttaaaaaaatgaacacccaagaatactgtatccttctaaactaaacttcataaatgaaggagaaataaagtatttcctagacaagcaaa

SEQ ID NO: 395837 - DNA, 487 bp, Homo sapiens
cttctttttcttttttttgagatggagtctcgctctgtcacccaggctggagtgcagtggtgcaatctcggctcactgcaacctccacctcccgggttcaagcaattctcctgcctcagcctccagagtagctgggattacaggtgcccaccaccacacctggctaatttttgtatttttagtagagatgggtttcaccatgttggccaggctggtctcgaactcctgacctcaggtgatccacccacctcggcctcccaaagtattgggattacaggcatgagccaccacgttgaccatgaagttaagcaccttatattctccatagcactcacttcaatctaatttcctgccccaagcttctccatttccccagaatctcttgaaatttggtcaacttttagggtgaattacagcaactccaggaaacatttctcagcactgaaactggtggataaatgcacctacaggacttcaaattcgatga

SEQ ID NO: 395838 - DNA, 599 bp, Homo sapiens
taaattgtgtcccccccaaaaatataacttgaagtcctaatacttcatatctgcaaatgtaaccttattttgaaaagggtttttgcagatgttaaggtgaggtcatactggatagagtaggttagggttcttaattccttataactggttttcttataagaagagggaaatttgtttttgttttgttttgcttatcctggcttgctttaagctttagaagaagagggaaatttggacacagacacacaggtagagtgtcgtataaagacagacacacagacacacagaaggaagacatgcgaagatggaggcagagactggacttgtgctgccacaaaccaagggatgcttggggctaccggaagcttgaagaaacaaggaagggtcctctcctgaagactttggagggatcatggctctgccaacaccttgatttcagacttctagcttctagaaccgagagagaataaattttggttgttttaagccacccagtttatagcagtttcttacagcagccacaggacacttaatccacaagcctttggagtcagtcggcctgcgtttgaatcctgggtttaccttctaatgctgtgatc

SEQ ID NO: 395839 - DNA, 494 bp, Homo sapiens
tgggatttctggtttgttcttgcagttgatctggagctaaaattcataatcggaaatggtattgtattttgaattttagttactgcctgttcattgctctgaagcagtgtttttctccccccaactttttttcctttgtgcttcagattggataattgccatcaatctctcttcaagttcacttagtcttacttcttttgtttccattctgcttttaagcccagtgaattttttatttcacatgctgtgtatctcagtttgatgaaggccaatttatcactctactgcttttaaagtaggctcacaaaatctaacctaagtgaggtttcacctcttggtctgaggctttttttttccattttccaattaataataagttatgagtaaatattatttataataaaagacaaagtctatgccactgctttccattttcaggactacctatggaaacctttgctttccagtctgatgttgacagaccattttaacca

SEQ ID NO: 395840 - DNA, 418 bp, Homo sapiens
tccctatctcattctgcaacagctatcccatcccatctctctattgtttgctgcatggtctcacacatgacatgtgaaaatctgactcaaagttctttatcttgaagctgtgtttatatgttccgtgtgcacataaaactcaactcagttactattcgtccttttccttttagctacgctgtcaaatcaaatgtggtttcaagataggaaggggctgtccagtttctaaatccgccaagacaggcacacttccagcttcattgaaagttggtcttgaattcctggtcactacgtctgctctgagtagtgcagcaaatgttttcaaaagggttcacagtttgcttctcatggaatcaggttatggtagagtccttcagcttagccaattcacagatctttgcagaatgagattaaaaca

SEQ ID NO: 395841 - DNA, 421 bp, Homo sapiens
catgccttcaggcactctagagatcccctggactccctatcagcctagtggaacgttcttaaaatggcgctgcagtctgagactcttcctaaccacttgtcttcttatccccctctcctttctcagggatcagacttgcagtgttgtctgaaggctcttcctgcctgttctttcttcctcttctttatccttcttaggcccaataaatctcctgcacttataatcccatcttgacatctagttctaaaaggacctgaactgacacatgaagaagaactgacacatgaagtagagggaagtatactgttcccaaatatacttccctctattctgtaagaaggattatatatccctgcctattaccatgtgatgtgttcaggccagtgaaatgtgagtagaagtgacatggccgttttaagca

SEQ ID NO: 395842 - DNA, 693 bp, Homo sapiens
gtttcatgcacttcctactgcattctcaccagatgactctgcctcctagagagtcatcaaaagggagctcacttgtagtttccaacagtccacaaacccactcgtacttatatctctgaatataaggaaagaaggcagttgcttattgtttattgcaatgtaaactccaagacaagataggctaccttccttgtctgtttcattagtggctacatccccagggcttagaacagtgccttgttctgccaggcgcggtggctcatgcctgtaatcccagcactttgggaggccaagggaggtgggtcactcaaggtcaggaattcaagaccagcctggccaacatggtgaaaccctgtctctaccaaaaatacaaaaattagccaggtgtggtggcaggtgcctgtaatcccagctgctcaggaagctagggtgggaaaatcacttgaacctgggaggcggaggttgcagtgatccaagatcaagccactgcactccagtctgggcaatagagcaagactctgtcttaatttttaaaaataaaaataaaaaagtccgggtgcagtggctcacgcctgtaatcctagcactttgggaggctgaagtgtgcagatcacaaggtcaggagttcaagaccagcctggctaatatggtgaaaccccgtctctactaaaaatacaaaaattagccaagcat

SEQ ID NO: 395843 - DNA, 440 bp, Homo sapiens
attttccagaatttagatacacaaaatcaagaaacccagtgaatcccagacagaataaataaaaagacatattttagagaaactacagaccagaagagacaaaagaagctctttgaagtaagagagaagagatggactatcttgaaaaaagcaacaattggacttttagctaacttcttaacagcaacaatgcaagccagaagatcttccacatgctgagagacaacaattatcaacctaacaactctgtgctcagggaaaatatcttttgaaaacaaggacaaagtaaggatatttttcagattaaaaagtgaaagagttggccagccatggtggctcatgcctgtaattccagcactttggagggtgaggcgggtggatcacctgaggtcaggagttcaagaccagccaagccaacatggcaaaaccccatctctact

SEQ ID NO: 395844 - DNA, 222 bp, Homo sapiens
ctgcctcccttgggtcacctcatccttttcttaggcaggagttctgtctacctgttgaattttgaatgaaaacccaatggatggaagctctgcactgaattctctattttgttccttgctgagcctccatgaatatgaaataccagcacaaaggggagagtcagcaggtagagatcaacactatccatatttaatggagagggagtctgagttcacaggtgg

SEQ ID NO: 395845 - DNA, 297 bp, Homo sapiens
tcatttttatcattggggtgggagagtgccattaaaatggtctttaacaaagtaggtcaataatttatatttcaagaagggaaatttggggacatggaatgagagcatgttatttgggttagttgaacagctccagaaataattacgtatttttaatgcctattagggacctagaaacctatttggggaggtcaggaaactgggtatgagatctgagtctttgcaggtgctcgatctagaatctccagggagaatgtattttggacataaacaatgagacgtggataagatggatgg

SEQ ID NO: 395846 - DNA, 93 bp, Homo sapiens
ctgcaggagacatttctcaaagacagaatgtccctaccatggttctagaatcctagggtgaatacaaataaattctgggataagccaggcagc

SEQ ID NO: 395847 - DNA, 228 bp, Homo sapiens
ctgacccttcagcccacaaactgaccatcttccccctcgcacctcactccaggcccacgcattgactgccatctctcccctctcctggaagcctctgaagcagccacatccaggccccaccccatgcatgaactcctccacaccagcccaagatgaccaacactgtcttaataacaatgactgccatcgagaacactcaccctggccaattcctttccatatgtgact

SEQ ID NO: 395848 - DNA, 442 bp, Homo sapiens
cttacacctcagtagtacatgaacagcgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgtttttcgtgtttttttttagttgggggtgtctagtaattttgggttgaatgctgaacgttgcatatattaagtagaacagtactactgaggtgtaagcgggtac

SEQ ID NO: 395849 - DNA, 932 bp, Homo sapiens
tgagtatctagaatccttgtcttagatgaattgattacgacatttaaaataaacctcagaagtcagtgattaaacttttactcttgatgatttccagagccctatagtacttctaaggggtctattaaacaaaggattagtagttttgtttttttaccatttaacaaaaacaaggtagatattaaatggagtctatgagaagccagcctgaaaaagcaggtatgcataaatattgaaaagggaaaccctaaatttatttacctcaggaaattgcttttaaagccgtgggaccagcaagactcttagtaactcctaccctgtacccagaatcttgatttagggagtttaaacctcagttttagctcatttggttatgaaagatacctttttaaaatttaatctagtaactagaagaaactaaataattggttcaacaccaagaggctatgcaaccaaaactgagagacaaaattgaattgaaaaatgttaaccaactctgaagtatttatgacagctggaattccgggcagttcttttctccttgttctgcaaatcatttggcacttgctcactgacttggcaaatgaggaaaaaatattttaggaaggcagtatgtgctggggtaggtctagagacactttacatgctatcatatacctagaagagacttttctggaggaatttctccactagaaagtatgcttttataattgattgtaatctgacttctctgtttttagaaacagataaatttgccactggatgttcagtttttatttctggcttatctgtttcatggttttttcttttgttttccctctcctgcaaggaaagtatctatccagagagtttgagaaaccatgcctttaaattaactaactgctgagttctacagaattggagaaaattgattatttccttgtatttcacag

SEQ ID NO: 395850 - DNA, 513 bp, Homo sapiens
gtccccctgtaccccgggcccaaggggccccccccattgggcccccccccccccccccggggaaccggcccaaatttttttcccccaaaaaaaaaaaaaaaaaaaaaaaggaaagaaaagatataaacatctgactatctagcataattattattgaaaaattatgcatttcagtgcataatattctcttgtaaatgaatttatttctcatttatattagaatttgggcagaggcaatccttcctacccgatacgtgtggccacttaccatatagggcatttggtctacctccgtgtgttcccagtgactgcagatgacatcattcagtagagaagcatcgtgctgctcttagtttataggcagtgagtaccctacagattagaccacctcataatgagttcttgattgcacttcagattgtcttgatggggcaccagatgaggtccctttgtatgaaatggccagatactgaacatgttctcaagtgtttacagtaatattaagactattcc

SEQ ID NO: 395851 - DNA, 416 bp, Homo sapiens
tggggaaaaactgctctactaaagcaaatcctagacattatgtaattccacctgtaaatactattggatatcattctaataggtaatgatggtatcatggttgtgtctttaagaatattaaccataattccttagtattatctgatattaaggagttcattgctggtcgttgctactgagttatcactggttctaggccataatagtgaacaaacagcaattggaaataaaacctggcaatcttaaaactgagttggaaaaaccagtttcatgtattttttaggggaaaaatgcatacttttaaattttatacctatatgccgtttctcttataccaaaaatcttggttcttatatatgtcattggataaacttactgctaatagcaattaaatgttggtattttgaagttataaa

SEQ ID NO: 395852 - DNA, 962 bp, Homo sapiens
cttcatttttaaattgtttttaaaagatgaagccaagccaggcccactgtgtggaaggcaaggcacatgaagaccagcaccccgactctctccaagccagccccactgtgtggaaggcaaggcacatgaagaccagcaccccactctctccttgcatcagctgacaagttctcactgagggcttttatgttccatgttccaggagctgaggggagaatcaaaggaggttacagagaaacacagacgttgttcttggccttacaggactgaaggcagtattgggagaaaggacatgcatatatattaaaaccaaataactcaaggcagaaaaatctgccaacatttgggagtactgtgttttaactttcaaattttataagggatcaggtagcctcttaaacaaagactcctcctgactacggtggagacccacatgctcaacacaagtggccctctctagtgactttaatgaatgatacctgcagacccaggggtccatatccagcactcgtgaatgaatgaacaaggacaatggctgtgtcagtagaattaacagtctgggctggcaaagcccttatgcttctcatggtaggcacaaggatgggggttgtgtttgcctctttttttctcctgcatcatcagaagacagatggccttagactgcctgtctgtgtctcttcaggcacctttgggaaggtgggaaggatgggtaaaggtacttagcacgtattcaacccatgcaaggcctgggttaaaaggaaagctagagtcaccacagcatgagggtgaacataaatactccttctactgggcagagtgtgctatgctagcagaagagaagtagataatgtccaaaggctcagggtcaggctccttgatacaactacactgatgtgtgatgtgtgttgggtgcagagggaaaaaaacttgctaatgccttagtagtcctcctccctaggtga

SEQ ID NO: 395853 - DNA, 509 bp, Homo sapiens
tcatattaagttgttggtttttgtttgtttgtttcccactcataatatgtcctgttttctaaaaactttttaggttcaggcagttgaccatttatgtgaaaaatgtctgaaaaatttgaccctgataaggtggatgcctcttgtgagatcacagaagcccttaacctggaagaggcgtgtaaaccaagaggtttcaatatatgtaacaattgaaatttaagcatatttaaatgttatctactcaaatatttattgagtcctactatatgccaggcactgtagtaggcacatgttgagcaaacaaaaattcctgttctcatggggcttacattctagcagagaaaacaaaacacaacacaagtacaatgcataggatgttggatggtggcacgtgttgtggtataaaataagtcagagaaaggagtcagttttaaataggaaggttatagaagcctcactgagaaggtggcatttgagcaaggactcaggtggtgtggatagtaccaagc

SEQ ID NO: 395854 - DNA, 232 bp, Homo sapiens
ttttcaggagttaaaatgagcttggaataaaaagtaataggacctaatttcttacatgactgaagaagttggctctaagagccttgccccatctaaaggtcaaaaatattttgagaaatgccagcattgtttgaataaatgcccagtctctaaaggtggcaactttgaagggcagcatattcatttgatagacagtgttaaatagtctcctcactttatcatcgctcacctg

SEQ ID NO: 395855 - DNA, 483 bp, Homo sapiens
tgctgggattacaggcatgagccaccgcacccagatccagaaactcaggctttattccagaccttctgacacagactgcattaacaagatcttcagtttattgtagacattacaatttgagcagtaccttctaactcaatgtgacttttccatctgaaaagtttacacaactctttctgtatgatgtaaatataccactcaaaaatgtacatgttagtgttcatgtcttcatcatctggaaaagtatcatataaatactgatattttggatcttatgccaatctcttttctcagagttagagtatattttcacagagtagagaatatttctgtgttgaaggttattagataatttcagtcacccctataagtaagacccaattatatttactcttatttcaccttgagtgaaacttaaaattctgcccaggggcacttggtaaatatgtgtgtttgtttgtgtttttcagggagcgttgacat

SEQ ID NO: 395856 - DNA, 235 bp, Homo sapiens
atgatttgttcatgtaatatttttacttatcaataagtttgctgttattagcgacatttaaaatacaaatttcttcattcactgaaaggtgagtgtgtgtatttttaataataaaacaaagtagagtttgaactgtaagacaaactgggaaaagttccatttggttatactatactatattaccatgctaatactttttccaaagagaggaaatcagtacagaagtatatgtgac

SEQ ID NO: 395857 - DNA, 278 bp, Homo sapiens
tgcattctacacctgtgagagaagatcccagctgtttcccagcttaaatttagcagggaggtaaatggaccctctgtgggtttagataaggtgtatggtcaagcagatgttgtttttccttttataacttgccaccgaccttctcattaggggctggaataaagtcatgagattatagtcttatgttgctaagaaggggaaacataacaaatctactagcattaatttatataccacgttgactcaataaaaatctttgtagatcttgaaccttaatc

SEQ ID NO: 395858 - DNA, 486 bp, Homo sapiens
agatagtcttcctaaaacattactctttttctaactgtgaccttttatgatttcagttacctacaggacctcattagcctgttgctcaaacctttcttcccctgtctcctatctccctattatgaacactttgccccagctagactgcctgtatgctacacacatgtccccatttttatccccagaacccagactctggctgttcccacattcattctattctttcttcaaactggaaatgccttttctattaaaatcctcccttccgacctgggcaacgtggtgaaaaccatctctacaaaaaaatacagaaattagcccaggtgtagtgttgtgaacctgtagtcccagctatctgggaggctgaggtgagaggatcacctgagcctgggaagttgaggctgcagtgagccatgatcatacctggctaatttttttgtatcactgcactccaaactgggtgagagtgaaaccctttcccccaca

SEQ ID NO: 395859 - DNA, 468 bp, Homo sapiens
ggtgctttttgcttttcttttcacttcccacatctcaagcacctgctgtgggtcagctctgtgcaggggtacaaagatgatcgatgtggcagtgtacaaaacagtcagaatccactgtggtggctgtaccagcagtattcacatagtgcagtaggaacatggaagcgggggcaggcagggccagggaaccctcagggtgatctagacccaggggacaacatgatcaaaagtatggaaatgtaaggctgtgatgtgatggggcataccaactgtttagcgcagaggtcacctgtaatcccagcacttagggagcagaggccagaggatagctagagcccaggagtttgagatctgctcaggcaatacagcgagccccctttctccacaaaaaggggaaaaaaaagacaaaaaaacccaagtgtagagcagaggtcagcaaaccggcttgcatgccaaatccagcctgct

SEQ ID NO: 395860 - DNA, 267 bp, Homo sapiens
tagttgtgtgagaacaaattaccgagcccctcttagcctgttttcttatttgaagatagtaactacctcagcgatattgtaaagattaatgagagaatgtatgtgatgcggtttttacagtttagtaactcaatgtaattggagacttatgtatcatttgctatgtggcacacactattttaaggtctttgtatatattaactcattcaatcctcacaataatcctacaaagtaggtaacctcatcatacggtagagggaaatgaag

SEQ ID NO: 395861 - DNA, 520 bp, Homo sapiens
agatggggcctttttcagttattatgaacttcttttaaaggatttaatttttccgtacttaagcacaaaggtttaaatcattaacgcctgaaattcaaaaattagattcactctacatcagtatgattttacccttttactgggtgtatgtgctgaaatttgtggattagatgtaatgttaactgtctggagaaagagtaggaacttgatttctctttgacatttgcaggaaaagaatatatatgattttgagactccaaattgaattaacaaaatcaatctagtaggtggtaagataacctaaaataacatagactcaaggtaaaaagcctaatgtagataaatgtcacattgcttggaggaatacttaaaaattccagtttaatcatcctatgctttttgataggagttcatgtacaacatattttaatagatgttcacaaaatttctgtattatttatatcttaattccactattggcactaattgtaggatattggggaaaaatattccttagttc

SEQ ID NO: 395862 - DNA, 510 bp, Homo sapiens
gcccagccacctgagttgcttatttctacagtaaggcatgtaatgaggcttggcagacagtgagaaaatgcataggagaaaccaaacatagccctggctgtggttatgaggttagggcttaaaggcactataatgtcctgatacagaagtgactcttggactgcaacagctctgtctgagatttccaaagctcaacgatactggtgtggaaaaggtgccttcttctttttgcttttgtgctcaaggtgttgctgctgccagcttgttgcctacctcttttcttagcagctgcggcatttcctgaaagaccatgcatgactaagttttaattctgtattcctgagggaaagcagccctgactccttctcagtttccattttgatctatttctctttattccttttagggcttgcatgtgaccattggacctaaactctgtccatcctggtcttttctcccaatggctaattttttgctctaatccctatcccccttttaaaagatgcctct

SEQ ID NO: 395863 - DNA, 462 bp, Homo sapiens
gctgtctccagtgctgaggagagacattttaattaattatagtcccatgggctcggggatcaatagcagtgaagagccgtggaatgaattccagcctctgtgctgtttccagctctccctgtgaccttgtaccagtcgctcaagctctctgggccttggtttcctcttctctagaatgggaatattcatttcacaggcataatgagaatcttcaaaaaggtatggcgatcaaagtgttgtaaaatgtagagtgctaaccacaagtaagttattattaaggtggtatttatattcccaaagggtaagcatgagtggtgtttctcttctgagccatttctagaaccttcttgctttttgttaatacgttaaaaccacctggcagcttccattttcctttctgagtctgagaagcaagcagcccagacagaattggggggagagggtgtagatgggaagaagttc

SEQ ID NO: 395864 - DNA, 787 bp, Homo sapiens
gtcagagacacaaagtcatcggggaaatgtgacagaagtgatgatataccagttctgggcctacacttcaaaaagaactggcagtttctgtttccttcctctgggaatgtttgccctgaaccactgcataagccatcaggtcctactgcagacctcactggaaaaggagaggtcgtgagactacacagtaaccaagaaaaaaggcccagctgttccagatcacagtggagcaagcagatgacaccggcccccattagcccagaaccacaactgcccacctgaacaaatcctcaaataccagcagttgttttaagccattaaatctgagtggttcggtgcactttcctatgagggagaaggggacttctggaattcttcatgaaacagtccggaggtgagtggagctgggaaataacttgaaccagaaaaggaaagctccttcgtggtgacagtccccactacccttcttatcttctggatgaggtattaccttcagatccaggaaactaacaggaggaccaatccgaggaagctctgggaaggtgaaagctgagaaatgtgtaaggtgtcgtatttctgcactgatccctgataggattcttacctttgaacagttgctttgaatggagtacatgctaagcagatactttgaatctataagtatgtatatgattaggacctaaaggggttgtcttagtccctttagtgttcctataaaggaatacatgacactgggtaactgacaaagaaaagaaattcacttggctcatgattccgccggctggaa

SEQ ID NO: 395865 - DNA, 530 bp, Homo sapiens
gtgcagaacctgaacccagacaacccctgggtatgagtccggccccagatcacagctgtggttttggctgccgcagtgaccttggcaaagtcctgagtcgtttgctgttgtgggtatgatggacagctgcgacgttttcctggactcccactgaaatctttaacttcaagatcatcttctccatcccaacagaactcatcaggcccagaaggctcccagccccagaggttcccagagctcttcaggtggaatgttgagtctgcacaagccaggatggtgactctggagaagttctccagaaaagaatcagcatctagagtctcctgagttccaggcccttagaaatttagactccagaaccactgccaaagtgaccccctcagcccagcccttcggtacccagcatccactgtcctcagcccagcccttccgtacccagcatccactgtcctggtgggagtccgctgtgctgctccaagaagacagaccctcaccattaccggaaagactgaccctcctgtgtccaggtc

SEQ ID NO: 395866 - DNA, 432 bp, Homo sapiens
aaagtctttagaatgcctaatgggagattagaaatgttgttcctgttcccacaagtttgagttatatcacctctactgaattaaaaaaaacccatggtacccactttgagatatgaaaacactggagccagccgggcacggtggctcacacctgtaatcccagcactttgggaggccaaggcaggcagatcacttgaggtcaggagttcaaaaccagcctggccaacatggcgaaaccccatctctactaaaaatacaaaaattagccgggcatggtgccgtgtgcctgtaatcccagctactcgggagactgaggcaggagaatcacttgaacccgggaggtggaggttgcagtgagccgagatcgtgccactgcactccagcctgggtgaccgagtaagactccatctcaaataaataaataaataaata

SEQ ID NO: 395867 - DNA, 263 bp, Homo sapiens
aggaaagtgatcacccctggggtggcacaacttagactagaacaaacccccatcctgatcctaacggcccccaggctgcatccgttatgcgacactcacgtgtgcacactctacaaatggaaaacccaaagcttctatttgtctaggtcagtggtcaaggacccctttaagaacttgtgagaggtggtgaacgccttgcataccacgttagggggctcgcagagactctgcagtgcggtccatggacttttaggagtcccctg

SEQ ID NO: 395868 - DNA, 150 bp, Homo sapiens
atggagtataggtagtaggtggaaaagagactgttgccatgagttgcttttggtatgaaccttagaagattgtcaaggcatggtaagagggcatgattatttctgtcctttgtgtagtctttgatgtgcacatcctggaaggtgtattca

SEQ ID NO: 395869 - DNA, 339 bp, Homo sapiens
gcgcctggccggtgtttgccattttttcttaacccattaactcttggctacaagaggacagaagtctgttagtgaaaactcaacaaatgacagccattactgtcatcatctgttgctactgtggtacttcatgctttgaatgaagtagatcttcagtaactattagctcctttcttctctttcggctcccttcattacagcaagtccgactcaactactactgcaaaaaattaggtcaaagacatgttataatggctgccaaggaaatggggtataattgataggagctatagaagaaggaagagcacaaatttcagaggaaaacacatcctgttaccg

SEQ ID NO: 395870 - DNA, 599 bp, Homo sapiens
cctggcgcaagctgactgtactgcccccatctctgctcactgcaacctccctgcctcattctcctgcctccgcctgccgagtgcctgcaattgcaggcgcgcgccgcgatgcctgactggttttcatattttttttggtggagatggggtttcaccatgttggccaggctggtctcaaactcctgacctcaggtgatccacccgcctcggcctcccaaagtgctgggattacagacaggcatgagccgccgtgcccggccataagcatgtaaagttttaaagaaaagcagcttttatctctcctggttagtgtgttttttaaacagcttttttgaagtataattgacatttaataaactgtatatatttaaagtgtgcaatttgataagttatgacatttgtatacactggcgaaaccataaccacactcaagatagtgaacatatccatcacccccaagagtttcctcatacctttttgtaatctctgcttcccaccgcatctcactctatcccttctcagtcaaacactgattggctttctttcactgttgatcagtttacattttctaaagttttatatgtatttagacagtatgt

SEQ ID NO: 395871 - DNA, 298 bp, Homo sapiens
tgcttgcttttggctggaaacacccgttaggatcagagatagggatattaaagtggatgttctttatatagaaatgacaccaaaaggcaggcttgcagaaagaaaaataatgaatgaagtgaaaggaaatgatgtgggtagaggtaagaactgcagtgcagtgtttaatttcttgatttaggtgtgaagaaacacacgttctgtgataaaatatgtaaattagagaaatatttttcatttgaatctgtaattccactcagagccaaagtttatcacttgtctctctactaatgttagt

SEQ ID NO: 395872 - DNA, 110 bp, Homo sapiens
gttagtctgagggtggggttattatcatcctttctttaaagttaaactctaaactaaattcctcccacgattagcttggtctgtgcccaggaacgagcaaggacagccag

SEQ ID NO: 395873 - DNA, 790 bp, Homo sapiens
tctcaacattacattgaaatgtaaataaataagatgtaaaatagtagagtgtttttggataaactttactattactaatattcaaagaaaatcttgggaaaaagttgtctgagagttaaaagggcactgagtcaacttattttgcaccctttgatggaaaaacttgagaatgtttgggccatgtctcttctctgctgacaagaattaagtcagctgcattgattgtgttctgagaaaaagcccaagaaagctcatgtatttggtttctaatttcagtgttaaattatttcaattttgctcttagatgcttcccataatcctggcacattaaaagatgcttcgtttttatttaacaagactagtaggtttgggacacctttaaatcctcacttcagagactaccaaagaaatattctttgactcagatatttaggtggaagtcagctctctgttagtgactaaatatcatgcctgttgtggtgctgctgatgggcaaatcagggagccattcattcttgccaggggagataaatgctgttagattgctcttttttgaaggaggtcagaaaaagctttgattgactgtgaatgactgtagataaaacctaaagtatatgctttgccattatcagcccaccagccttctaagcttcaaaaaattaaaaatagtgatcccttagtaactcagtctgtgggtatttaggagccagatggagaccatatgcccatacatattcctttttatctgctgtggtgggacagtgatggtccctcttcaattaaaaaaaaa

SEQ ID NO: 395874 - DNA, 363 bp, Homo sapiens
gggattacgggtgtgagccactgcgcccggccacattttatagccaaccggcttcttgtgtaacatgagttggggcttcttgggccccagagtccagcactcaggtagaaatatgaccgccatggccagacagcagccctcgctgggcccctcttcagagcagagctctgtgccgagcctttaggggtatgagagaaaccggagacctggtccgtgctctcaaagagctcgcggtgtagctggggagagagcaaggccacatgagacctcagaaggacactaaacggcacaccgacaagctcacagcactctagctgtgtcccgggagaggaaaggggtgaatcagggcaggtggggtcagtc

SEQ ID NO: 395875 - DNA, 379 bp, Homo sapiens
cggagcgagcacagtgctaagagggttcgacatggtccctgactccaggatgtccatcatctcgcgtatcttcgctagacaagacaagctattattcgacccacataatccagcactcaggtagaaatatgaccgccatggccagacagcagccctcgctgggcccctcttcagagcagagctctgtgccgagcctttaggggtatgagagaaaccggagacctggtccgtgctctcaaagagctcgcggtgtagctggggagagagcaaggccacatgagacctcagaaggacactaaacggcacaccgacaagctcacagcactctagctgtgtcccgggagaggaaaggggtgaatcagggcaggtggggtcagtc

SEQ ID NO: 395876 - DNA, 350 bp, Homo sapiens
tgtttgcagccaggaaggagttgctagacttcagcagctatgtctcacctgaaaggaccacccatcatccatggacagccaagcccaggaaagaggccctgaccaaacctaccactataaacatcatggaagctctcgctatagaccctggctatagcaagtctatgggggtagatcaggcatcgatatttttgaaagctccccaggtgattctaaaatacatccacataaggcttccgggtgagaaagcacagaacggggattcttgtgagatcattctggaaaggtgaacatgagggaattgatgctgttaagtggctactatgtgccaggcactatgccgggcattt

SEQ ID NO: 395877 - DNA, 393 bp, Homo sapiens
ttttagggaattagaaaatgaaataattgattcagctcataaatgtcctcttaggtgagtgtctctctctcttgctccctccctccctccctcagattagtgaagatttttcatttattgtaaaatttcagttgctgatacagatttttgcctttttgtggtctgttaatactttaattacaactgaatagtgaaataaaaagggagtaggagcagcaccttggaatattttacattttgagctttttttcttttatttctttgtatatgtttatatttcttctatctttttacctcctggtataatttatttctcatcgtaatgagtatggaagatgactgtgatgactacattaaaacctctgtttgttctttttcactctgataactttt

SEQ ID NO: 395878 - DNA, 556 bp, Homo sapiens
gaatagtctcttcctttaattcggtgtatttttgcttcatgcattttggggctgtgttgttaggtacatacactttaattatttttatatcttcttgattaactgacacttttataattataaaatatccttctttgccctaataataatttttatcttaaaatattttgtcaattttgcctggcattaatatagctactccagctcttctggttattgctggtgtatcttttccatccttttatgttccatttatttgtgtctttaaatcttaagtgtctattgtaaatagcatataattgtgctgtgtttaaaaaaatccattctccaaatctcttccttctagtttgacagtttgatccacttactttaatataattactgataagatagaattattttttgctattgtgctatttgttttctatatgtattatgtccattgtattcctcaattccttgattcttgaatgcttttgtgttaaatagatattttatagtgtaacattttaattacctttcatttctcttaaaatatataattttagttatttta

SEQ ID NO: 395879 - DNA, 344 bp, Homo sapiens
tgaactcctggcctcaagtgatctgcccacctcatcctcccaaagtgctgagattacagtcttgagcctgtactggctatcactgtgcctggctgagtttgacagtttgttataatgataaacataacacttaaatataattgtgcagtctgactcttaggtatttaccaaagagaaattaaaatgtggccactcaaagacctgtacatgaacgttcgtatgattacatagctttttatatgatttttccattttggagaaagttctgaggcaggaagagaagctgtaagtgcttgaagggtacactggcattgtacaattagtacttgtccatgacagctgca

SEQ ID NO: 395880 - DNA, 712 bp, Homo sapiens
gagttgggaatttcttatattttcctctcacttcttaaaaccacctttgtgcccctgctttacattaggaaaaatggaaaggtgattaaacacggccgttaggagcctaaaatctaggtcagagtcccgtatgaaagaaatcagataagttgagagagggcgtgtgcaggttggaaatggtggcgtccatctctgctggggcgtcgatgcctcctggctggacaggtggagcctggaaggtagggaggctcggagcatgttcagagaggcagggatgtttttgactgtgggtaacactgcatgctgggaacggaaatgagcactgtgtgcccagcagggctcagactgccatgtggggtccctggagaagaaatcacgctaacactgagtatcaaaaggatgagtggtcctgggttctgctctggcagccctgctaagggcagagtctcccggtggtcctgggtcctgctctgacgccctgctaagggcagagtctcccagcctctcaggagcttcagtccacttaggaaacttgaggtgagctgcagggagcctgtggagaaacgcttctcatttagtggggtgaggtgacacggggtggcggggacagtaagttaagtttgagaaggaagtatgtagaaagtgtatgtgaaatctgtagatttggggcctctactccattgtgaacttaaagaggcagggcgaaagcgag

SEQ ID NO: 395881 - DNA, 483 bp, Homo sapiens
agagcttttgttaatgtggcttctatctgtacatttccatattataaattaaaaatgataaatacatttattatttcatttaaatacaaaatagtaaaccctttacatgttaacgtaaataaaatacttttaagcatataacttttctaaaatgaaaatattttgtgagaaaaatggcatagttttatatttttgtaaatctctttaataattaccctaataaacaaatctactgcacatgcagttcataaaatatgttgctacggatgaagtgtatgaagaaaatctggcctcacagatgtgtagttggaaaagggagaatcattttaatagtctttatagatattatggatattattctttgagactatactaaaacttgacaagtggcagtttcctaaaggttagttgcaatgtgaaatctgaaaccatgtcggtgagctttttgtacgcagctataataaaatctgttggcagtttgta

SEQ ID NO: 395882 - DNA, 741 bp, Homo sapiens
ttcccgctcgcgcctctccctccacacctccctgcaagctgagggagtggactctggccttggccagcccagaaaggggctcccacagtgcagccgtgggctgaagggctcctcaagtgccgccaaagtgggagcccaggcagaggagtcgccgagagcgagcgcgggctgtgaggactgccagcacgctgtcacctctcaataacgcccatcccaacgtttcctgaggaataattttggtcgtgttcctgctactcagcttttcgtggttcctgctcattttcagagtctaacattccagcttttccggaaattctaagtctgcagtggggagaagtggtgaggtggtcacacacattctggtccatgtccctaccaagtttctactcttcttcccacaaggctgcctctgacttgagggttcaagagaagaagaggaaagagatactttgatgtaaaagttttcaaagaaatgctttgggcagaagagactcatggaaactggacactatatctggagccaggaataataggatccgagaaacagtaacaagtataaaacaaagtggtcttgaactcctggcctcaagtaatcctccccactgggcttcccaaagtgctgggactacagagaatcttaacccaaaagaagaatgagccaagaacatgaacagacaattcaaagaaaaggaaatgacctttaaacatatgaaacaatgtccaacttcaggcaataagaga

SEQ ID NO: 395883 - DNA, 362 bp, Homo sapiens
aaatgctgttcattgttcttgtgacatttaccaaaatttctagcaaatagttatatagttaattaattgatatctgtttccctgagagaacataacatctttgagtgataggatcttgaatgtatagtaattagtttatttccatatcctcaagcacaatgtgtagtacatactgagcactccattaatatttgttgaaagctgttatatatgctgaatgatcaattgacatgagttttagttctggattggccaacaatgtgaccttagtcaagtagttaattaatttttaggttctttacaggtcaaaacctttaatctatgagtttaggcgcaaatgaaactgaaaacatgtcactagg

SEQ ID NO: 395884 - DNA, 627 bp, Homo sapiens
tgacctgaagtcaaattccttctggagacatgttctaaaactcaaaatgataatcagtaaggtttcaaagattatgttttatactgataaaatgactttaaaatttcagtacactgagaaaaggtggctagtataatatattgcatattcgtgtaattgtatgacaagagtatcaataaaatttgctgtgcttctatttggttgaacagctttcaataaaccacattggtaaacaagtgcataaaaataaataagtcttatttttatatagtgacattgcatgtcaaacatttaatgttgaaaaataaattttaattttattaattcaaactattcaaagggaaaaatatgcttgatatatcttactatacattagagaagcagaggaaaacgcttattttctaatgatacagggttgaaggcattaattgattattgggaccaccatggctctattcattctcatgtcttgccttttttttccagaaacatgtgcttatatgtttctttcttccacgttctctccttagacaactgaaaaacacttttaaatatcagacatttatcgtctatcttggctcttctttcctcagctatttttgtctctttaaaaatagagtttggtca

SEQ ID NO: 395885 - DNA, 580 bp, Homo sapiens
tcctgacctcaagtgatcagcccacctcaacctcccaaagggctgggattataggtgtaagccactgtgctcagccccaatagaaaatttgaggagtataaaaaagttgtagaaggttttaagactgcgcctgggctgaagtaatatgaagtagtagtcattcatatatacatacatacatatatatgtatatatatgtatacacacacatatatatatttcaaagtattagcctcccgagtagctggggttacaggcatgtgccaccacgcccggctaattttttgtagttttagtagagatggagtttctccatgttggtcaggctggtctcgaactcccgacctcaggtggtctgcctgccttggcctcccaaagtgctgggattacaggtgtgagccaccaggccccagccttaccagtatatttgaaaccttttttttttttttattggagacagagtcttgctctttcgcccaggctggagtgcagtggcacgatctcggctcactgcagcctccacctcttgggttcaagtgattcttctgcctcagcctcctgagtagctgggactacatgc

SEQ ID NO: 395886 - DNA, 292 bp, Homo sapiens
tctggaggatccccaaacgcagagaggagatacattatcaagaaccccaaaatatttgtgttcagaagtgtacgtttttatgtgtgctgtatttcacccctcaaaaataattttttaaaaatgtttaacaactttactattttttttttaacttttaagttcaggggtacatgtatagttttgttacataggtaaacttatgtcatgggggtttgttgtataaattatttcatctctcaggtattaagcctggtacccattagttatttttttctgatcctctctgcgtttg

SEQ ID NO: 395887 - DNA, 557 bp, Homo sapiens
gatcacaaatttaccattacttctattgttaagcatttactgagcataccttattatcccattaagaaaatagagaagaaaagaaacacaggtttccagactaattgggtggatgtggggatgacaatattgcatgattgtgctatgatggagtctcagctttgtgaaggcaagaattcacttctatatattcattatttgatgtggtaaatacctaacatatgaataaatgaatgaaactacattattttaggacagacattctccaagtatgttacctggcccactaccatcagaatcacctgatccttttctagaataccatatatgagacactgttctaattacttttcttaaattaactcattttatcttcactcaactctatgagataggtactattattattaccttcactttacagatgagctaactaaggtccagagtgccaaggtcacacagccagtaagtgacagagctggggatttcaacccagagtcgatgctcaaaacccctacatcatcttgcctctctatatctaaaagtaatgaggcaga

SEQ ID NO: 395888 - DNA, 535 bp, Homo sapiens
taattatttcttaattaagtgggataaagataaatcgctcttttgtggcattaatgtgacctatcttagacattttttttatttctctttaatctcacatggtggctttcaaactttttagttctgctattttctttacaattttattctctttattttaaaacaaaatgttagttggaatgtaccaaaattggaaagcattgtctcactgtctctaattcttctcccattctctttaactgattacaattaggcttgtgctccagatcacaactagtttgatcaaagtcaccagtgacctccatgttcctaaatctagcattaacctgttatcagcatttgactacagttcatcactcccttcttaatggatttctaggactttcttggtttttctcctacctcagtatatgctcctttacattctcctttagtgctttctcttctctctgacatcttaacattacagtgccccagggcttaatcgtaagcctatacctctctcctgagtgccaggctgttatgtccatttatg

SEQ ID NO: 395889 - DNA, 255 bp, Homo sapiens
cctgcccccgactctactgtatgtaaaaaggttttataaaacagcaagtcagggaaccactcagggaacagtggggagaatgtaggacaatcctgagcaccaggcttcaggcaatcaggcacctgcacccagaggaactggaacctaggtggggcttttcgagttgtgtttccaatgtcctttttaccatattgacaaagggaagaatttatgtaggaatacatcatctttaattaaagcatagctataaattat

SEQ ID NO: 395890 - DNA, 229 bp, Homo sapiens
taacttttttagagacaaggtcttcctctgtcgtccaggctggagtgcaatggcatgatcatagctcactgcagccttgaattcctgggctcgtgcaggcctcctgcctcagcttcctgaggactataggcattcaccacaatgtgtgaagtttgtttgcatgaagtttgcagctaattttaggaagcttttttattttttatttttttggagatggagtctcactgtg

SEQ ID NO: 395891 - DNA, 466 bp, Homo sapiens
aataatgggaagctcaagataaatttagaattctacaggccaaaaatcatcttacaataggtacaatttagaacacattgaaacaataaattacaaaaaaaaagacattaagtgagtaaaatttcatgttatggatatgaagttttgttttaaggcagttatgtaaataattcctcgtcaaattatttaatatccataaatatttcataattccattttaacatgtaatgacttctagccccatttaaagatgataagaataaaaataggtgcttatagctaaacagtaaataatttaaaatttagagatattcagttttttcctgtcagagttaattctgtgattctatttattggttttatttgcttgtttattatttatttatttgaggcaggctcttactctgttgccaaggctggagtgcattggcacaatcatggctcactgcaggctcgactttctggg

SEQ ID NO: 395892 - DNA, 600 bp, Homo sapiens
gttgagaaacactggtgtactgcatgggcaaagaggcaagggatttatgagcaatattttttatttatatttttggaaaggaaactccagagagtaaacaaatgtgctgatgacagactatcttagaaacacttccccgggtcaaagtggttccttctgagattttgctcctatgtacacactgcttggtaaactttgcaacttcacggcatatcagaaggaactagactgcatcctcttcctgtctcttcccttggagtagcatttagcttttcattgcggacctgttgttaaaggaagataaactttaccctataccagccattttctccttttatcaagaaaaatcaatttgtatggttcttaaatgtatttccctagtatatattcaaattaaacttgcagttagatttatatcagtgtttactccaaatagtcaaaatatctacaggctaaaaacagttcctatttcgagcattaaaatagcataagccttagtcacttgttcagctctttgattctcataactatttctaaccgtggtagagataagaatccaacaaaacaaaactctttgcaacaacatttaagttttgctat

SEQ ID NO: 395893 - DNA, 396 bp, Homo sapiens
accgggggggcgccgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctg

SEQ ID NO: 395894 - DNA, 309 bp, Homo sapiens
ggctcacaccagcactttgggaggccaacgcaggcggatcacctgaggttgggagttcaagaccagcctgaccaacatggagaataataataagccgagatcacgccattgtactccagcctgggcagcgagagtgaaactccatctcaaaaagaaagagagaacgagagaaagagagagagagagaaaggaaggaaggaagggaggaaagaaaaagaaagaaagaaagaaagaaagaaagaaagagaaagaaagaaagaaagaaagaaagaaagagaaaagaaagaaagatgtatcctttccctattt

SEQ ID NO: 395895 - DNA, 409 bp, Homo sapiens
agatccaaattaactatctaattgagaaacctttacccaagaacctcaagtattgagccaatgctaaatgagtattcaaaaaagaaaaaaggagtaagccggactttgcgttcccaaataaaatgctgccaagttcacgtgtaacccatagtgctgggcagaaagatatggtaaaattttaatatttacagaggacttttctgctttgatagtcacaattgaaattcaactagaattcttgcatcttaagctttagagttttctttcttccccacaattctaggggcaggtggtgatggtggtagtggtggacgggatataaattgttaaagcaggaaacagtacagaatggcaggataaacagctgatccaggcctgccgacagcagagagagcacgggctcactgac

SEQ ID NO: 395896 - DNA, 508 bp, Homo sapiens
tcagcaggttctactctactcctctatatccaatgagttactgatactacctcctgtttcttacttccttcaaaacatctccttatgttccttctggtccaacagtaagcatcctgatctgaattttcactgccccatacattgaagtactgcatagcttttcatctggctttctggccttcagtttttcccttgcctaatatatcttacacagtgctattaaaacttcctaggatactactttcacaatgtcattcttctacagaaaaattctctgtgactcgtggctgggtgcggtggctcatgcctgtaatgccagcactttgggaggccaatgcgggcggatcacgaggtcaggagatcgagaccatcctggctaacatggtgaaaccccatctctaccaaaaacacaaaaaattagctgcgtgtggtagcggacgcctgtagtcccagctactcgggaggctgaggcaggagaatggcgtgaacccaggaggtgcagcttgca

SEQ ID NO: 395897 - DNA, 445 bp, Homo sapiens
tagtgtggctatgcaataatgtatttatttattcctcctagatggccattgaggttgtttttagaagcacacactgggatgaccattcttgtttacaccactttaaacacgtgtgttttttctagattagatgctttaattcatatagctggatagatgaagagagggaggaaggggtggatgggtggatggatagatggatagaaagctagaactctgatactttattagtagtagcaaatatccatgtacactttgtctaacttgtgaacttatcatactcctagtgctattgtgcacacgcccacgcatgcacgcatgcacacacacacacccctctcccttagcagctggccaggagtccactatgggaaaaagtcagctgagggctatgacattagaaagaaaatgagcagagttatatgagatgaacaggaagaatcat

SEQ ID NO: 395898 - DNA, 188 bp, Homo sapiens
gaaggcgaatgatttgtctttgagtgcaactcagggtcttagacttttttctctttagacttaccagttaggctctaatttaggaaaaataaaacaaaaacttacatgggtttggagtaaaattagctggagtaaaatccaaggctagatttctattgaactagaacctcagctttctgcttataaac

SEQ ID NO: 395899 - DNA, 382 bp, Homo sapiens
ttgagcccagaagtcactggaggagttcaagggtgcccagagtgcaagcaagatccaagaatatccagaactattcctaagccacatcgtgtattattatcaaatggcctgtgaagcagattctcttgctgggacagtttttaagacctctctatactgaattgggacactgcctggaagttgtccaaactctgccttttgaaagaatattgatgactaagaaaacttgccctgaataaactaatgttaggacacaggaaagcaccctcacttcaagtcatgttcattccacaatctcatatttcagatgtcatggttgcaggattggtcgtgttgtgttggagctgagaagaggcagtgcccatcaatcagcagttcctgc

SEQ ID NO: 395900 - DNA, 239 bp, Homo sapiens
gattgagcccaggaggtcaaagctataataagccatgatcatggcaacactgtgctccagagctgtgacagagtgagaccctgtgaaagaaggaaagaaagagagaaagagaaaggagagagagaaagaaattaattgacttcaactcacttactgagcctttaccatatgcctaggactgctaactgttgcgtatgcaaagatgagtgggcactcttggacttagtgttcattaactg

SEQ ID NO: 395901 - DNA, 466 bp, Homo sapiens
acggtggggtctgtgctgaccgtggtgttgtcagaattgagttgttggacacccagttggtgatagaagtttggttggtgttcagcaaactccatatatttggtgttagaataaagatatcagaccaggtgcggtggctcacacctgtaatcctaatactttgggaggccacagagggcagatcgcttgagctcaggggttcgacaccagcctgggcaatagctggtgaaatcttatgtctaccaaaaataaaaaaaaattggcttggcaaggtggtgcatacctgtagtcccagctggggctgaggcaagaggatcacttgaaggctgggatgttgaggctctccagatttatgatgtatcctggagaatgttccatgtgtgtttgagaagaatataagttatactgttgggtgaaatgttacctatatatgtcttttaggtgtagttctttagtgctatgaagt

SEQ ID NO: 395902 - DNA, 498 bp, Homo sapiens
gagaaatagcaccgaggtttggatatgaacaggaaattcacagatgaggaaaccagaatgggcggtaaatacatgaaaaaggccagacatggcggctcacgcctgtaatcccaacactttgggaggccaaggtgggcggatcacttgaggttaggagttcgaaaccagcctggccaaaatagtgaaaccctgtctctacttgaaatacaaaaattagtcaggtgtggtagctgggattataggcatgcaccaccatgcccagttaatttttgtatttttaatagagacggggtgtcaccatgttggcaggctggtccgaaactcctgacctcaagtgatctgcctgcctcggcctccccaaagtgctgggatttcaggtgtgagccaccatgcctggcctctttttcttttttagcttccatttttaaacctttacgttcaggaaaatacattgcatttgtttatagcttgttccttaattctttgtttttcattata

SEQ ID NO: 395903 - DNA, 405 bp, Homo sapiens
gactagaagaatgagtttatgaatgagataggcgagtgatccacatggtcaaaggaaagccagaagaacagggatcatattctacatgtcaattgctggatataaatgatacctaaataatgaatttaaacattttaactcagatattcagtttatggcatggcaaacaactgatttaaaaattgtttataatgctttttttttttttgctcataatgaaaatgatgtaaaaattcctgaactctgtgtgtttttcctgtatatatctaatttacttacaaaactctcatagggaacttttttttaatgttccatttttaaagcctagaataacttcctaaggaaagtgtgaaatattcagacccataatagcttcctagaaagtagttcttactttccatatga

SEQ ID NO: 395904 - DNA, 353 bp, Homo sapiens
ccccgcgggaccccagtgactggttttccgggatcactggtgagggtgggagatgggttcttgctgggtggtcaccgttccagccacatggtgggcgaggcagggggtgggggagaggcctggggctgtgcacctgtctttccacctctctcctctgcatcccaccctccatttcaaatcagggaaggatgaggaaagagtttgtgggtatcaccctcttgctccatgccctggcttctcagaagttccccagtgggggcccctggagtgatggacactgccacctggacctgaaaaaggacacctggtccctggggtgggagccgggctccctctcactgaccttgtggcct

SEQ ID NO: 395905 - DNA, 777 bp, Homo sapiens
aattactaaccagtcttaaccatcttttataaacatatgctcttataaatgtgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtagtcccagcactttgggaggccaaggtgggtggatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttt

SEQ ID NO: 395906 - DNA, 526 bp, Homo sapiens
cagcgtgtgctgtagactgaggtagtatcttcgagttctgtcattggcacctatcagtggctgagatatcctgggttgaagtctgcaaggtccagcataatgtattatgcatgaaaagacatctcctgttacttcatttttgtaaaagattacctcaatactccttaagggctggatgacagtgtgtgaagtggctgaaacttacatcaaatgctttaataacaggtcagcaaaaaggccaatgggcttaacttttacattccaactggcacagctacaggagtgggctatttgccaaagacatcgaaccaagcctcggagaagtagaaacagctcaaccaggttcattcagcagagaatcgtggttaaaatatattaagcctggattcctcaaattctgttggtaaagttaatcgggatagggtaacacttggcatccttatgctatgactggatctctcatgggaatgagatcttagctttaatttttagaatttaattaaagcttcacaagtataaatataaa

SEQ ID NO: 395907 - DNA, 350 bp, Homo sapiens
tggatccctgggtgaaaaagattttataatattagatgagttgagagaaccaatgtgaattaaagctgactggcttaaaaaaaataaacccatcaaaattagtaagggaataatgttattcattgcctttttttcgttgagttatgaaagctcttcgaagatgaaggttttatgaaactcaagatctctccagaggccgggcacagtggctcacgcctgtaattccagcactttgggaggctgaggtgagcagattgcgagtccagaagtgagcagattgcttgagtccaggagttcaagaccagcctgggcaacatggcaaaacccctgtctctactaaaaaaaaaaaa

SEQ ID NO: 395908 - DNA, 538 bp, Homo sapiens
aggactaagagaaaatactaccacagaatacaagggagtagaaatattccagaaatagatgggaagcaataatgttaaatgtagcaaaagaaaggagaagataaggtgtggaaagcattctttgggtttgccaattaggatgctactggcgatttcagaaagagcaggttcagttaactccgtgagaatggaagccacacgttatcaaatgtcatagagcagccagtaaaatacagactgaaaaaatagggagctgaattcagtaacaaggaggttttcaatgacctttcaaattcattgcagtttgacttaatgaagtattatgggtaactggcaaaccgcagtggtttggtatagggatgggagagtaagaagtagattgcccaatagatttattttctctatgaaatgggaggtgatcattgcatgtggaaattgggagggaaggaactagccttccagtttgaaataggagatttcagttgggggttgaaaaactttctctgtaagtggacagtaaatattttaggcgttgtag

SEQ ID NO: 395909 - DNA, 495 bp, Homo sapiens
cttaattctgctagttgattgtgtctttactgaaaagaacccagctaccaatttgcctttttttacaccacaaatcctaattagaaacttgaggttttatagaaatcatttaatgatagagattacatatgtgaattaatgtgaatatagtatctgtgcttcctgtgtctatgactattttaagatataattgtgctgcgctatcagattaacatttggaagtttctagaacagttaatgctatttacagaaaggagtagaaactcatcaactggcactctctttgatttttatattttaaattaactctcttcgatctcaaagtatattttacgagtaattttattaggaatctcttatagtgccccaatgggataagctatttgcctattttcacagttctgaacttggaaagaagcaaagtatatgtaactaaaccacatatttgtctttttattgctttttcccttcttttatatgctaaatcaaatatag

SEQ ID NO: 395910 - DNA, 884 bp, Homo sapiens
ttttttttgagatggagtctcacttcttcacccacactggagtgcagcggtgggatcttggctcactgcaacctccacctcccgggttcaagcgattcttgggcctcagcctcccaagtagctgggactaaaggtgcccaccaccacgcctggctaatttttttgcatttttattagagacgaggtttcgtcatgttggccaggctggtctcaatcctgacctcaggtgacccacccgcctctgcctcccaaagtgctgggattacaggcgtgagccactgtgcccggtctgaacctttatctttctattaatagtaatattaacaaggggtatctaaactaataaaagtataaaagtcccattaatctcattaagataatatgtttaataagatacattttaattaaaatgtattcatgtttaataataattttcttataatatttaatatatctatggtttgattgatactatataactagtgattctaatcataactcagtgcacaagaattcttaagggttatgaccacaggaaaatattaaaatatcaaatttaaatttatataaatatttttattgagaaaagtacaagacaggatctgtgcaagccatctagcacaaagtaaattacattagtataaaattctaaggagaagtagaatggaaacaaggtcaaagagaaaaaggaaaatgtaaataataatttgtccttaacggtttttgaatagatgatgatggatatcaagtatggtatttgtattttattggatacttccttttctttaaaaaagtgatgcttttttaaaaaacagtctttaatacccaagaaattagatctttgcaactctttaaattttcgacgtaaaacatttatatatcaa

SEQ ID NO: 395911 - DNA, 355 bp, Homo sapiens
aatcactaaaaatccagacaactacaacgttcaacacggaaaatgatttaataggtgctctctgaaatagccaataatcttctgaaatgatgctgactatcctaggtcactaggaaaattcatactaaactttcaacgctcagcctaggcaacatggcgaaaccctgtctctactaaaaatataaaaattagcctggtgtggtggcatgcccctgtagtcccagctactcagacggctgaagcgggaggattgcttgagcccgggaagttgaggctgcagtgagctgagatcatgccactgcactacagtctgggtgagagagtgagatcctgtctcacataataaataaataaa

SEQ ID NO: 395912 - DNA, 277 bp, Homo sapiens
gttttaagtacaatgctaattcttctacacatttcttggcttcctcataatgctttgtgtcttcaaccccactacacaaagtaataggctgctgctcagggacctggaggccaaaagaaaagatctgtatgagtgctcaattcattaattgttttatttagtatagtttatgcactcataatgctgacactggtaacatcaaaacgcccactaaatttactgaattctttcaaaagatctttcctattaacatgtatctttgcattcctttgttttg

SEQ ID NO: 395913 - DNA, 274 bp, Homo sapiens
agctcacagtgaattgtgggctttctccctttccttttgagagtttgctgtgggaacgccagccaggaagcctaaggcccatttgcagttccagggccaagccagaaaaagccacctggaaccctcctagctcaggtaacaggcacattcccccctccacaggaagagctcacagggtcagcactgggcctccctcctgtttctacagggctctgaacaatcacctattggaagccaccactcccacgggaagaggcaagcagcctcgccctgg

SEQ ID NO: 395914 - DNA, 208 bp, Homo sapiens
cctgggcagtaccaggccatcacttcacctgccttgtgccctccacccgcctgagggaacctgccctgtcactctgtccttggggctggcctttgtaccctggttcccaccagctgtctcctgccactgaaactagcccctgcctaaccctccacatttcttacatttcccccaggagtctccccacattaccacctatgcaacaaca

SEQ ID NO: 395915 - DNA, 808 bp, Homo sapiens
gaccttgggaggtctcaggtactgaagaaatccatgactgaggctttctgccaccatttctttatgatacctgaccaataaggagagggtaatcttatttccagattatgttaatgaaaaaatgagattatacgctaagctgctcctagatgtggaaagagtaatgattccagccagttgtttttaattaatctcttgtgttcttggcttatctggtcccagaaaatgaaagccatgaattttacaatacgtgtgccagatcacatgtgtaattcagtggaaaacccctacacaataaagaaggaagctttacaatgaatagtagttccctgggtcctaggaaaacttgaacaacattttgcaagctaaagaattcctccttctataacccacttcactctgaaacatcagagttttttgttttttgttttttttgaaatggagtctcactcggtctcccaggctggggtgcagtggcacagtctcggctcgccgcaacctccacctcctgggttcaggcgattctcctgcctcaggctcccgagtatctggggtaacaggctcccaccaccaggcctggctgatttttgtatttttattagagacagagcttcaccattttggccaggctggtcttgaactctcgacctcaggtgaaccgcctgcctcagcttcccaaagtgctgagattacaggcatgagccatcacacccagccagagtgtatctcactgttacctgaaattatccaaagttgtagatgatcaaaggactgggtatggttggactagtcggggtcctctagtcag

SEQ ID NO: 395916 - DNA, 185 bp, Homo sapiens
agagacaaaatgagtgagtcgagtgagccatgatcacaccactgcactacagcctgggagatagagaaagtccgtctcaaaaaaaaaagtacagaaggacgggtcaaatcgtcttctatctcttcccgcccagtaaaagagcagttgatatttaaaagaaaaaatattttaaaaatagaaatata

SEQ ID NO: 395917 - DNA, 799 bp, Homo sapiens
gttttatcatgcagggccatgatacaatgacaccattgtatttagcattgccttattacagtatactagtctgacactacttgagaaaagtaggaaatttaaagaggtaaagtggagacaacattggtaggagtagaaaacaggaactaaggaaatagtgagaacatgggatgattcaccctggaggcaggaagacagagaagcaaacacaattgttatcaggaatgcatgaatgatactttacttcactgaatctaagacatggtgaaatgtaagatgcacccatattttatgtactgagaaaaaatactaacaatcaaattctggaatgccaatgattataatatgaatcctgatttcaccaatatgaaactgtgaaaaaatgttaatgttacaataaaagaaatgggttttatacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggaaaaaaaaaaggggagggggggacacaagagtaagacgccaccgacaactatggtagacgataacaaaagagagccgctaccaacagagggacggcatagaaactaacaaagacacagggaggacgcgataaaaaacaagacgcgggggaagagaacaaaactgctgacagagcggatgtgagtaagaacaaccactcacggggggggcaacaaagagggacagaaaaacacaagagaaatataacagcctgcagaggaaaacacaaagggagcaaaa

SEQ ID NO: 395918 - DNA, 649 bp, Homo sapiens
cacatcttgatttgtacagtcataccgtcactgcgatagaaaatgtaagtaattaaaatggttcccaaagctaggcacaatggtgggcgcctatagtcacagcttcttagggggctgaggcaggaggatcacttaagcccaggagttcaaggctgtagtatgcaatgatcgttcctccacatagccactgcactctatcctgggcaacatagtgagacctcatcccttacaaaaagggggaggttccaacattaataccatgtacctgttattgtaattccccatgtatatcatacaaaggggcacatactaataggatcatggttggatgtggtatgatttgggctgtgtcagtaaattggacctaggaaaacatgcttatttgccctgtttgtatgtaaaaaacagctaaaattcctgtgtcttctatttaagtagagtgaggacatttatataaaaaattttatcttctcattacttctgatagctcagttgaaaactttgttttacggctgttgcatacacttgactccttctcaaaccaactcctggtgctgtggatcctgtacccacctgtttcattttcattcattattctcccctatgactaaaattcacttataaatatttttaggactttgcatcttca

SEQ ID NO: 395919 - DNA, 163 bp, Homo sapiens
cctttaaagaggtgattaaattaaaatgagaccattaggatgggccgtaagccattctgactggtgttcttttaagaagcagaatttgaacatggaaagagacaccagggatgtgtgtgcagaggaaagatcacataaggacatagcgaggaagccaaggaga

SEQ ID NO: 395920 - DNA, 460 bp, Homo sapiens
ccagtgtgggagcaatggaggtgttcagaggtggtcagactcccatcgaatcttgaaggtggatccactgggatttgttggctattggatgtaggataagacaaaatgggagaagtcaaatttgactccagtttttggctggagtgactggaaggatttgtttgccatttattgagattgggaagacagaggcaggggtagatttctggggatgatcagtgattcagtttcggacatgatgcatttgagatgcttttcatgtatgtaagggaataggcaagtgtggggttcagggaggaggttcaggctggaaataagatttgagaacgacataaagatggctttgaaagcatgagagtaggtgagattatcaaaggagtggttttagtaaacaaaaatgaagaggtccatggactgaaccccaggctcttcagcaacaaggagtctgtgaacacaggag

SEQ ID NO: 395921 - DNA, 378 bp, Homo sapiens
aggaagagaaggaaggttggggggttcagctctcagctctgttggagatattatacgggagttattccaggtgatgatctagcacctaatgacctaggcactcggtctctgacctacagtgttaacctaagacaagaatctcttctgggtgtagtgttcatcccagacctagcacagctctaaggagaaggaacccatcccgtcccctcagttgggattagtgtttgggattactcaatttgtagttttccaacagtgagcttatctgggcaaacaagcaaagaacttctgtggccaggccaaggtgggcatatcctcaccatcagggtctctggaccacctcgcttttcctgttctccacaccccaccctgccccac

SEQ ID NO: 395922 - DNA, 227 bp, Homo sapiens
cacaagaagcacatgcccaggctggagaccaggagggccgtgtacacactcctagagccctttctacaacatgcgcgaaccacgaagttaaagggctggaggcaaagccagagatcctccggcttcacgccaccctcagaagttagccgaggcccactctggatgaaaacccccaactaagctgctttctgggtctgcatcgtcgagaccggccaccccatagggag

SEQ ID NO: 395923 - DNA, 512 bp, Homo sapiens
tgaggctcaaaaataccttcaggatagttgtatatccagttattgattttcttaaaagatgtgtaaggaaaacagtttcaatttcaggggaaaagtaaaagtttttccctaagtcacttaaagcctttgcaacttcttttttcagttttgtaagtaatatatctatgttcttttcattatagcaagcattcaatgtgaacaactttttaattaactctgaattaccattcatacatcctaaaaataaaagctcgttattcattaaaatcaactgatcccatttttcttaaaatttccctgaaggcaaatgtctgaagcacctttcccttgtgggggtaaaaatcctaaattgctttatttttcattccctcctattcaacatgggagcagcatagagacccaaaccatgtaaacaagttcagtgaaccaaaacagccacattagcttcagtaaaattatagctagatgtgcaattttttccgccaaaccattctaatgttggagcggccgca

SEQ ID NO: 395924 - DNA, 473 bp, Homo sapiens
taaaactgattaaattatacgttaaaggaaagcacattttaaaccttaatgtgtccaaaaggttggatggcaaggtttgggtgctactgccttggcagagacaaggcagggaccagggaggctgtgtgcatgattttaggaggtgagaaactcaggtgggaaggaattgcagaagcctgtggttcacctggaaagccagggagagagagaggatgtattctggtgacctaacaggtattgtgaataatgaatatgcttttccaaagcgatctggtctccctgttggagagcatcctgaaataacttaagaaatgtaccttgctttcaggtttcctgagaacatgagggcccctagacagagtacaaggtgtaattcagacagccagccagaaaaagaattaaagaatcagggcaggtgtggggatcctaacaaaacctaagcttttagtagtcagaaaactgcaataacacag

SEQ ID NO: 395925 - DNA, 644 bp, Homo sapiens
ctatgtatctaaggtatcatcactgtgccatctttgggaagaatgagaaaatagccactgcaataattttctggagggctattttttcctatgggacactgatggaggaagaccacagcccattgactagaaaaaggcctggaatggagttcacgccctcagagctcgtgcaggagccatctatgaactacaagcacattgactccgtatcctcacatgagccctgggaggcagccactgttaatatcctcattttatggatgaggaaactgttgccctgttaaagcttaatcagctttattatttgcttcccatcactgctgtcacaacttgccacaaactcactgatgtcacacaacacaaagttattatcttatggtttgggaggtcagatgtccaaagttggtctccttgggctaaaatcaaggtgtcagtgaggttggttccttctgaaattctgaggggagaatttgtttccttgcctttttattttgtttttgtttttgagacagagtctcactctgtcacccaggctggggtgcagtggcgccatcttggctcactgtaacctccacctcctgggttcaagagattgtcatgcctcagcctcccaagtagctgggattacaggtgcatgccaccac

SEQ ID NO: 395926 - DNA, 843 bp, Homo sapiens
tcttgctctatcacccagtctggagtgcagtgatgcaatcacggctcagctcactgcagcctcgacctcccaggctcaagccatcctcccacctcagcctcgaaagtgcacaatcttttgaggcctcacacagatggtggtgtgaaagggtcaaggctgtggaggcctgctagagggccgagttccatttccccttagagtgagtgcagggtcagcctctcagggctcgggggcttcagtggccctgcctcggagagctccagccaatggccatgtcacgcgtgaggcagctgaggggccagggcagcagagcaaggtctgttgccaggaactgactgccctgcctcccagcagcaggtcagaggtggggcatctgggacaggtggccacagcagcctggagacatcgcagaaggagaccttccgtagaacaccaggagcccagcagtgaggggctacaggaccaggacccagggtgaaccaggtgaaccaggacccagggtgaaccaggagggtgaaaggccaggcactgcccagctaagggctgcagcaggcaccgcctgctaggagagtctcaaaggacatccacacaagtgaccacaagctcaaagtcaacttgaaacatgggccacagatcgcctgaagccagcttacccccttgggacacagaacagcccccaaagacgtccatgacctaatccccagaacctgcgcatatgttacctgacacggcaagagggacttcgcatatgcgactgagttaaggactttgaaatgaggcgattatcctggattacccaggtgggccccaggcaatcacagcaatcctaatgggggaagacag

SEQ ID NO: 395927 - DNA, 525 bp, Homo sapiens
aggacccttgcatagtgaggaaacctctttcagcccatataacagcatggcggtgcaggatatggaatgcatatttagagtcagtagaaatattgatgcgtagtccccttgcaagagtgaggtcccgagttaagacaatgagttcggcttgctgagaggtagtggagggcagcagagcactagcctcaatgatagatgtggatgatattatagtatagcctgcctttgctggtgagtggcaattaggcctggtggaactgccatcaataaaccaagtgtgatcagggtgagggacaggaaagaaggaaatatggggaaaaggagtgaatgtcaggtggatcagagagatacagtcacgggcatcaggtgtgctatctggaataatgtggcaggccggattgaagtctgggccagaacagtggtaactgtgggagactcaacaaagagtgagtatagctgaaggagctggggagaagaaagtatatgtcaggtgtgaggaaggaaatagattttggaagttatgag

SEQ ID NO: 395928 - DNA, 305 bp, Homo sapiens
tatatttagtaatattagtttagctatgttctagacactattctggggactgggatattacaatttaatgttgaaagcattctgattcattttcagagacaaaaaaaacaaaaaacaaaaaactattctcaagctatcatataacattgtcctggaggtccaagccattgtgacaagaaaataaaaggaaataaaagataagtagttgaaaagaaaaaaacaaaactatcatggtttatagaatgtattattctctacctagaaaaactgtggtaattaactgacaaggcattagaactaataag

SEQ ID NO: 395929 - DNA, 276 bp, Homo sapiens
ttcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcagaggttgcagtgaactgagatagtgatagtgccactgcaattcagcctgggtgacatagagagactccatctcaaaaaaaaaa

SEQ ID NO: 395930 - DNA, 146 bp, Homo sapiens
acattcactactgcaacacagccaccattccaccaagacgccctagcaacctatacaagggaactgaggtcactgacagacaaccctggctgagctcccggccaactgccagcaccaacttgccggccacctgagccagccttttt

SEQ ID NO: 395931 - DNA, 741 bp, Homo sapiens
atatattcttccagacctttttcctgtgtattgacttttaaatagatgtacattgcaatagtttggattagctcatccatagcagggtggttaaataaacagtggcacttttttttttttgagacagagtctcaccctgtcgcccaggctggagtgcaatggcgcgatctcggctcactgcaacctttgctttccaggttcaagcgattctcctgcctcagcctcccaagtagctggaattacaggcgagcaccaccatgcctggctaatttttgtatttttggtagagacggggttttaccgtgttggtcaggctggtctcgaatgcctgaccttgtgatctgcctgccttggcctcccagtgtcaggatcctggccccagtggcacatttttatgatgcatctggtactaaagaaggagctggctttatgacctttacttgagtatttttttgtgtgtgacagttgaacaattctgacccctattattgttggctggacaggcattttctttttaattcctctatgcaaggaactgtggattgcttttttctggatagctagaacgaggccattttctttcaaaagacagtcctagagtttccagtggttttctttaattgtgtatgcgtgagtgtgacagtgtgtgtgcctgtgtctctatctgtgcatgcatctgtatgcacagtttcttagttgtggacaatgcaacttggaatcattttagttttccaattgatt

SEQ ID NO: 395932 - DNA, 406 bp, Homo sapiens
ggaaaggtagactgagtaaagcacattgccctccctaatgtgggtgagtctcatccaagtagttgaaagccttaatagaacaaaaaggataaccctcccctgagtaagataatttcttctacctgactgccttcaaacagggacattggctttttcttgccttcgaactcaacctgagacattggctattccttggtcttgaggctaccagctttcagattagaaccacatcactggttctcctgggtttcaggccttcagactggaactacaccctgcagattttgggacttgtcactttccataattgtgtgagccaatttcttataataaatttatctatctatgtatccatcctatttgttctgtttctctagagaactctaactaataaagattttatgac

SEQ ID NO: 395933 - DNA, 805 bp, Homo sapiens
ttctcaaaaaaaaagaattgagtcttctatgtctgggataatttaaacatggggtgttggattgggtctcttgattctgtaattatatgtcagccagtcgaatgatggcaacttttaaggactggtccttagggaagaggaggtcaagtggtaaagacctaattccacacagcccaggtgactacatggagaatgtgctcaaaggcgaagtttatgctctgagctggacagtgtagactattaggggaaaacagtgaatgggaagaaaaggtgtgtggcccagattcaatttctagacacttcctttcctattttttctaccaagactacctagcagtggcaagtatgttctgaacattctgcagaaattccttctacctcactgaagtttcaagtaattaatgtgaaatggaggagttgacacagattaaatgggcacacatataaggacattcacagtcattttgtgaagcactattatgagacctaaatagcaagaagcaaatgtgaataactctgtcatttaaaaatttttaaatccaaattggattttaacatttttcttctttttactttattgcctttccaatgcagataccgttaaacatattggcagttttttctcaaagcaaataggtgaagtttctctctgtctctcctagagagaccgtcctggatttgattccctatggcttgggcttgtgttcctcccttccttctgtggtgtgctgtagaaccatgcaggcttccctctccactatgactgacttcaactgcatcttcagttgctcttcttccctccaaa

SEQ ID NO: 395934 - DNA, 164 bp, Homo sapiens
tcccctctgctagagcatggactaccagctgacctgccgagtcactcaccttaaatgttagcagtagctatggggtgtgtgtgtgtgtgtgagagagagagagagaaagcaagcaggcagagtgtgactttttttttttttgagacagagtctctgttacccag

SEQ ID NO: 395935 - DNA, 1056 bp, Homo sapiens
tgaggcaggagaatcgcttgaacccaggaggcagaggtggtagtgagccaagattgtgccattgcactccagcctggacaatagagcaagactccgtctcaaaaaaataaataaaattaaaatttaaaaaaaaatcaaaaaggaaggtcctaagaaaggagagaggtgagcaaagaataaggaaatagttaggtgatagacacatacaactgttgaggaacagaaagaacaatagaatcaggaagaaaagagcactttacaaaatatccttcagtatactaaaaagtgtgagtgtgtgtgagtgtgtgtgcgtgcatgtgtgtgcgctatagtgagattatttagaaaacttgccctgagttcattttcacttagggttggttttagatttgtgagctttcttgactatgctaatcctcgcctctttggtactcaacacccaatcctcccacacaaacagagtctgtcagaattatctcttttatcacttgatattcagctcacatttactttctcagacttttggaagttaccactcagacagatgcaaattcagtgcgatgcctgccaaagtgctgagcagaaaagagactttcttttacaccttccatcttttgagcttttggtcctactctttcaatttttgctaaatagtaaatggggatattgttgtttttcagatgaacacgtgagtacatttgcattactgagcttgctgtctctagttctaaagagattctttacaatttccgtatcagcaaaggaattgccttgatttcctttgatgatgtttccctgctgatattctagacctagcacagaagcaattggtaccctcgtgaaaatggctcttgcccagtaattctgctttatttgtacatattcagctttaattacaggggtaagtgggggaaggagaagaaagccaaaaatacccactgcccccaagtggaagaacaagaagaagcttgactccctcaacttgcaggagtacaattatattgtaactgaggttgttttcctagatgtcagccagaaagataaacactcaaagtt

SEQ ID NO: 395936 - DNA, 823 bp, Homo sapiens
ggtccgggcccccgtaggaagggccccccgagctccctgcccccgcccttttaactccccccacagacggagcgcgccgacggttctgctccgggcatctttgaatcggaggcacagttgtgacgtggtctgagcgacgacactcgtgcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcac

SEQ ID NO: 395937 - DNA, 185 bp, Homo sapiens
acaaaccaaactcataaagattggaagcaggaagacaagttgcctccaggtttgcccaacggggatgttctttcaggcctggacatactggatgagcggggggagtccagacccttccaggcatccaagggccctgtcagccaccagacacatgcactgagacccagccagggaggcaggatcta

SEQ ID NO: 395938 - DNA, 354 bp, Homo sapiens
ctgcactccttggctttctccccagacaaacccaccctgagctcaggatccctccagcttccaggagcaggtgcggggcctgcagggacggctcgcagagaaggcagtttgcgagtcagtgcctggcttgtggaggttgagaccaaggccagttgggtgcttgcatttccaggggtccaaatatttttgagaagaaaatgttctaagaaagtgcacagggtggtggatgaaagaccacgctctgggtaccgtgtacaccgctcgggtgacagtgcaccagaatctcagaaatcaccactaaagaacttacccatgtaaccaaacaccaccccttccccaaacactattggaatt

SEQ ID NO: 395939 - DNA, 357 bp, Homo sapiens
gggctccagcacatcctgggtgggtaccatctgggacttagagcatggtagtataaaaatgaactccgtactggtagttttgaagagcaacatgttcctactgagtcttattaaaacagtaagagattcctggaggtcagctcatctaactgaaaacctctgaataaatcttgtgtatcaccaccaacaaatattaatctcttttcactgtcagaaaaagttactacttcaggaagtagcctacttctgaaagactgaatattaaactgtcttccttaacttacactaaaccaactttttacactggcaaaaacaactctagggcggccaggcgcggtggctcacgcctgtaatccc

SEQ ID NO: 395940 - DNA, 507 bp, Homo sapiens
tgaacatgcagtatatgttcagatagaaaaaggaagtgccagaataacccagctttaaaaaggtcttcagaagaaaggaagtctcactttttaaaataaacaaatgagaaagtgtttttgaagaggagcagaaaatggagcaacttgattccagagcactcgctcccctcgtgatgttgccggccacacgcacctgcgacctcgtgcagaaacgtgcagcagtgctttccagctggtggcaggtgatgtacatggtacggagacagagggacgccatggtggcaggagcagccgtggtggagagcacagggcgacactcggcttggcctggatgaccagtcatgacgagctaaaagtcctgccgttttctgctcacacgtcgttcccacgtctgcacattgagtggtgatgttagccggtgctggctgaactctgttctctggcggagagactgccagtttgcagagtggacagttccagacctctgtgaaagggggatcatgaccg

SEQ ID NO: 395941 - DNA, 559 bp, Homo sapiens
cctcccaaagtgctgggattataggcatgagccaccccgcctggcctatgttgtctttattcttaaacattcagagtgcagtctcaaatcccatcccacagagctgtaagaagctcctaagaatgtgttacaggatgaggaggctgaggaccagcctggacagtaaaacagttcctctgtggtgagactcatcagtctctttgctgtagtgaggtctccctcttggaaagaaaggttaactaccttgtagtacttcaagtcctgtatgaagtctttgttgttcattggtaattcatattaggatttttctttcctatttataacttgaattttgaaatcagtagtgttagaactactgttattactacattcactgattagtacattcctttgtattgtcagattgtaacagttctggggcaagcactcggtttcacctttgtatttgaagtagtacaccctagtctggtcaacatggtgaaacccatcattacaagaattagccaagtgtggtgcacatgcctgtagtcccagatactctagtgactgagatgggagg

SEQ ID NO: 395942 - DNA, 130 bp, Homo sapiens
tacagtcttgggatttttaagaatatcttgtatcatgtgactgaggagatttttcctgaaacagtaaatgtcctacctacctttactagaaatattattatgataactattaagtgggctcatctgtaga

SEQ ID NO: 395943 - DNA, 583 bp, Homo sapiens
agtggccaggcagaggggctcctcacttcccagtcagttgggtggccagacagaggcgctcctcactttccagacagggcggcagccagagagaggtgctcctcacttgccagatggggcagcagccaggcagaggcactcctcatttgctagatggtggggccgccgggcagaggggcatttcacttcccagacagggcagcagccaggtagaggaggcacacgtatttttattgccgcactgttcacaatagcaaagacttggagccaatccaaatgccaatcaatgatagactggataaagaaaatgtggcacatatacaccatggaacactatgcagccataaaaaagcatgacttcatgtcctttgcagggacatggatgaagctggaaaccatcattctcagcaaactaacacaggaacagaaaaccaaacaccacatgttctcactcataagtgagagctgaacaatgagaacacatggatacagggagggggccatcacacactggggcctgttggtgggtagggggcgagaggagggatagcattaggagaaatacctaatgtagatgatgggt

SEQ ID NO: 395944 - DNA, 477 bp, Homo sapiens
aatcattttatggcagttaactcaagccagcagatcagttgttaaatattatcatctagctgagttgtcacatcagttatttatttgtactctttgttgttttttatttatataatttttcatttgtaatgtctatatgctctttgagaacacagtctatacctccttcaccttccagactgctacataaacataaactgttcaataaatggttacttaatataaatgaaagaatacttcttaaggacagattgaacttattttccaaatagtagtctagttattttctttcttggaaatcaccatattgttagtaggaattatgtatttcattttgtttgtttgaatttcttgaagaattttgccaataatagatcaatcttatatagtggtatacctgaagatgctaagaacaagaaaatgcctttaatctaccaaatttgtatgagcttgattccatttctgtgtctttctttt

SEQ ID NO: 395945 - DNA, 543 bp, Homo sapiens
gctcggtaccgattacgctctagacggcagcactccggccccattgggcagtcccttcaccatttcctcctgtgccctctgaaattgcatgatgtgatttctccattcccggggttggggttcttctggttgaaagcattcagaaggctcagcctaaccagcggaggactttccacccctgacaagtgctgaccgtcctgggctttccacccttgcccgcgcctgggatgtttgcttcagtagcagctgtgtgtgccatgggcaagcccttggctggcgagtgggcatttctctacccctttactcttggctgctagtcctgtcctcttacaagaggtgtcactatgccatgcaccattcaggaaaattgctgccaattaagtcatttatgaccaactatgtttaattttcacatcgagtgtagctcatccctattgtgaaagaaaccatgtttcatagaataggatgaaatgtgacaatgcagcctgcctggtgacacgagggtgcacgtgacaaagcacatcagcacttagcacagtgctc

SEQ ID NO: 395946 - DNA, 471 bp, Homo sapiens
tcttcagactcttctggaaaggttaataagcccctgatggaatggtgtggcaagttataatctgctatcaacacaatgcacatcactgtccactcatctttctctggggtaaggttgtacatgtaagtatacaggtaacaaacagttactcctgaatcttggcatccaaccgcaaggacagcatgaatctagcttcctttacttcacagcatgtttacttttagtgtttaggctgtttagcgtggagacctgggtatgacgtattactgaacacgactgctagacatcagtaaaatgggaacggggcctgctccagcaagctttgaccagggacattttatgaaattgctacctagtactaaatgctctgtatcagtgccctttctgggattcagactggcagatctaatgggttctcttagtgcataaagcctagcgttatctgttattctagtgcttatcatttgcaaa

SEQ ID NO: 395947 - DNA, 576 bp, Homo sapiens
ccccagcatccatcatctcatttagtcctctcaccaactctgtaagagcagcttcattatttgcatttttgcagattaaaaaatgagattcataaaggttaagtgccctgcctggggtcagccgctagtgagcaggggagcctagttgcagtccagccccctggctgcctttggcccctgcaacactatctctcactgctctgacaaaatgtcatttctgaggaaggcaggcacacagacccaaaaggaatgggtgccgggggggaggccaggatgagatatttgtgagtgggtttgttctgatgtagcaaaaactctctcgttgctgtgggctgggaagtggctgactggctgcgtggtcagagtttgcaaagcttttgcagatccttttgctagaggggctttaaaagctgcaagcgctcagcagttcctatcagctgggatttttttcctccagattgaatcctgtcagggttttactggctcatctgttcccagaatgacaccatgtcccctcacctgagcagcacggccttgccacccacggtactccctgctaccagacggctcccggaa

SEQ ID NO: 395948 - DNA, 336 bp, Homo sapiens
gtcggatttgatttgctaatttctgtgtctggttttggtagcagggtattgctggcctcataaaatcagttgggaagtgcatactccggctcaattttccagtagagtttgtctagaattggtattattgcttccttaaatatttggtggaattcataaataaagatatccaggcctagatctttctttatgagaaggtttttaacttcaagttcaattattttgtagatgtaatgtatttgggttatttattttgtaagaggtatttagcaattggtatcttaaaaggaatttgttcattttgtcaaaattgtccaatatatagatataacatgt

SEQ ID NO: 395949 - DNA, 457 bp, Homo sapiens
aattaaacctcttttctttataaattacccagtctcaggcagttatttataggagtgtgaaaacagactaatacaaaaaaatgaatactgcacagaatgttgtcatgtaactaagggaagacttcatggaagctttccatggatggaaggaaaagttgcaaagaagcttcacgtggattggaagggaggttgctcagaggcatgtcatgagtggaaagggaagggtgcagaggttatggatggaagggaaggttgtaccgaaacttatggatagtggaccaagaccagagagaaggaagagggagggaggatcgcctgggtctctagctagttatgggttcttcaccaagtgcagtgtattctgcctgaggagaagtgggtatgagaccaggggccagtcggccaccagaggtgtgaggtcagttccctcatccagctggggatgggctggggacac

SEQ ID NO: 395950 - DNA, 518 bp, Homo sapiens
ggtcagcatctgagggtcctacgaggcaggctaatgttacctatggctcggaacactaatcgatcgccactacagtgtgttgcaaaagacttccggggtatgtaatatcagctcctgttatggccctggctgttagtagatcaaatgtactaaattatctagatataagacttttgagaaaggggatggaagagatgattaggggcaaacagaagcgggttatttcagctcttcaaagtaaaaaaggagataaggttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagc

SEQ ID NO: 395951 - DNA, 227 bp, Homo sapiens
tggtgaggcctctccatgttccaccctctactatgaactggcaatagaaggttctttgcacatgcacatattggggccacttgacagccttgatgaccttagcaaggatcatttcagtggtgtggtcagcccagaagaaaaagatatcccagaagaaactgaagaaacaaaaacttatggcacgggagtaaattcagcattaaaataaatgtaattaaaaggaaaaa

SEQ ID NO: 395952 - DNA, 427 bp, Homo sapiens
ctctttacagtgtgattttgtcagtcctcccatcaagataaaaagtcttaaatctgatctgacttgctttgacaaacagaattcagtggaagtgatgttgcctttaactttttggaacattgccctgagaccaccctttaaataagctagtctagcatattagaagatgagggaccaagcggggagaactgaggaaccccaaccaacagctagcaccaacttgtattttccaggccagccaatgataactgaatgcagcagtatgagtgaactcaggtgaaaccagcaaaggggtcacccagtcagttcctagaatcatgagaaatcataaattattgttgctttaagctatgaagtttggcgtgatatattatgtaacaatggataacatccttccaaatcccacctcattcacccccctgcaaaa

SEQ ID NO: 395953 - DNA, 503 bp, Homo sapiens
cgacactcttgagttgaccagtattattacactaaggaatctagcgctttatcagaaaagttcttgaaaagggtacatgcaacatcaattacaaatatattttttaaaaaagcaataattaactactacaaaacaaagttataaaagaaaattaactcatagcatgacatttggctcagcagtatagaatatttatctcataacataaaaaaatggattatttggccaagcatggtgcctcacacctgtaatcccagcactttgggaggccaaggcaggaagatcacttcagcacaggagttcaagaccagcctgggaaacatggtgaaatcctatctctacaaaaataaaaaaattaaccaagcgaggaggcacacacttatagtctcagctactcgggaggctgaggtgggaggatcacttgagcctggaaggttgaggctgcagtgaactgtgatcacccactacactccagcctgggcaaccaagtgagactccgtctc

SEQ ID NO: 395954 - DNA, 702 bp, Homo sapiens
tgcactggaatcctgtgagacaagggtggtggccgctctggaggtgcctggggcggtcccctcaaggcccttccgggcttactccgtcttccacactgttgagcagctttcctacctcatggcagaggataaacactgtggtcacatccaggcagacccggcccaggtgggggacaatgccgttgtagaaggccttgagcccttcctttctcaggatttgcagccgcagtcccgtgtgttctgcatttgtgcttttcaggccccgcatccgggtctcgatcccgtgcagtggagcgtttcccaagacactggctgcgcctgcaatggctccgaaggccccagcgaccagcgggttcatgggcttgctggggttgtcccctcggtaccagctatgcaggggggtcaggagaagaagcggatggcctggttccagccctgcttcagcgcgggggccgtgaggccccgctgggtccccttgttcccgcacaatctccctaaccccggtgggagactcctctgcactggacgtctggggaggtctggcggtggatgaacttcaccttgatggcgtccatgggaaatatgaccaccacggccccggccacgcgggcgccccagccgcacagcagcctgcgttgttgtaaggccgtccctgggcatccctcgtctggctgctgaggaacaggaacattcagaacccaa

SEQ ID NO: 395955 - DNA, 280 bp, Homo sapiens
gaaatcaaggtgttggggctgtgcttcctctagaatccttcctggtctagtccagctcctgctggctccgggagttctttggcttgtggcagcataactccaatctctgcctctgtgttcacatggctgcctcctctctgtctctgcgtttcttctcttctttttaaagaatacttactgcacgttggatttaggacccaccctaaatctcggatgtcattctgaggtccttaattacattttcaaagacgctatttttgaataaggtcacattcacagg

SEQ ID NO: 395956 - DNA, 525 bp, Homo sapiens
atcacctgttgtttaatcgctaacactgttacatatcttaatactgtatcacattaagtcattttaaaagcattctgctttcccttttgtttaaaattcctacgatccctgggatattggtagggggttaatggaagtcttgattaaaatcttccaagctttaaggctttcagttcttgtaaacaatttggatctgagagataggcctatttatgactttttactagcctatttacccatttaatgttaagaaaaaaatatgcttattaaaagttttgttataataagtacaaattaaaatgtcttttaaaaaatcagccacacttcgttgtgtgatgatcacagaatttatggtagttcttttgaaaattgtctgaagatgtattataatcattttaaaagtaaaggaactaccctgagtataccaattttccattattttaaacaaaccttttaagttttatatctagattgcttttaagtagttatttccaaacttgaaggactatgaactctaatcataat

SEQ ID NO: 395957 - DNA, 139 bp, Homo sapiens
atgtattattcatgattcttcagagacacaggaaagataggatatatatatatatatatatagagagagagagagagagagagatttactataaggaaatgacttagcagttatggagactggcaagtcccaagagccg

SEQ ID NO: 395958 - DNA, 213 bp, Homo sapiens
attggtggtgctggcaaatgaaatgaagaaaagtcaaatatgtcttggaagtagaaccgacaaaagttgctaatgtgttggatctggatgggtagaagtgaaaaggagaaatcaaggatgacttctagatttcgagattgttttgcaagttgatggtgccttctacaatagggaaaatgttggggaggaaacattgggagcaccaccaataca

SEQ ID NO: 395959 - DNA, 840 bp, Homo sapiens
ggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctgtcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttccagggacttgggggtcctgactccaggcctcatcctgcttacccctctgttccaagcccagctttctaagccatgggaatagaatggcccttttttctggtgtccagggtgaacgc

SEQ ID NO: 395960 - DNA, 487 bp, Homo sapiens
agaaaataaattacaatagccactaggtggcgatcgagtattgctgaacggacagcaaacgacaagctgagtctaaactgtggccagaaagatgtgaaactgagcggcaaatagcccaaatatgaaatgttgagggcaacccatgtggttagcgtatttatcgatactacagaagccgcagagaaaaggagagcggacatatattctctctctaaagaatgcgggtgacttaaaaacgtttcccccagaactttactggaacagcgctggaaccagcagcgatagttaaccaggtagtctgaaactgccatagtattcactgcaagtaaagggaaactgaaattaatgaagcagacaaacgtctccgcaggtcatggcaccagaaatgttgatggctgatgtaataccttggttcttatcttcttagtttaaaagaatttaaacaagagacacacagcaaaagaagtacagcataatttattgcaaa

SEQ ID NO: 395961 - DNA, 449 bp, Homo sapiens
ctcttatttgaataagtgatcttggagtgtttacccattgtaacaaaactccttttctcataattagaatcattaagaaatttctcctacattttagatgacggaggtgtgtgtgcacgtgtgtgtgtatgtgtgtgtgatcaactcattgcatatttcttaaaccacaatattgtttaaggaattttagaaaataattactcaataggaaaatgttggccaatcctcagatatttagataaggctgattcaaatgcctattctttcactgttctcactatgacactcttatttttattattggcctgacttccgcagttattttgaagttacagatttttaaattttgagttgaaaaaaaagagcaaatttagattaaggaatgagaagtagtcctcgcagcctcatgaatctcctgaaatttcgaacggcaaaatctaaaatctaca

SEQ ID NO: 395962 - DNA, 400 bp, Homo sapiens
aagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttggtaagt

SEQ ID NO: 395963 - DNA, 243 bp, Homo sapiens
tctgagcaattttccagcatcctggtgtgcagatgaaagtccagggtaagaaggaaataaaaggtaaattaaatgaagtagcaactatttctccagccttttaccatgcaggagcagctttgtacagcaccatcttatctggtcttactggccaaggtagacaccagtgagtcctaacacagtccttacagtcctagcttgtaagagagaagaaatacctactatttagttaacagacactac

SEQ ID NO: 395964 - DNA, 131 bp, Homo sapiens
ggatagatggatgatggatggtggatggatgatggtggatggatagatggatggatggatggatggtggatggatgttggatggatggtagatagatgatggatggctggatgaaggatggatggatggtg

SEQ ID NO: 395965 - DNA, 546 bp, Homo sapiens
aacatagcaaccgcacccatacacaaggggtataacacacgaatatctaacgagctccacaccacgtctataccgagcaaaacgactaatcacatacaaggatgagcaaccgataatactagacattgctcaaacgaagacatacaaggacgggtgtggtacctgcagtactgttagcggttaggcgtacggacagggctattggttgaatgagtaggctgatggttttgataatcaactagtatggggataaggggtgcaggtgggtacttattcaagttgtagccttcatagttgataaaaaatcagcacacattaagaaaacaataacagaactattttcttcacatgacttttattccttaatccagactgttaaaaggactgcaagacaaattgtttttcaatcagatttttttctccaccagatgtctatgtgaatttcatattgttttagacaaaaatgctcattccttcggtctaagtactatgtcatattttgttttttcaagccttcaaattttgtgctggtggttacttcatata

SEQ ID NO: 395966 - DNA, 645 bp, Homo sapiens
tgtctagacatatgttatgtaatcctacatagttatgtcaagatatgttatgtaataccacacagtaatgttgttgtacctattttgtaccttcctaatatctattttgtcatttgagtctcacaatcttttttgtgaatctcaagtaaaataaaccatatgagatgcggtaactataactggatgtacaattgcaaggtatcccaacatgtatcaaatgtatattgactaaagaaagtttatttctccttattcaaaagcagttacataaaaagaaagaaaatgcatttttgatttttggaatatgctagaaattgtatattatctcatttaatcctcacaagttaatcaagcatccccatttctcaatgaagtaaatgaggtttcaagacattaggtaacttctcaactctacagcataaatagatgtacttgtttcactcctagatcttctaaaattaataattatgctctttttttctactatttgttacctatgttttagaattatttttaactaaactgatatatagattatgaaaatctttactttttactatcaagcactatataacataaattagtttctcggcctggcacagtggccatgcttgtaatcccagcactttggaacactttgggtgg

SEQ ID NO: 395967 - DNA, 603 bp, Homo sapiens
accggaccggactccttggtgtgttgctcgctgtcatatgtgcacgcacacatacagacagagcctaactctctgtggccacctggatccttgctagtccaccaacgagccaagcacactcccacccaggggcctctgaacttactttttccaccaactgctacgttctgctcccacatatctgcatggctcccttccttctggtccctactcaaccatcaccttgagggggaacagagtggcaagtccaccccccaacatcccagtgttcctaaccctttaggcttccctgtcttcttcatgaaacagaccaccttgaatattatacatttgtcactgatatcttctccactagaatgtaagctccatgaaggcaggggctttgctatactcactgtggtatccccagtgcccgaatcagtgcctggcatggtcaatagacatttattaggcgaatgagtaaagaagggaaggaaagatggaggagtgctgtaactgtggatttccctccctttccttcctcctccggctcacagcaatgatgggagggggccttttcagtttccaaagccctctctcccctacacactcatttactcctca

SEQ ID NO: 395968 - DNA, 560 bp, Homo sapiens
actgttttgagccaggtgttcatgccacactttatatttctccctctagcatttacatatttcatggtgatttttctcattaaatatctttttccaagactaaaatgagctctctgaaggcaaggcaatatttaatttactgctgcatccatagcatctagcacagtacctgaaacatagtaggcactataattgttgctgaataaaaccagaggtcagcttagctcatatgttgacatatgtgagcactctgggtcacaattagcatcagctggttatgccacctcctgcttctcctagtacctgcatccctgaatcattaagtctagctgcaatagaaagtggggtatggttgaaaggtgggaggagtggttccctctgatttgcttttccttagagaatcttctcaactgtaaaataattgaaagttgcgttcctttctagactcaacccgaactttgttttggtgcaatgtcaccattggaagagaaggctcaaaaatttacctttcattgtgtgttatatgaaatatatctcaataaagctgttacgaacgtaaa

SEQ ID NO: 395969 - DNA, 680 bp, Homo sapiens
gtattacagaactctgtggcattacttaatagttctcatacatcattttgttttcatttcttatcatctgtcccaacaggggcagtcccctctctccctcctatctgcctgacatccctgttccctactctctaggcacttaactcccaaacactattcttaggctgctcacagtctgcccaatcctggtggtgcctaatactaaaatactaatagtatctcatttttccccctacaaatttgaatgtccagggttactttattaaaccacagcctgatcgcccaaagtaattttcaaatgtgggtaacaaccatgctatatctggaaggcagggccctttctcttccacagatgaccgtgctcaatttacttatgccagtgtggagtaactgcgttgccttggcctctgtcccccctccttctgtatttatagcaccccagtattcctctgggaaatcatccctccctgactttcagaacacttattttacccactgtcaactctactctggggctgggtcaggtcggcttcagggattatctcaaggatgagcacaggcttcaacaaagagccaatgagaaccatgctgagggcttcccttcaaaatcttggccaagtcatcccaccaatgtgaaggaaaagactgcctgagaatggcgccagcctagagaagagtgg

SEQ ID NO: 395970 - DNA, 326 bp, Homo sapiens
actcctaaggagacaaaaaagccacaaagaaccctaatctaatttagagtgtgatgcagggcatggtggctgatgcccgttatcctggtacttcggaaggccgaggcaggaggattgcttgaacccagtttgagatcagcctgggcaacacagtctctaccaaaaacaagcaaaattagtcaggtgtggtggcatgtgcctatagtcctagctatttgggaacctgaggtgggaggatcgcttaactctgggagattgaggctatagtgagccaagatcacaccactgcacttaagcctaggaagaccctgtcttaaaacaaatac

SEQ ID NO: 395971 - DNA, 1738 bp, Homo sapiens
gttcctgttgttcttcctgcagagtgtgtcccagccgctgtggtctagggtgaagtgacaccttaagcagatggcagctgggccagccagctcactggaccgatgggggaaattggatcatagagattctaaaacgtggcccaccaaagcacaatagaccaaaaaagagaaaaaactgaacactaaatctgcacaaatcatttctgaccacactaagcagtgcctgcacgatgcctcgtgcgacgcatttgatttttggaagatattcttatctgtcacacagcactgagagttagggaaaactaaaagatgtgcatgtgacggaccccagccttaaagttgaacgtgatgaccctacaaacacccagaaacacaggcactcttcccagcggcgcggacctcctgctcccgggaacacacccgcgctctccgtccacccacccctcaggtgaaggcacagctgtccagagctgaggcttcctagaggcagggctgccagctgccaggtgtcaggtgtggcagagccgtcttctgagctccctgggagagggggtcgcgccacctcatgcctctgagtgaggcctggtgcacaggtgtggaaattgccacgcagccctcttggccaggcgcagagaccccaggcctccatgactcaggggccgctccaccccattgtgcggctggtggcttggggaagagagacgtaaaaccccaagttaggaggtctgtgccgcgccttgccttgcctcaaggtcatccccagcaggtgagcgtggcccaccctacacactcaggtttctcagggtgccactccgtgcctggcgctcagcacgacatggtggattcacacccaagccccaggtgccaggacaagaatgccagcgctgggcatactgccggcccattccccccggcccgagaccctggacacccgcccccccccccgccagctcaggcttctaggtggaatgtggagacgggtttcagccacactcccaaccttagctgttgagactcaactccaaagacggaaagttagaaaccccagggcagagtccaggagccgacctgggtctcacacaggtgtcccagaccagcgtggggatgcccaggtggccaggcccagcctgcggccgctgaagttacacctgccgggtgagtagggctgccgggaccccaccttgagtgggagacccccagtgtatcccagaagtggttaacaagcaaactgctttccatgagcctccttgatttgttaaatattgaaggcacttacctaaatactgccgtgttgccagtagcgtgccggttaccagtttggccgttcttgtacacaatgtgtgagtaatgctgtgctcgtcagaggggagacttttatattcagtaatttgttttataaattaaagtgaaggatgtattgaagtgtggtttgaaaaatcctgatatttgctaatggctccggtcacgacggtgtcttttggaagtggttctcgaaaactctggtgacttgggggctgcacagtgggcctgcgtgggcgcggtgcggggcaactgcccatggagcccgtggctggccggctctcctgtggatgacactcacccttgactgccagggtcattcaaagtcttgcacatccatgaaagactttaatggaaatgttcacattattattttcattaaaagcaggtgtttccaagaagcaaaggtttctgaagccattttctttttttttttctt

SEQ ID NO: 395972 - DNA, 621 bp, Homo sapiens
gctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgc

SEQ ID NO: 395973 - DNA, 341 bp, Homo sapiens
cctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttt

SEQ ID NO: 395974 - DNA, 638 bp, Homo sapiens
tcctcgtggggagactaggctccactggggtcgacttccttgtttttatggaccgagagaaaagacagaattgaaagagactgagggctaaagcgagaggggtctgtggaagacacctgttggcggagagcggtccacgcaaacatggtcatttttaagaaaactaagataagtgctttggaaagaaaatttgctaacaaaatttgctgttaaatggctttgaagtgcttttaggttcactcttctttggcagacactgttgactgggtaactccacacctttttcccacccttttcttcctgatctgcttctgctacagatgctggaaagctaagtgcatgaattcccaagctgtcttcgtggctggatatgtctatgacccacttctgactaaagagtagctaaaaatctgatggggaagggggcagtctgagaaaaattgctttcctgatatagtggacagatgtacttcagctttttcctgccttgaatatagatgttatacccagaggtgcagcaaccattttgtgatcatgaggctacaagccaacattgaagactaatagaatggaaagagagacaatgcttgggtcttttgcggaatcacggagcaacattgatgttggaatgtctccct

SEQ ID NO: 395975 - DNA, 280 bp, Homo sapiens
cttacttttacttttctttgttgttctatatacagtctaagcaaagtctctctgaaaattgtgtgttctaacagcaaatcttaccaattttcttccttgtttgaaaataaatattcaaaatattactttccttttggggcatatatacgtttaacatctcatccttgaagttttcctgaataatgatgtcaaaacaaagcgccttacttgtattattctaagaatgtttggaggagaaaaatagcaatttttgttagagagagttttaggtttatgtgaa

SEQ ID NO: 395976 - DNA, 411 bp, Homo sapiens
gaaaaccagcaccataaaatggagtcaccaaactcacgaatcaggactaatgcccaaggaagcagagtaactaggagttaaagaagaacaaagaaaaattgaaagggaaattgacctaaaacatcgataacagtacaccatttctcaaagttgaagaaagacaaaagtcttcaaataaaaatcacataccagtcactgaaaaagatagtttaatataaagatatctgtacctaagacacatattggtgaaatatgagaactccaaggataaagacaacaaaatttgtaaaagtttccaaagcaacgagcaggctacctgcacaggaaagagaaccaggctagtatcgattgctcattagcaatactcatgttcagaaatagtaatggattagcttcaaatttatgagaaaa

SEQ ID NO: 395977 - DNA, 240 bp, Homo sapiens
aaaatcttaattttttgtactccaaaatgacagataaatattttatttgtttgatactgagtgttctgcatctgacatcctaatgaacactgaacatatttccattcactaatgctgttaaaagaaccacaggcttggttttgcaaaaagatgtatctttgcaaccaacagacttacccattactgcagagatgagaggactttctgctgtttgaatgtatgcattaaccaaaaatacag

SEQ ID NO: 395978 - DNA, 269 bp, Homo sapiens
ctcctgaaaacctgtcctcaactctcctgagcactcagaagggaccctgaaccagctttagtctgcaagactgcacggctggcctctgtcaccttctcctaacacgggagcccctggggctccctctgctgctgtctcccaaaggcctgtagatgacttccccaacaccagcccaatgctgcttgtttcatttgctcattgtgcatgtactgtctgactgccccatgaggatgtgagctccacaagggcagggaacgttgctctggctg

SEQ ID NO: 395979 - DNA, 254 bp, Homo sapiens
gatggcacccttaggggcagagccactgactatgtggcaatggaaagggccctgaaagaaggtggcaggtaggaggagctgaaagccaggcaggaggcacctgtgtgttggtgtgtgggccagagaagaagaaagagcctccaggtgacaagagctgcagaatggggataatgataccctgacaaagcagcagagcttggagcccagcccagccagggggtctggaacagctaagccgcaatgcaccactcaca

SEQ ID NO: 395980 - DNA, 380 bp, Homo sapiens
atgttttggcatcataagtatgtattgacagcctcagtgttagaggctcagcactgtgatgtgcacatgtaagttcacataggaatgagagttttcaagggcagggatttatctttgtttactgttatatcccttttgtctacaacagtgcttggcacgtaagcatgctaaatagattaaagtaatgaatgtgagggtaatccatactctcctgagggcgagaatcctacctgtcctgtacagctctgtgtctgcaatccctagaacagtgtttgcctcccatttgttgagtgagtgaatgtacttcagaacttggtccttgccattaaagagcttgaatctggtttggaagacagattgcaaaatattgaagagcagta

SEQ ID NO: 395981 - DNA, 383 bp, Homo sapiens
ccagcctgggcgacagagcgagactccgtctcaaaaaaaaaaaaaaaaaaggcaaaccaggagaatttgccgcctttcagcccatgaattgggaggacaataaaaaggcagaatcctagaggatattacatttgggaatggaaatcagtagagctctggaatggaaagaaaacattgggttgcactgtaactcatcactggccttatggttgatagatgacaaatcaggtggcatacactaacagaagaatagacacacaggaatgcttgtgtagtacttgttctggttggttactatctctgtagcatttagcttttttcatttttttctaaaatgacattttgaataaaatttttacaaaagtcagtacattactgtaatt

SEQ ID NO: 395982 - DNA, 154 bp, Homo sapiens
tgcgctttgctctaaaggagtatgaatcttaacacaaattacagtgaacacttttcttaattagataagaactttaatttgaagcaagtgctctgtgtcatatctgaaattttcaattaggagcaaagtcttctgcttttattccatgaaactg

SEQ ID NO: 395983 - DNA, 747 bp, Homo sapiens
ctgcagagggagtgtggctgttatggactctggaactgagtacatttctattgtttgaagacaccacctcgtgataatttccacggcagccgcaggagactaattcagagaaagccacaataagttgctgatgtatttgggtggtgatgcagagaaacggaaggggtcaggaatgactgcaggcctggggctgctcggtttggggtggggggtggtgtctcgggacaggctggcgtagctgctgtggtggcacagagcagaggctgtcaggtcatggggggcaatgccaagcctggagtgtcccacaggttggccggggatacggacagcacaccggggtggggagactcactgagcacgggctgcctggagatcatggagaaaccaagtcaggacacggggggaagggagagaaggaaatggggcaacgctttttgctaagtttctatcgttttgtttgcttttctgtgtagcgaaacagaaaagatggatggtagctggggacagagcaggccgaggaagtccttggattttcatgtggaggtgtagcgggaagctgccggacagtggggctgcagggggtggggaagaggttggccatttcccagcgcagggctggttcctccagggaagagtgtgaggtttgcgctgctgctgcgttaaccgtgcctctgagcccccaacccagccactcaggcaggtggggctgcttcaattcatgccttccccagggaggaatctgaagaa

SEQ ID NO: 395984 - DNA, 1037 bp, Homo sapiens
acaagagtgttccctggtttcttgagggtgtcaattcaggggttgcttcccgttttatcctataaatacttctggctgcaaagagcctacaagcagtctgtttcctgttgcagtgtggtaaggtaaccttttaaggtggagaccggtggcctgtttggggcagttcccctctagagggagaatttgtctctgaagtaccaggagactgcaggagattttcctgtgcttttcctacccagacaccagcccagaactcaggtgacttcaggagcgttcacatcctgtttggaaacaaagtctgcaaattgtttaataggccgagccttgatatccgcatccctctcagctctatcacaggtctgctttgctgttttctcttggctgtgacagtccgcctgatggtcattataacagcagttcaccattagtacaaacaagagtaccatacataaattctgtgcgcggtttaccaacatcatcaaaaagttatattgttctactgttctcattctttacttgatcaccatcataatcatatcaacatcctaatttctggcctaaaccaaccacagaaccattgttagccccttatactatccattgtcaccaagagtccatttgctagagcttttagtgatattttatctatttagaagagcactgcagcatggattctgtgttaattcatgtactcattgatggacttgttgcttgtgtagcccagttaataagaatagctgatgagcttttacaattcattctacaagtacaagaagttccttatgtagaagaaaatggtagagcagaagagactgaagcagatgcacctcttcccgaggagccttcgctacctgatctccctgatctctcagacttagactcaatacttacaccaagagaggatgaagacctaatatttgatatagatcaggctatgttagacatggataacttatatgaagatacagtctctggtataaatgatgacttaacaggtgactaagacccaatttctgcccccgtccccagggatgtga

SEQ ID NO: 395985 - DNA, 85 bp, Homo sapiens
aaatggatagaatttggaagaagaccaagtgatgacatgatgagaattcaatgtgttgatcagcctctgtttgaaagaatcatta

SEQ ID NO: 395986 - DNA, 362 bp, Homo sapiens
tcacagggtcctcaggatagtggtcggcacatggtaggcactcagtaaatatctcacgaatgattcccattaccatggctaaaacatgagtcttttaagatgtcttactgtggatctgtctccaacttcggaagaaattgccaccacagtcatcatcatgaattatgttactatgaataactggaactagcagcaaattgctttaattttaatgtgggccaaataagttctgcttagatatttaaatagactttacttaaacattctgaaggatggagatttcaaagctggcacctccctacctgtgaggcataataatggttccccaaagatgactactttctactccctagaacctgtga

SEQ ID NO: 395987 - DNA, 191 bp, Homo sapiens
cactggcacaggataggcataaaaatcaatgaaacagaattgagaatcctgaaataaatccttacatggtcaactgattttcaacaaaggtgcttagacaattcaacagagaaaaagacttttcataaatggtactaagaactggatattcagagcaggggggaaaaatgaacttagatccttacttcaag

SEQ ID NO: 395988 - DNA, 327 bp, Homo sapiens
ctgagcctttcctggaatgtggatataaatcaacacaagatatgaagagcagaaagaaaaggaatttgccaaattgctgatatttaagagtaggagtgttaaacacagaggttgggagagaattaacctggcataaaatggatatttcaaattgattattgacttcaaagtctttttttctgtgcagctctggcaaactctaaaataatttgagattgaaatttggaaagaagagtcccaagtccttgggagtttgacccctatcaggtactgtgagctagagagactcaaatgagacctagtcatatttttatttctaaaatgctc

SEQ ID NO: 395989 - DNA, 467 bp, Homo sapiens
tggtttctactatagctccaacatctagcactacctagcacatagtagacacttgatcaaatttgtttcataaatgtacaaaggaatgaattttatagaaatgacagaaggctcatggagattttggaatgagtggccacactgtttttctgtctttaatgattttaatttccatatctagactttaagacggtacttaatttattttcttagaacaaaggagtaagaattattccaacagccttttgcatcacgaccctgtattaatctaataaaagaaaggttacactcctatttgttgatgaacagcacattaatgagatcttcttgaaataatcccatctctattatggaggcaaaattacattttccagcataattactgtgtcagtcaagctcccaaattttgatattaattttttcccttgcaaaggcaatattaacttattagtttgtcaaacctctgg

SEQ ID NO: 395990 - DNA, 695 bp, Homo sapiens
atttcgtgggaacacggatggtgctggaggctattatcgttagcaaactaacacagaaacagaaaaccaaataccacatgttctcacttataagtggaagctaaatgatgagaacttacaaatgcgaaggagacaacagacactggggtctacttgagggtggagggtgggaggagggaaaggagaagaaaagatagctattgggtactgggcttaatacctgggtgatgaagtaatctgtacaacaaacccccatgacatgagtttacctatgtaacaaaccttcacatgtacccccaaacctaaaataacagttttttaaaaataatcaatattgtcccagtcctccattttacagatatggaagttgtgattaaaatgtgattaatgtcacagaaatactgggaaagccaagcttctaacagtcattccagggtcattgccagggtgtcaaatcctatgtcactgcacagtattactataacaacaaagtgtccctttcctgacttcctattccccattcttgatccagcatctttgggatccacttccaggcattttctctggggtcctgctggcttaagtcagccagatcctgcagcgcctttgccatatgatcctcccctcccttaacagacactgtacttacccagttggattatactgaaacttagtcctcatactgtctggtatcg

SEQ ID NO: 395991 - DNA, 631 bp, Homo sapiens
ggctccaggaccatgagagagaaccctcacacatagggctccaggaccgcgatagagaactcaggaccgtgagagagaacccttgcacgtagggctccaggaccatgagagagaaccctcacacatagggctccaggaccgcgatagagaacccaggaccgtaagcgagaatccttgcacttagggctccaggactgtgagagagaacccttgcacatagggctccaggactgcaagagagaacccagaaccatgagagagaatccttgtacgtagggctccaggaccatgagacagaaccctcacgtggggatccaggaccgcgatagagaactcaggactgcaagagagaacccaggacccaggaccgtgagagagaatcctcgcacgtggggctccaggaccataagagagaacccttacacgtagagctccaggaccgtgatagagaactcaggatggtgagagagaatccttgcatgtagggctccaggaccatgagagagaaccctcacgtagggctccaggaccgcgatagagaacccaggaccgtgagagagaatccttgcacgtagggctacaggaccgtgagagacaaccctcacacgtagaactccaggaccgtgataga

SEQ ID NO: 395992 - DNA, 694 bp, Homo sapiens
tggccctaacttgctcagtgttcttattcagaatctgaatgaagctgtagacttgaatggcaagtctgtggatgacacggaactataagaaacagctaacgtgatatgactcacataaggaaatgtggagctcaaagtcattcacacaagctgaggccctgtgttctctcctctataccctgctacccactcatcaaatgaggctggggcacaaacaagggagtgcagaagagacagaagagtctgtttccttcccaagatctggtccacaactgacctcatttatcttcaaacacctttctctctttaaatatcaggataacctaactttcatctgccagctttaaatacaaaccagtcatcataatttcacacaatgggcactattcttgaccatggagttcacctaaattacttctattccttaactaacattttgttgtaaattttctttgtagaatgcaacctaatttttaatttaaaaaaattaaactcaacataaaccatcatctttactaggcattttagggaaactgaaattttgcatgtcaagcctgcttacctgcagaaaattctttgtacttgaatgtctgacagtgacagtgataaacaacatattgtgcttctcttccagctctaaaaccctatgtgtttaagagttagaggcaatactaacttgggatgcaaccaagaa

SEQ ID NO: 395993 - DNA, 396 bp, Homo sapiens
agagtgagactgcaggatatttggtaaacagcctcgggttcctgttaggtggacatacaggtattagtccattttcatgttgctgataaagatatacccgagactgggaagaaaaatgtttaatggactcacagttccacacggctggggaggcctcacaatcatggcagaggatgaaaggcacttcttacatggtggtggcaagagagaatgaaagcagaaaccccttataaaaccatcagatctcgtggtgctctggtagtgcaccagagcagtctgggggaaacagcacccatgattcaactatctctcaccaggtccctccctcaacacatgggaattatggagagtacaagtcaagatgagatttgggtggagacacagagcccaaccata

SEQ ID NO: 395994 - DNA, 420 bp, Homo sapiens
gggcaacatggtgagaccccgtctctaccaagaaaaaaaaattagggcacggtggtgtgtgcctttagtcccaactactcaggaggctgaggtgggaggattgcttgagcccaggagatggagatttcagtgagccataattacgccactgcacttcagcttgggtgacagagtgagaacctgtctcaaaaaatatatatgttccaagactcaagtttacagttggaaaggatgcatgggaagacagagggtagctatgtgtaatggctgctcagttcttaataaggttgttcagacactaataaaattcagccacttaaaagagatatgtaaaccatgcctgacttaagtatcttgcttaaagtgttgaattcagttactttaaaacaagatagagaaatgagaaatgtcttgtaggga

SEQ ID NO: 395995 - DNA, 188 bp, Homo sapiens
gagaataatttattgaccaatacaaacagacaatttacatttctgagacacaattttaaaggaattattaaatacagcttctaacaaagaccataatgacaactttatgcagaaccctgggagctcaacagaggaagacacagcttattttccagatactggttccatatggcctcccaccagtcaca

SEQ ID NO: 395996 - DNA, 179 bp, Homo sapiens
tatgaataaaatgagttttcatgttttataattcagaccttggacatagtaattgggactatgtgatagtaaataccaaagtgcgaggtttgaatacttgtatactcgtaaaagccatttagctattttaattttttattcatgtataatacaaatagaaaaaagtacacatgatacat

SEQ ID NO: 395997 - DNA, 543 bp, Homo sapiens
gggaggtgtctagaggatccctgctatcatcggcacatacagttaattacgtagctttgtaataggtttgaaatcaggaagggtgaggtgcaaagaaatatcattgggattttggtaagaattgcactgaatcggtaaatgctctgggcagtatggctgtctttacaatattaggtcacttcatgaacatagtatgtgtttccatttatttgtgtcttttttttgtgatggggtcttgctctgttgcctaggctggagtacaagggcacaatcacagctcactgcagctttgatctcctgggctcacatgatcttcccacttcagcctctggagtagctaggaccacaagtatgcaccaccatgcacagatatttttattcctgatatttggttgcacagtacaatagggactgcattcttgttcagcaggagagcacccctttcaccccgcccctgccagaaatgtcaggcagccatcaggtgatgggtttggcagttatcacacatacagttatcacacatacagttatctcacacacaca

SEQ ID NO: 395998 - DNA, 651 bp, Homo sapiens
aaaccaaaaatacccaacaaaagcaaactctcctcctaaggcaagtgcgaacatcattggtaagttctgacgtggcctctgtatagtctgttgtcctggctctgagaaacgtaacttaaaacctctttgaaacgtcttaatctttgagcaccctaagtccttgagcacccattcatttttgtctttgaccttctaagtgtcagattggtttccagtttgaaaccaaacaaacttctttgaaattcttgaagacgtagttccaggggagcatagcgtagcttccaggtggctactgaaatggctgacagttactaaagatggtgaggatagagttaaaagcagcagcactcccattttctgatgatggcaggtgataaccttggaataagaagctccaaactatcatgcctgcttaggcactaacttcctgtaattgtaataaaattgttggcattgctgagacctactgacaccttcagcaaacgttagtaaggggcatattacgtgtccagtcctctgcttggtgatgggatttgacattgaatgggttatctttctcctcactccactcccatctctctggatcttcaccaattcctgcccagatagatgctgtatgtcctgctatccgcctcgtccccagccttgctg

SEQ ID NO: 395999 - DNA, 350 bp, Homo sapiens
atttatgtgatttttaaaaagatttttaaatgtggaagatagtggagagaatcggcaatttaggggctctgaagcagtttaggaaagaaacggaaatatttggtatccgatctcaatttcaaaaaagggtgtagaaattgaacgttcaatttctacgcagtagcaaccaaatgttttagcagagaacgatgggtgtttcaccacaagactctttcccaatattttgtgttctgtggcagaaaagcggatgtttcttggcaagatgaacaggtttgcacatgtatctgtctctaggaattgccataggcttgaagaaccaggccttcctccttgatggtgtagaacttgaa

SEQ ID NO: 396000 - DNA, 392 bp, Homo sapiens
ctgtagattggcattatcactgtaagataaccttaattctaaaactcacagttaacaaaatggccacactttctttctcaagtcaattaaagttgattttaattttcctaatgttacatgactgaaaaaagttgagacaatggaaagagttttaatcaacgcagtaaataacctgagttttaataaaataacttggtgtgaacaaatgtttggctggcacagagcattatgcttttccagctgttaaaattaatttgagaatatttattttgctttatttggtagaaagtataaggttgttaacgttgtatattcaagaggtcattccccttcctcccctttgaagtagtcacaaagtatttgaagtgccttttgatactagaaagtgattt

SEQ ID NO: 396001 - DNA, 199 bp, Homo sapiens
atttactccgtgcccatcatgtgccagacattacactgagccttaagatacttacatcttcaacagcattattgcaaccaatatttaagtatggtactatgctaactgcttgacacacatcatctcatttcagcctcagagcaaccctgcaaggttgtgtatcgttatccctattttacaagatgaggaaactgagggg

SEQ ID NO: 396002 - DNA, 329 bp, Homo sapiens
tgcagtggtgcaaccatggcgtgatactcctgcctcagcctctccagtagctgggaccacaggcgtgtattttttatttttagcagagatcgggtctcactgtgttgcccaagctggtctcaaactcctgggctcaagccttgacatcccaaagtactgggattacaggtgtgagccactgcgcctggcattcttttataatggatgaacatttacaaaatagtttcccaatttagttgtttggatgtttttgtttagactcttagctaaatgattctctactgtatagatttatctcatgcttttcaaaaactgtatatttttatagt

SEQ ID NO: 396003 - DNA, 336 bp, Homo sapiens
cttaggagatattactgtagcctaggccagggcttggcaatctaccactggtgaaccacttgcctttgtaattagagttttgttagaacacagccacactcatctcagagtgagactcttgactcaaaaacaaaacaaaacaaaaagacaagctctatatgaaattatcccggttccctttaaatgatgcctctgggcttccagatcttttaccttcctcattttatttttgagatggagtcttgctctgttgcccaggctggagtgcggtggcgcaatcttggctcactgcaacctccgtctcctgggttcaagcaattctcctgcctcagcctc

SEQ ID NO: 396004 - DNA, 364 bp, Homo sapiens
acagcagcatctcactcccattaccaatgtactgtattagtcccttttcatgctactgataaaaacatacccaagactgggtaatttataaagaaaaagaagagatttaatggactcacagttccacatggctggggaggcctcacaatcacaattgaaggcaaaagccatgtcttacatggtggcagacaagaacagaatgagagactaagtgaaaggggtttccccttataaaaccatcagatctcatgagacttattcactaccatgaaaacagtataggggaaaccacccctgtgattcagttatctcccaccaggtccctcctgcaacacatgggaattataggagctacaattcaaga

SEQ ID NO: 396005 - DNA, 971 bp, Homo sapiens
gccttccgcttttattggatttcatttcttttgctactttttaacatggaagctgaggtccttcatttcaaacctttgggtttttttcccctaatatggggaagagatgttaatgttaaaaatctatctgagaactgctttaattacctcccatcaagcttgatgtggtttcatttttttttttgagacagtgtcttgctctgtcatccaggttggagtgcagtggcgcgatctcggctcactgcaagctctgcctcctgggttcacaccattctcctgcctcagcctcccgagtagcttggactacaggcgcctgccaccatgcctggctaatttttggtatttttagtagagacgaggtttcaccgtgttagccaggatggtctcgatctcctgatcttgtgatccgcctgcctcagcctcccaaagtgctgggattacaggcgtgagcccagccgatgtggtttcattttagttgagtttaggatgttttccagttaaaaaaattcttcttgacacatggctctttttaaatgtatgttatttaattcctaaatatttgggggattttgcttatctttctggtagtttctgcaataattccatggtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttctagcaattattttaagaggattgttgacatctctgaatattaaattggatttacttctctgcagttctgtcagattttgcttcacatattttggtatgtttttattaggtgaataataaatatttcctattttatgtccacttgatgtg

SEQ ID NO: 396006 - DNA, 852 bp, Homo sapiens
  misc_feature (267)..(267): n is a, c, g, or t
  misc_feature (282)..(282): n is a, c, g, or t
  misc_feature (286)..(286): n is a, c, g, or t
  misc_feature (301)..(301): n is a, c, g, or t
  misc_feature (315)..(315): n is a, c, g, or t
  misc_feature (374)..(374): n is a, c, g, or t
cgtgtagtgccgcttctgtggagtgtgccgctcctgtgtccccgagtggttgttcacagtgttgttgtgctattcactggagcctggggtatttgcggtttgtctttccgagggggccttcttctcgttgtttccgacccttggaggtggtaattctgcgatgatttccgggcccctcggctgaagaagtataagaagtgctggctgggatttggcctagagcatgacagtcagccttagcctcccagcagcacgcaggagaggcanccagcccccagatgnactncccagtcctcacagncagatagggtgtgnacagcctcacaaaaatgcctgggtccccagcactgcagagtcttcagcaagttgctggncctagagtcgtgacgactaggcatggtggccttctcagtggctcgtgccgaattcggcacgagtatttgggggattttgcttatctttctggtagtttctgcaataattccatggtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttctagcaattattttaagaggattgttgacatctctgaatattaaattggatttacttctctgcagttctgtcagattttgcttcacatattttggtatgtttttattaggtgaataataaatatttcctattttatgtccacttgatgtg

SEQ ID NO: 396007 - DNA, 654 bp, Homo sapiens
  misc_feature (69)..(69): n is a, c, g, or t
  misc_feature (84)..(84): n is a, c, g, or t
  misc_feature (88)..(88): n is a, c, g, or t
  misc_feature (103)..(103): n is a, c, g, or t
  misc_feature (117)..(117): n is a, c, g, or t
  misc_feature (176)..(176): n is a, c, g, or t
aagagaaaagagacgctggggagccgtagaccatgacatcaggcttaccacctccactcggaagggcanccagcccccagatgnactncccagtcctcacagncagatagggtgtgnacagcctcacaaaaatgcctgggtccccagcactgcagagtcttcagcaagttgctggncctagagtcgtgacgactaggcatggtggccttctcagtggctcgtgccgaattcggcacgagtatttgggggattttgcttatctttctggtagtttctgcaataattccatggtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttctagcaattattttaagaggattgttgacatctctgaatattaaattggatttacttctctgcagttctgtcagattttgcttcacatattttggtatgtttttattaggtgaataataaatatttcctattttatgtccacttgatgtg

SEQ ID NO: 396008 - DNA, 630 bp, Homo sapiens
catgcctgtaatcccaacactttgggacgccgaggcgggcagatcacaaggtcaggagatcaagaccatcctggccaacatggtaaaatcccttctttactaaaaatacaaaaaaattagtcaggcttggtggcacgcccctgtagtcccagctacttgggaggctaaggcaggagaattgcttgaacttgggaggtggggattgcagtgagctgagatcacgccactgcactcaagcctggcaacagagcaagactccgtctcaaaaaaaaggaaaaaagaaaaggtccatagcaagccatattaagcaatttcaggatctcagggatacagaaggcactaaaaagcttccggagacatgtaaaaactggttacatgaactgtatcacacaatggcaacagattcaagaatactataatgagaacataatagagaaatgtcttcagaactatgaaatttagagtgaacctagcattttatactcttatgaaataggaagctttggctaggtgcagtggctcacacctgtaaccccaacactttgaaaggctgatgcaggtggatggcttgaggccaggagtttgagaccagcctgagcaacagggcaaaaccccatctctatgaaaaat

SEQ ID NO: 396009 - DNA, 500 bp, Homo sapiens
tgcagggcttcctcctgctgccgcccacgccaggatcagcctcctcttgccgctgcagccccgtcgctgcaccggtttcatcggtctgaagtccagctgctcctccttggcctctgcacctcagcacaggctactgcctctgaggggccgcccagccgtcgtcctcctcacaacctcccatgatcgtggccctgaggtcacctttccattggcgatgaacaatcccattgtcactccccatgggtgtgcccaccggaagctgctcatgggcaggaggggaactgttcaagctggtttttccagcccctaccacagcgctgggtgtgtaggtggacaagaaagtcattacgtatgtaaatgaggaagcgcatgaacacctgagcgtgtgagaattcggtggggtgaatgccactccaaatgtgtgtcaaatatgatgggactgaatgcaaatgaaagtgggtcaaggagatattcagaataaaatgagcaacttttcctca

SEQ ID NO: 396010 - DNA, 459 bp, Homo sapiens
agggtcagtagcctgcgaagctccttgtttctgttcactggagtcaggctgcggcaatttaggaatcaggcagtcactccggaggtcctcttagttatgcaaacctaggacgtgtcctcccccattaccctggagagcaatctgcttttgtttaacagagaccatccctttttaatggccaggtggagcagggttagtttgcataagcagtctttccaggaagaaaggaataaggtcccagccaagtacaccagcttttacactgtacatacatctgggtcgcctctaacctaggtcgctgcagacatcagctcttcaaagggggaaatcatagacacacgttgaacccaaggcaggacagccagggtgaaacattttgggggcagctttgattcagccttgaatgtggctgacaatctgagccctttatcaccctggacggtgaatggaaaagtgaat

SEQ ID NO: 396011 - DNA, 611 bp, Homo sapiens
ctctatgtgattgcatcttgtatcttccattacccaaatccaagttttctctttctgagcaggttgactttaacaaacacaaacagaaactgattgttggtctcgcttttaagtaatttgtgaaagacgacctgctgataagaataacattaacataatgttatctgtttaaagtgaaattcttattccctttgggaaaacagacatagataccctaaaatggtaaaatttccttgcttatgttgataggccacacctgacaggtgtgcttacattgacaagccatacatcttatcaaaagtggtcattttgttggctgaactaaagagcatttcatcattttccctgatattaactctttgactatgagatgcaactgtcagtgtgaaacttggcatttgcccagctcttctgataggaatggctgttctctcaccttgtgggatatttttacaatcttgactctcttttccaatatcactttcacatatagtgctggtaggccaagggaagacttctcctctccactgtacagattcttgggcccagcatcttttctggaatccccaaactagtccctcaccagctccatccttgtgtctttgagtact

SEQ ID NO: 396012 - DNA, 211 bp, Homo sapiens
tcaggaggctgagataggcggattgcttaagccttggaggtcaaggctgcagtgagccatgaccatgccattctgcactccagcctgggcgccagagcaagaccctgtttcaaaaagagagagagaatttctttgagttgaattatgtagaagtttgtcactgacctatgttcctaaagtatgaagcatacatatgtgggctaagaaatag

SEQ ID NO: 396013 - DNA, 538 bp, Homo sapiens
ctctcaatgcatgactacaactgtttcgaaacaatagagaaaagaacaagatccacatattccctcaatttgggaaactttatgccatcaattcttagtatctatatttttgtattgatttttacataaatcgaagattttattattaagcaagtttttgcttgtttccacaaaacaagacactgcatagttttcaagtatgggaggtgaggatcacttattatggccatatctgtttttctctcccccagactatcccttggctcttgtaacacacaactttgtttgtttgtttgtttttggagacagggttttgccctgttgcccaggctggagtgccatggagtgatcatagctcaaagtgatcctcccatctcagcctcaccagtagctgagactacaggtgtgtgccaccacgcccaacaaatttttgtatttattgtagagacagggttttgtcatgttgcccaggctggtctcgaactcctgggataaagtgatcaaatgattcacctgcctccacctcccaaaatgcggg

SEQ ID NO: 396014 - DNA, 478 bp, Homo sapiens
tggacaaggtgtgactaacgaggcaatgaggctcagctgtcattctgcttattggcaaacaggccagaactcctgcctctaaataaacaggtccttcctgggagtcagcacagatggctacaggctcattcaaacctggtcatcactgcttggattattttggagctgttctttgggaactttccttataaccagttgatcagccacatgggaacattagccacttgcttcatagtctgcttcagaattaatatttaaaagaaaggcaggaagctaagttttgggagtctcaccaaggggtaagagtgcaacagatgcccagtactaaggaagccactgggcccagacagtgtgagctctctcagggacgtcacagggccaggcatcctctggtgcccagagcagtgcctgacacacagttggtcattagtaaatactagtagaaaaaaaattgagaaaaaaaaagcagcaacattat

SEQ ID NO: 396015 - DNA, 556 bp, Homo sapiens
gtttatattgattttctcaaaatcagttgtttattttcaatgacgacgcctctaccgccaccaggtcaacaaaaacgtacttgcttttgcatttccgggactctagcatttcagagcaggaattaaaggccttgccaaggcttttaagcgattgatggaaacaaaacaaaacacagaaggataaattttgaatttgctaagacaagaattcgcaccaaggcagacataagacatgaggatgtcttcctgacttgcgtccttggctcgaatcgttcttattagcccttttcaaaaggcagctgtgacctccatttctggctaatcaggccacttttgttccccccgaggcgtgggaggacaacagttaagccctaacagcctgcgaagcagctcctcgacgaacggcggcgtccccgtcgcctgggcagtgggtgtgggaggtgacagcctagtcctgagcctctggagcgggcctatactgcaccgccgtacgtgaatttcaggagcgcgcaatgccgccaccatggcggaggggagacgcgccctcagcggccgc

SEQ ID NO: 396016 - DNA, 813 bp, Homo sapiens
tccagatgattctacaaacagttcgcctagggacaggcctgtccctcccacagctctaagctatgacacaccccgcaagtcatgaggtctctttcaatagagagctcatttcctccacatagtcatattgaactgagtgtttctggatatttctcctttagattccaaataaagcaaacattttctgattaggggttgagggaagacagtatttttaaaaaaaaaaggatatggccattagcttttccaaatttatgacaacccaagaggtcacttatcatcaggtagagtaggcagagcgctgaagtgggagccaggagacttggttccggtcctagccttgcctaccgctgatcctcagctcctgcaggatcaggatcctcctctgtaaaacgagggactggactcaatgtccctgaaattctctgccagagtaaagattctaggttcaacaagatacatactttttgttctttgttcccgctgcttctcccaggaaattccacccaacataggaaacaaaagggagtctggtccgcgggttcttttcactgtacatctcaagccaatcacaacataagcaacgtactgaagttaaccagaggaaagtccataaaccaacgacaacccagactacatcacatcaccatccatcacagatgtcctaagtgccaccatcccacaggcagtaatgcttccacccattggccttcttgaagccttgcacaccacagctggatttgcctacacatgtgccccagcccacctaccaggatggggcattggctggaatctgctggagctctcatcaga

SEQ ID NO: 396017 - DNA, 95 bp, Homo sapiens
tcaattttcaggtagataagtagttaatgactagatgcagttgggtaaacattatctaggatcaaccaagatgcttaatctaaattattacaaca

SEQ ID NO: 396018 - DNA, 798 bp, Homo sapiens
acattccctaacagactactgatttactgatgctacctctgaaatatttctcccatttattcccattcttgccatttcgatttgtttcaggaccccactatagctacctaattatttccccactccaaatacatgctacgcacaactactgggttagttctaccgcaatcctgctcaaaaactttccgttacttcccaatttctataaagtacaaattccttatcctgactgggtgcagtggctcatgcctataatcccagcactttgggaggccaaggcaggtggattacgaggtcaagagatcgagaccatcgtggccaacatggtgaaaccctacctctattaaaaatacaaaaaaattagctgggcatggtggtgcatgtctgtagtcccaactgctggaggctgaggcaggagaattgcttgaacccaggaaggggaggttgcagtgagccgaggttgtgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaacaagaaaagaagaagaaagcagcattcaaatgtaagacaactgtcaaatatcgagccccacttggtctacaattcagaaagaagaacgcctgtacatcgcctttttataagtcct

SEQ ID NO: 396019 - DNA, 446 bp, Homo sapiens
acattccctaacagactactgatttactgatgctacctctgaaatatttctcccatttattcccattcttgccatttcgatttgtttcaggaccccactatagctacctaattatttccccactccaaatacatgctacgcacaactactgggttagttctaccgcaatcctgctcaaaaactttccgttacttcccaatttctataaagtacaaattccttatcctgactgggtgcagtggctcatgcctataatcccagcactttgggaggccaaggcaggtggattacgaggtcaagagatcgagaccatcgtggccaacatggtgaaaccctacctctattaaaaatacaaaaaaattagctgggcatggtggtgcatgtctgtagtcccaactgctggaggcacggagctgctataatgcgttatcttcgaatactctgga

SEQ ID NO: 396020 - DNA, 757 bp, Homo sapiens
aaattaggtggccatggtggcgtgcacctgtagtcctagctgcttgggaggctgaggcaggagaatcgcttggacccagagggcggaggttgcagtgagccgggatcatgccactgcactccagcctggcaacagagagagactctgtctcaaaaaaaaaaaaaaaaagaatcgttctcattacagcctaatttcttaatagtccccagttgagtcttcctcttcagtagttttttgtttttgtttttgttttaataattgtagatttacaggaggtttcaaagaaatgtacaagagaagtcccgtgcacccttctcccaatcttaatgtttcacacaattaaagtataatatcaaaaccaagaaattgacattggtacaatccatagagcttatttggagttcaccagatacacatgctgtcaatatttgtgtatgcgcgtgtgtagctgtatgcaattgtatcacatgtagccttgcataactaccaccacaaccaagatccagaacaattccattatcacaagactcctttgtgttacccctttctggccacacccatcccctcccctgtccctggcccctggcacccatttatctgttatgtatcactgcaggtacttcaattaacatcacctaaatggaattgtgtgctacgcatcctttttctttttttttttttctttgagacagggtcttgttctgttgcccaggctggagtgtggtagcatgagcatggctcactgcaatctccacct

SEQ ID NO: 396021 - DNA, 336 bp, Homo sapiens
caaccttttcctttacagtgaaactgtcctcttagcagccttgttgtcctggactggattcccagtcccctgtcaccgtgtccgctgtgtcacaagtggtcattaaagggagagtggaatgaaccaaatggacctggagatggatttcaagatctttcccatatccatttgcctcacaaatctatttgatttgtgctattatgtgacttgatttcccagatcatatagatcatatcatatttagtcacgttatatttgtgactaaaatttcaggcttttcacattatgctgaatcatactttaaactcattcagattccctaattcagaaactatg

SEQ ID NO: 396022 - DNA, 452 bp, Homo sapiens
ggcagatgagaccaatttctctctgaataacaaaagctgaggcaaacatttaaaaaaaaaaaaaaaaaaaaaaggagggctgggtgccatggttcacgcctgtaatcccagcagtttgggaggcagaggcagatggatcacctgaggtcgggagttcaaggccagcctgaccaacatggagaaaccctgtctctactaaaaatacaaaattagccaggcatggtggcacatgcctgtaatcccagctacctgggaggctgaggcaggagaattgcttgaacccaggacgcggaggctgtggtgagccaagatcatgccattgcattccagcctgggcaacaaaagtgaaactctgtctcaaaaaacaaggagttggctaacgttctctcaggcctcttactgtgagtgtacatgagagggagaaaaaagcaaaagaggagaacaagatgaga

SEQ ID NO: 396023 - DNA, 422 bp, Homo sapiens
ctctttcaggaagctctggaggttaggcttcaccaatataagcgtggtcactaaaaaataacaacaaaaaaaagaggaagacatgaaataaagctggagattcagacaagaaggaaatctccagaatgatgatgaagagcgatcccagaaagctagctgtctaccaagattagagaataatcagggcagattccaggagagaattctccaagatgatattgatagtatagctgatgactggagagactgactgtgtactgataggaaattgggacaattggcagaatttagagttgaattaggagtaagtacaataatgcctacgtgatgaagcctacataaaaacccaagaggatggggtttggagagcctcctaatagctcaacaggtgaaggtcctgtagctaacacatctcttcaagt

SEQ ID NO: 396024 - DNA, 536 bp, Homo sapiens
agctcggtaccgtctacgccacaaggattccaactaataaatgataaagcaatgctagatttagaatattatcactttcaaatctccaatgaaacaaatgatacaggcaatttttttagtctagccaaaaaatctgaaaaaggaacaactctatcaatgaggcatcagatagaaaattacaagtggcaataaaaaaaaactataagatgttagcacaaaataaaacaatgcaaattaaataaagcatttttcacctaccagattttcagatttaaaagcctaataatgggctctgcacaatggctcatgcctgtaatcccagcactttgggaggccaaggtgggagaattgcttgagttcagcaattctcagttgagaccagcctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctct

SEQ ID NO: 396025 - DNA, 499 bp, Homo sapiens
aagctcaggagttccagaccagcctgggccatgacgaaaccctatctctacaaaatttttttttttaatttataatgagaaaataaatttacatttccttcttaggtctctagaggatccattttttttctgcaaagcatctgtccacaccctcttaccatgcttgtatgccttaaagatctagcttggcctgtcagcagtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagagtgtgttgaccctggactcaccctgaaaggtaagggcacaagagatagttgtatttagctgtatcttgttagaaaaatacatttgtgtagccag

SEQ ID NO: 396026 - DNA, 294 bp, Homo sapiens
ctagtaggagtttaaactggtacaactacttgggaaatctgtttggcagtattgactaaagctaaacacatatgtatcctataaaccagcaattccaatcctggatatgcagcaaaagaccaccaaaagacatatacaaaagtgttcatggcaacattctttatattggtgaaaacactgaacaatctcaaacgtcagccagacacagtggctcacacctgtaatcccagcactctgggaggctgaggcaggaggattgctggagcccaggagctcgagaccagcctgagcaac

SEQ ID NO: 396027 - DNA, 632 bp, Homo sapiens
atagaaaactaatgtttctctgggtcttccattttttgaataaaactgactcttaccacccaacacatggatttggaaggatagcagtacaccaccttcttagctcacttggctggaacatgagctgatgaagtcctagtctcaagtttggccttcaagaaaactagataggcttgccctatgccagagccaatctagacctgccatcagttctgtttcttctttgtgtgtgtgtgtgtgtgtgtgtgtgtgtgagagagagagagagagagagagagagacagacagacagacagggtctcactctgtttcccaggctggagtgcagtggcatgatcatggctcactgtagcctcaaccacccaggcccaagtaatcctcccacctcagcctccagagtagctggaactacaagggcatgctaccacacccagctaattcttgtattttttatagatacaggatcttgtcatgttgctcaggctggtctcagatgcccaagctggtcttgaactcctgggctcaagtaatccatccaccttggcctcccacagtgctgagattacaagtgtgtgcaaccacacctggcccatcagttctgtttcttgaccaatgactatacctttaatgct

SEQ ID NO: 396028 - DNA, 952 bp, Homo sapiens
tatacctatggaagatagaaggtacacaatttttttttactactttttcctacaactttgaagattggaactcattttcagataaaaagttttaaaatgcatggaaattatcaagtagatatcacaaaatgtctgtcaaaggacatttgctcttaatccccagtttgtctttatcttttcatgtgtttggagatgatatctctgctctttcttacagatgaagttgtttatttgtctaatatttgatgttgaaacaactgctgtcaaagattgtatgggactctagccatatctttgagtttagacaaagactggaagagtttagatttactgtcattttactttttgtcagatcagagctttgatagcctagtgattccagctttttaatactctgagatctccaaaatggatgatgtgcacatgtgtaagatgcatgaggcccagcatttgggtgtgactctatcactttttgtcccactcaagaaagtaaactggagttcaagttaatgagatatctgttgtcttttaagtaaattgcaaacctcgatattataattattgttaattataaattcctattgacacttatctcacaactgactataagtaactgattaagaactaatgtagtaccctgtgagatgaaggggtggaggataatggccggaggtaaacatgacaggtcctctatgtgggccagatcttttttatattcatcttgctgaactttcttttgggctgacagttcattcgctcattcattcattcattcattcaacacatatttgttgagagactgctgtgtacactaggcttgaggtacatcagtgaacaaatgataaaatgcttttcttaatggacccaaacttctagttgggagagaaagacaataaacaatgatgataaccaaattctgtagtatataagaaagtgataagtgatagagaaa

SEQ ID NO: 396029 - DNA, 213 bp, Homo sapiens
ggaggccttgagtattaatttacagatcagagaggtaagaaaaagctaaaatgtctacactatgttgtagagcagtgatttcctaataacaagtgaggcacagataattaaatcagattcagttgtgtggagcgagatgagagtaggtaaggaagacattctctctcttttttttttttttttgagacggagtctctgtcgccaggctggagc

SEQ ID NO: 396030 - DNA, 584 bp, Homo sapiens
gagttttacaagccactgagtcgacctcatctaatctctaaaagaaaggagttgcgcatgtcttaatgcccactgagctctgcttgctctcttttgaagccttttttgtgggagggtaggttactagcccaaagccacacagctgcttagcgaaagagaaagggagactaggacccagccctcctactgcccttcccagcacataattgtttctttgctctttattcttaatgtccttctacaaaacaaaaaccagtttgtaatgtcaaaattgagtggttttgaaaataagcttaagttggccgggcgcggtgggctcacgcctgtaatcccagcaatgtgggaggccgaggcgggcggatcacgaggtcaggagatcgagaccatcctggctaacacggtaaaaccccacctctactaaaaaaatacaaaaaattagctgggcgtggtggcaagtgcctgtagtcccagctgctggggaggctgaggcaggagaatggcgtgaacccgggaggcggagcttgaagtgagcccagatcgagccactgcactccagcctgggtgacagtgagactccgtctcaa

SEQ ID NO: 396031 - DNA, 212 bp, Homo sapiens
tatgtagttggctgattggtgaaactgatttattttgagttcttcatctattagaaatgacataaattaaaccacttctttagcacaggttctgacatgtaattaatacctagtaaatgattctcttaatatagccatgcttttatttgtagtttgatatcttttactactagtaagtgttctttctgtgtctgcatgtctaaggtctctaa

SEQ ID NO: 396032 - DNA, 556 bp, Homo sapiens
  misc_feature (70)..(70): n is a, c, g, or t
accgccctatatacctaccatagctatgtatgttttaagaggttctgtttctcatattctaccaatattntgttgtactcagtctgttcattttagtcttttcaggagcataaactgagatttactatgattttaatttgcatttccctattgtctaagatgatgaacacttttcatgcgcttctatcttcctttgtgaaatgtctgtcaatttttttgccatttagaaaactgagttcagacagaccccaccctctacgaaaaataaaattaggccaggtacggtggtttacgcctgtaatcccagcactttgggaggccgaggtgagaggtttgcttgagcccaggaatttgagaccagcctgggcaacatagcaagactctgtctctacaaaaataaaaatcaaaattttaaaaaatctgtgcatttcactgtatgtaagttttgatgccaagtaaagggaggagaggaccctgggaaagatgaaaatgactgagccattggctgctcatccttctcccctgctgtcattgcacgaattctgatgtggagaga

SEQ ID NO: 396033 - DNA, 293 bp, Homo sapiens
cagtatgtcattgtaatcgttctattttgttaatctcttactgtgcctaattttacatgaaattttataggtatgtataggaaaaaacagtatagtcatgcgcttcataatgatgttttagtcaatgatggattgcatatatgacagtggccccataagattgtaatggagctggaaaattcctgttgcttggtgatgtagccaactaaatgtcatagcacaacatttgtggtgatgctagtgcaaactaaacctaccatatttccagtcacataaaattcataataaaccac

SEQ ID NO: 396034 - DNA, 275 bp, Homo sapiens
ttcccaatttagtgcttgtggatttatcattcctcctgcctagaatgtcctttcccactctcttctccaagttaattcctactcaaccttcaaaactcagtttaaatataacctcttcccaaggccttccccaatctctccaggtggagtcaagtgctcccacaaggccaagtaacatacatcatgttgtctgactattattaggtcctctggactgtgaggggctgaaggacagcagcatgttatactcttgtcatttatatatacatacgtgt

SEQ ID NO: 396035 - DNA, 546 bp, Homo sapiens
gatatgaatatgcaacattgtgttaaatttaataaaaatgctataaaaatggagtgttaatttatagatgattctcagatattgtctaagaataaaggagagaatgtgtgcctcaaaggagagctgcatattgatgaaatccttttccgctgtggaattggtgctctctctaaatagatgattttggccttggtttaatttttacaaatctttatagaatattaagtaatattttatagacttgagatggctcgggctgtggaacagtagataatctctccatgatcctgcccaacgcagaccttggttcagtagggaggaccttggagtgcacggtttgggagcagaggccacccatggtgaggagaggggccctagaaagctgacttgctcagccttcttcaggattccagatgagtcaagacaagccctggcatggagataagaaaacactacctctgctgacctcctgtgagatggcttctattttggcctcttccaggatccctaggtccatgtagaatatatttaagaagggaggggaaa

SEQ ID NO: 396036 - DNA, 276 bp, Homo sapiens
gaactatacctggtctttgtccctggttcctaacacagagcacctaaacgccttagaatttcttaggagacacttttatcttttgctgttcataataagcctttgttcacaccggaatttatgctaatgaggtgactcacagtggggctgctatgctagcctcaggatgggattggtcaccagaaagaccaaaaatgtgattagagggtgggaactatcggccccaccttcccacctgtaggaagaggatgagctgaagattaagtgctataaaaa

SEQ ID NO: 396037 - DNA, 366 bp, Homo sapiens
ttttcctaatagttggcttctttgaatcaggatccaaacgagggtcttttctcccctctggcccctcccagcctggtgaaggagcagcccagctgtcctgcagccctccccatgggctctgatgtctcccaagctgccgattcatcctgcctgccccctccttcttatgaactgggtgctaaatcggagagcagagagggtgccgtggtcttttagcaaaaatatatccgaagtattgccttaatttgtatttctgggcatcttgatattcccataagaccacaattcggaggtttggagagcaacaacagcctgacccttgtaaagctcctattatccttccgatggtttcatcatttaattagg

SEQ ID NO: 396038 - DNA, 310 bp, Homo sapiens
cttgcaaattgtgagtgaggcatatcagctggtgctttcttttctctgtgggctgccatttatgaatctcttggtttctctctgtctctgtccctccacttttctctcctttgctggtgtgtgcattccctctgacgccctggctctcactctttcattctgttttttattctggctccctctgtctttgtgtttttttttttaattttctttttttgaggtggggtcttgcactgtcacccaggctggagtgcagtggtgcgatctcagctcactgcaacctcttcttcctgggctcaggcaatcctct

SEQ ID NO: 396039 - DNA, 839 bp, Homo sapiens
  misc_feature (24)..(25): n is a, c, g, or t
taggctaggtacgaggctgggtgnntgagatggagtctcactctgttgcccaggctagagtgcagtggtgcgatctcagctcactgcaccctctgcctcctggttcaagcgattctcatgtctcagtctcccgagtagctggggttacaggcatgcgccaccaagcctggctaattttgtatttttagtggtgatggggtttcaccacattggtcaagctagtctccaactcctgacctcaggtgatccacccgccttggcctcccaaagtgctgggattacaggcgtgagccaccgcgcccggccactatatgcttatttaagagggtaaatattatggttatgtgaattttatctcagaaatttttttacccaaaaggtgcagaaaaacatatctggtaaaattcagccacatatgattcaataaacaaaaaaataaagtcttcagagaactaagactaaacctgataaagaccatttacaaaaaaagcctacagctaacatacacatagtgaagaatgctttcctttaagactgggagcaaggcattcttattcaacaatgtagctcactgtgcaataaggcaggtgggaaaaaggcccacagattggaaataaataaataagactacttgatgatatgaatgcctacatagaaaaatcaaagaatctcaaaatactagaataagtgaatttagcaaaattagtatgcaaaagttgactgtacttctatgtagtagcaatgatgtttagaaactgagatttttaaatcaccacttacagatttcagaaaacatgaaatctaacaaagatatgtaagatctgtgctgaaaagtaaaa

SEQ ID NO: 396040 - DNA, 252 bp, Homo sapiens
cctgctcagagcccacaaaatcgtattgaaattccagggaacaaaaggcctccaactctaccactccccagtgcaacctgtcctcctgccatcccaaatcccttgccagtctccacacttctattctcctccctcctccgggcctctgcgcgtgctgttcctttatctgcctcccaacagggctcgcgttccttgagaccatctgcagctttgcatccccagcacttgacgcgtagaagtgaagtcttgatg

SEQ ID NO: 396041 - DNA, 407 bp, Homo sapiens
cattattttaatttgcattggttatagtgccaacacaaagaaaaaacacactcaagatcttttttataaagtagggatttaattctaaatcttagtcatatcttacaatttataaattctttaatgttgaaaaatattttctttgtagaactaaaaccattctctctctctccctccctccctctctctctttctctctgtctgtttgagaacccaaaataaaatgtagtttataatttgtgattatgatttgaacttttcaaaaaatgtatgagtcatttcttgccctttgataatttccaaatgatgatgctttgcttttgcttttagagatcagtctttgcttttaattatttccatatattttggttgggagtgagaaaaataaacggaaaatgtcactcatg

SEQ ID NO: 396042 - DNA, 297 bp, Homo sapiens
cgatagttagaccaaaatattataatagaaatctacatttgctaagatctgatgtaatgctgaaattaacaagatttttttttcttttgatttatcaacatctatctacccacaataaaagaacacagaatactgaggcaggttagcaagctctgtagactaaagctgtgttactgagaaataatctcgaacaattgtgaaaacattcgcacatttcaaaatgactgtctctcttggtggcctgatctcccagctaggaaagacacactgatgttactctcgaggggacagaggcag

SEQ ID NO: 396043 - DNA, 184 bp, Homo sapiens
acagagaacatgggagaaggaacagctctgagggagagaagatactgatttgttttgttttgcttttcttgtggttgggtgaggatttatttaattatttgaaagtgttaagatactgccatagctatccttttgggggaattattttggggacaatagttttcattcttcattcacttattta

SEQ ID NO: 396044 - DNA, 686 bp, Homo sapiens
tagctgttcagaggattaccaaagatcttggagcatcaccctttatggacacaggattgcttccaccttctggctactgtgaataatacatgtatgaacatgtttatacagatatctgagactctttggggtatatactcagaaagagtattgctggattatgtgggaaatctatgtttaatttttttgaggaactgctatattttttcacggcacttggcacaattttacatgaccaacagtgcacaagggttccaaactctccacatccttgccaacacgtgttactctgctttccaaaaaaaagtttttaattgagatgggatctcacacatagtgagagacccagcctggtctcaaaactcaagtgatcctcctgcctcagcttttcccagagtgctggaattacaggcgtgagccaccgagcccagccttgaggctcattttcaaaaggagaagggtaatgaactaggatttatgccccaaattcatatggaagatttaattatgtatgtcaaagggtgctgtcgtttgcatatttagccatgggtttagggttttaacctatggtttgcatgttgatgttacttttagatgctggcaatcaaccattggaggacaataatgtattgactggaatgttgacacaggcgcttgaaagttgacgaaagtaagagaaacgagaa

SEQ ID NO: 396045 - DNA, 413 bp, Homo sapiens
tcccagaaagccaggcaaaaggcaggaatgaggagcagcggatagtgacaaaaaggggcttggaggaggggttttgcgcccctgcccttgaatgtccgtctgatgtacaaaacagtcgttttcttaatcttatgcaaaggactatgagcgtgcattttcaagccctactaccaccaatggctgtcgctaacccacccaccgctcactatagaaattttggatcctcgcttcatgtataagaaacaggttgacctttctctagtccagagggaagcaaagggccagtcttggcgcggcttaacctgaacaaagttcaaaagtatttccttgccctccaagaaacataaacttcctggtgttggaagtattgatacactcattataataggaataaaaattctgctccttcatag

SEQ ID NO: 396046 - DNA, 332 bp, Homo sapiens
caagaagaggcaaccaactgcaatggaaatgaaaagcagaagtaacaaaatgccaaatcaaggcaagatcaaatgcatagtacacatgtatggggatggatccaaatcaatgtcttcatcaacaacgttttctcttagcttactgtagatcctcactggtctctcaggtagtgttaccttggaattaccctggaatccttcagagcctaacctgttcctaagtagctatctttcagatgtcctgtttcctagaaagagaaacgacctcatgctgcaaagcatgctcttgtctttccagtttgcccactggctaaataaaaatccaaaactag

SEQ ID NO: 396047 - DNA, 450 bp, Homo sapiens
ctgttctcctcatgtacttacatttcttccctgctctacaaacccgattttagtcagtcaggaggatggatttgagactgatctcctatctcctcggctgcagcacccaataaagccttcttccctgacaataatcattgtttcagtgattgattttctgtgcagcaagcagtaggacctaaccagaacccctggcatttcagtaacacacatttctctactgtagcactaatattgtaattagtttaattattactttacatatcttcttcactagactgtgaattcatccaaagaggccaagcttaatgacctgccacagagtctagcatattatagctcagaaaggcataacagtagaagttctcctaaccaatctctacttaatgatgacttattggtgaactgaacattctctgtagcacagtgagtacatacacctagtaggcg

SEQ ID NO: 396048 - DNA, 276 bp, Homo sapiens
ttttttctctctctctctctgaaaacctctaggatcttatttttaccttcccacattccaaaatttcacagtgaaagggtggccttccctacccacccatctaaaatggccactcacttcttgccattttttagctcattttcctgcttaattttacttgtttttttgttgttgtttcttgttttgaaatggagtcttgctctgtggcccaggctggagtgcagtggcacgatctcaactcactgcaacctccctctctcgagttcaagtgattct

SEQ ID NO: 396049 - DNA, 401 bp, Homo sapiens
ttcaagcaattctcctgcctcagcctcccaagtagctgggattacaggtgactgccagcacgcctggctaatttttgtattttagtagagatggagtttcaccatgttggtcaggctggtcttgaactcttgacctcaattgatccgcccaccttggccccccaaagtgctgggattacaggtgtgagccaccacacccggccaattttacttaattctttcaccaaatatgtgactaagcacttacaatgtaccagacatggcactatgccatgtggatacatctatgaaagaggcaggtggaatcactgctctttccaagccactgcgtgtgcatggggccagggataacaaacagaggagcaagtacatttacaaaatgtcaggagattagtgacaaa

SEQ ID NO: 396050 - DNA, 287 bp, Homo sapiens
aggacaaccaatgaacatgatataggacaaaatacaataaacaaaacttttacagggattatgggaaagattataaaaagataatagatttgtttctgatccaatttatgtatgcagaattctttggcattctaagctaaaatttttagttcataattatgtgattcatattataactaaatgcctttatgtttcctaaaaaagtaagagttaatgcagataatgggtaaaagaaaatttcaagcaattaaaatttttccaaagacatagctactacagacacacac

SEQ ID NO: 396051 - DNA, 240 bp, Homo sapiens
acctagaggaccccggatgaggggaataaggaaaccatgaaggcatcttactgacagaactgatgaaaaaggatggtaatggagagtgtaagtacagggatgacaataagtagattaaaataaagaaattggtacaaaggagaccaggaaagaaaagtaattatttgagaaagtatacatggctctggaacggcaagcttagatatgaccctcgggtcttaatttttttttttttttttt

SEQ ID NO: 396052 - DNA, 376 bp, Homo sapiens
atgggaacgatcacttataaagttaaaatctgtttgtttttgttttaatgtaaggcttgcttttccttctacaaccatgaacaagcctggcctccctgagacacactgcatcctgtttaagttaatgggccttgactttgtcctttgtcaggagctctcccatttatcttcagagaagcacgcttggcacagttccactgactttgaagtcaacattttaaatatttcagagttagaattcctagtggaaatatcttaagacataggaagaagataaatacacaaggtaacgtgaatgttaactgaaggatgaggtctgaggatactgagaaatcctactaactttataaactttagataaacattaaaaaaataa

SEQ ID NO: 396053 - DNA, 472 bp, Homo sapiens
acccctcaaaatcatccacatggatccacttcctccatccacttcttagcatccacttcttctaaattagcatccacttcttccacattcctattcatgttgatattttcacctcctctcctgagtcacaaatgttcttactggcatctacaatggaaggttttcagtttactttgcccagatccaacagaggaatcactgtctattgcagctatagccttacaaaatgtatttcttaaataatgtaacttgagggtcagatatggtggttcacgtctgtaatctcagcactttgggaggccaagggaggaggattgtttgaggccaggagttcaagaccagcctgggcaacaagagcaaaactctgtctgaaaaaaaaaaagttacttttatactatactgtagtctattaagtgtacagtagtatgtctaaaaaaagtacataacttaaaaatactttatttgctgaaaa

SEQ ID NO: 396054 - DNA, 438 bp, Homo sapiens
caggaaggctcgggaaggcaggcatggtgatacctgtggccctgcatctccagagaagctgttccagctcctcgggagcaccactgagtccctggtgacctgcagagatgcagggatggcctggccagagctctggtcccacttctgcccttgccgagaccacctccccacccctcagagcctctattttccccttaaaatgggaacaagctcatctggaggagtcatagggttggacatgtaagggagggtgaagggctgtgtggccctgcacggttactgccatctcccacccacagaatgggagcattcacttatttcaaaccaggagagaagggactgcgtgtattgcatgtgtatgtgtttgtaggccctgtgcttagcatgaggtgggcctggcacaagaagcttgtcatccctcgcccttaaaattccagt

SEQ ID NO: 396055 - DNA, 539 bp, Homo sapiens
agtataagcatattctagatcttcttacaggcgtgtcatttcactgtctgaatttgggtttacacacatgaaggcacgatggaatgctattttcactgtctccggttaatgacaacagaagcgggctgaacttcgtgcacacatgatgcccctgtgggagctgcaggccaaaggctgctgaacaggaacatacaaaagaactgcagaaattcaacagagaaaagggatgggcaagactgtgggggtcggcaaacaaacccaaatgaacctgccatggagcagccaccaccatattcatgatttgtgcaagagtttagatttaagaaacattattggccacattaagttaatgttgttcatttgaaggtaatggctttgccatttttgtatttaatttgtaaagatgtttggctttatggttgtataatggttgtcaacagaaggagtttagtcctattttatttttacacatatttaagtaacattataatcaaaacaatttagttcaatactgcagtaccaagagattgtctttctat

SEQ ID NO: 396056 - DNA, 262 bp, Homo sapiens
ggctgaggcatattgcatacgtgcatgcacacacacacacacacacacacacacacacacagggctgtggccgaggcatatgcatatgtgcacacacacatcatcacgcactttctacccgttctacagacacacatcatcacgcactttccacccgttctacagacacacatcatcacgcactttccacccgttctacagacacacgtcatcacgcactttccacccgttctacagacacacatcatcatgcactttccac

SEQ ID NO: 396057 - DNA, 307 bp, Homo sapiens
ggcttctagggttagccggggagtacctccggcatagactgggggccacatggactcaacatcagaccacagacctgttagaggaggaggcgaagccgtcggtggaaggcacacgagggatctgagtccttttcctccctgcctgtctgtggcccagggagccagtggtggagatgacactttttttttttgagacagaacctcactgtatcttccaggctggagtgcagtggctcgatctcggctgactgcaacctccacctcccaggtttaaatgattttcctgcctcagcctcccacatagctg

SEQ ID NO: 396058 - DNA, 1716 bp, Homo sapiens
  misc_feature (1053)..(1053): n is a, c, g, or t
  misc_feature (1059)..(1059): n is a, c, g, or t
  misc_feature (1136)..(1136): n is a, c, g, or t
  misc_feature (1345)..(1345): n is a, c, g, or t
  misc_feature (1373)..(1373): n is a, c, g, or t
  misc_feature (1414)..(1414): n is a, c, g, or t
  misc_feature (1637)..(1637): n is a, c, g, or t
  misc_feature (1652)..(1652): n is a, c, g, or t
  misc_feature (1656)..(1656): n is a, c, g, or t
  misc_feature (1715)..(1715): n is a, c, g, or t
agcggggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcgttctcattaataaaacagacttggttccagaagaagatgtaaagaaattaagaacaacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatatgagaaacaaggacaatcactgcatggaggtcataaggctgaaggtattggtgtcaatcntagacnaatcacaatcaagtgattgtccagggtgtccatgagctctatgttctggaggagactccagtgagctggaaggatgncactgagtgaacaaatcgattggtcctcattggcagaaatttagataaggatatccttatacagctgtttatgagctactgtgtacagacaacagaaaagcagtggatcaacacatttcaaagaagatcgagagtttgtagcataacactagtggctatttcttatcaaaaggattggaaaataaaaataagtttctactgggtatatntcaagcactttatttattactttagttncgaattccaatatacttatacaatatggtatttgttttacngcattatcatatagagattgtagcaaattcagtatcgtgtataagacattttacattcatagcaattttatataatattccttttttttataagaattggtattttgcatcatataaatatcttttgaaattggcttttgtgatgttctacatatactgaatcattgaaagtttatatataatgatgatactaactttcaacatttgtctattttttcttagnacttcagctgtattncagngatataatgattacattgttattaaatttttttaatacaagtaatttctctattttttnt

SEQ ID NO: 396059 - DNA, 1319 bp, Homo sapiens
  misc_feature (656)..(656): n is a, c, g, or t
  misc_feature (662)..(662): n is a, c, g, or t
  misc_feature (739)..(739): n is a, c, g, or t
  misc_feature (948)..(948): n is a, c, g, or t
  misc_feature (976)..(976): n is a, c, g, or t
  misc_feature (1017)..(1017): n is a, c, g, or t
  misc_feature (1240)..(1240): n is a, c, g, or t
  misc_feature (1255)..(1255): n is a, c, g, or t
  misc_feature (1259)..(1259): n is a, c, g, or t
  misc_feature (1318)..(1318): n is a, c, g, or t
ggcagagaggcagaaggcccatgaggggaaggtgcagtggcttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcgttctcattaataaaacagacttggttccagaagaagatgtaaagaaattaagaacaacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatatgagaaacaaggacaatcactgcatggaggtcataaggctgaaggtattggtgtcaatcntagacnaatcacaatcaagtgattgtccagggtgtccatgagctctatgttctggaggagactccagtgagctggaaggatgncactgagtgaacaaatcgattggtcctcattggcagaaatttagataaggatatccttatacagctgtttatgagctactgtgtacagacaacagaaaagcagtggatcaacacatttcaaagaagatcgagagtttgtagcataacactagtggctatttcttatcaaaaggattggaaaataaaaataagtttctactgggtatatntcaagcactttatttattactttagttncgaattccaatatacttatacaatatggtatttgttttacngcattatcatatagagattgtagcaaattcagtatcgtgtataagacattttacattcatagcaattttatataatattccttttttttataagaattggtattttgcatcatataaatatcttttgaaattggcttttgtgatgttctacatatactgaatcattgaaagtttatatataatgatgatactaactttcaacatttgtctattttttcttagnacttcagctgtattncagngatataatgattacattgttattaaatttttttaatacaagtaatttctctattttttnt

SEQ ID NO: 396060 - DNA, 1572 bp, Homo sapiens
  misc_feature (909)..(909): n is a, c, g, or t
  misc_feature (915)..(915): n is a, c, g, or t
  misc_feature (992)..(992): n is a, c, g, or t
  misc_feature (1201)..(1201): n is a, c, g, or t
  misc_feature (1229)..(1229): n is a, c, g, or t
  misc_feature (1270)..(1270): n is a, c, g, or t
  misc_feature (1493)..(1493): n is a, c, g, or t
  misc_feature (1508)..(1508): n is a, c, g, or t
  misc_feature (1512)..(1512): n is a, c, g, or t
  misc_feature (1571)..(1571): n is a, c, g, or t
agcggggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatatgagaaacaaggacaatcactgcatggaggtcataaggctgaaggtattggtgtcaatcntagacnaatcacaatcaagtgattgtccagggtgtccatgagctctatgttctggaggagactccagtgagctggaaggatgncactgagtgaacaaatcgattggtcctcattggcagaaatttagataaggatatccttatacagctgtttatgagctactgtgtacagacaacagaaaagcagtggatcaacacatttcaaagaagatcgagagtttgtagcataacactagtggctatttcttatcaaaaggattggaaaataaaaataagtttctactgggtatatntcaagcactttatttattactttagttncgaattccaatatacttatacaatatggtatttgttttacngcattatcatatagagattgtagcaaattcagtatcgtgtataagacattttacattcatagcaattttatataatattccttttttttataagaattggtattttgcatcatataaatatcttttgaaattggcttttgtgatgttctacatatactgaatcattgaaagtttatatataatgatgatactaactttcaacatttgtctattttttcttagnacttcagctgtattncagngatataatgattacattgttattaaatttttttaatacaagtaatttctctattttttnt

SEQ ID NO: 396061 - DNA, 1804 bp, Homo sapiens
  misc_feature (1141)..(1141): n is a, c, g, or t
  misc_feature (1147)..(1147): n is a, c, g, or t
  misc_feature (1224)..(1224): n is a, c, g, or t
  misc_feature (1433)..(1433): n is a, c, g, or t
  misc_feature (1461)..(1461): n is a, c, g, or t
  misc_feature (1502)..(1502): n is a, c, g, or t
  misc_feature (1725)..(1725): n is a, c, g, or t
  misc_feature (1740)..(1740): n is a, c, g, or t
  misc_feature (1744)..(1744): n is a, c, g, or t
  misc_feature (1803)..(1803): n is a, c, g, or t
agcggggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcgttctcattaataaaacagacttggttccagaagaagatgtaaagaaattaagaacaacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatatgagaaacaaggacaatcactgcatggaggtcataaggctgaaggtattggtgtcaatcntagacnaatcacaatcaagtgattgtccagggtgtccatgagctctatgttctggaggagactccagtgagctggaaggatgncactgagtgaacaaatcgattggtcctcattggcagaaatttagataaggatatccttatacagctgtttatgagctactgtgtacagacaacagaaaagcagtggatcaacacatttcaaagaagatcgagagtttgtagcataacactagtggctatttcttatcaaaaggattggaaaataaaaataagtttctactgggtatatntcaagcactttatttattactttagttncgaattccaatatacttatacaatatggtatttgttttacngcattatcatatagagattgtagcaaattcagtatcgtgtataagacattttacattcatagcaattttatataatattccttttttttataagaattggtattttgcatcatataaatatcttttgaaattggcttttgtgatgttctacatatactgaatcattgaaagtttatatataatgatgatactaactttcaacatttgtctattttttcttagnacttcagctgtattncagngatataatgattacattgttattaaatttttttaatacaagtaatttctctattttttnt

SEQ ID NO: 396062 - DNA, 482 bp, Homo sapiens
cttctactgtgtttacagaaaaacaaaataagaccctcattggctgggagatttgcccaggatagtagagtgaatttttggcaaaacgggggctagaatccaagtcttctgactcatctctggtggtcttctacagctctgcccactggaattctagtgaatttgaattccaatatttgaatgccaatatttgtgtagaagtcttgaaattgagtgctttgctcatttatttggcagctttttattgagtgcttaagtgcctgttctgggcctgtgctgagctctgggaatgcagagatgaataggtggggtccctcttctcaaagaggtcttagtatggtagcttaaagctgatagattatttgtggataggagtcaggtcttaaacttgatgtgagtggcaggtgtgtcctcaaactattgggcctcaacctcgagccattgctgttgatggaaagggtggtttattaaattaagaacta

SEQ ID NO: 396063 - DNA, 297 bp, Homo sapiens
acataaagaaagccaaagataaagagtagaaaatcttgaaagtagccaaaggaaaattatacattacataaaagtaacaataattccagtgaccactcactttgaatcagaaaccaaggatgccaggagatcgttataacagcatttggaaaaaaaaacttggctgggcctggtggttcacgcctgtaatcccagtgctttgggaggcggaggtgggagaattgcttgaggctaagagtttgagatcggcctgggcaatatagcgagactctagcgagactctcgtctctacaaaaa

SEQ ID NO: 396064 - DNA, 537 bp, Homo sapiens
aatcaacttacacaaaagaaaactatgatatttttgctgagtaatagagattctgaaaggcaatggagaggaggaggatgagctttgtaaaatcagctaatccagatagaaagtgtcagttaatttaacatatttttattgacggttttacatatgaacaccactgttgtaggaatggtgaatcaatcataaatcttgtcttaaaggagcttctagtaagggctagaatgcacgttcataaataacaacagaaagcagaaagtcttaagtgtcttgtgaaaaaaagttcaaataaattacaagagggagaattactttttagctggagagtaaatttggatagacttgaagcaaactattgtttgagcaagatcaaaaggttggataagttttggagttaagaaggaaagatattccaggatcgtatctgtagcagcacaaacagatgctatagaaaaatgaatttctgagtttctagtatgtaggctgcacagaaggtagagtttgtgtgtgtgtgtatgttatatatatgtgctg

SEQ ID NO: 396065 - DNA, 348 bp, Homo sapiens
gcatttctgacaagcctcttggtgatttcagtgctgctggtctgagaacggcactcagtagcgagaggctagagattgccatggggcatcttggagaatatcccccagcagagagaaagataaaagaaggctcagccaagcaggcaccatgctgaggataagtaaggattggtcagatgagaagcagtgtttgggtgggcgggggtggcgatggcagaggtgacataatgtggagaccctgaggaaaggcaaagagaaagagcttcgattagaattgacaaggaattgctgtcattgccggagtgcagaaggagtagatgaaaatatcccgctcttggactgtggttt

SEQ ID NO: 396066 - DNA, 508 bp, Homo sapiens
tcatgaattttggagaacacaaacgttcagaccatagcaaaagcagagtttttgtttatttttccttaaaacatgcagtagtctctgggcctgctctatcaactggaaatgtatcacacaaaatataaccatcgaaatcatacatataagaaatatcagaatttatttaaaattacagtttaaaaaggtagagttcatcagttaaatgtctcaaatccaaatatgttaatattttgctataaaatgtaattataaattacatatttttcagtcatttagtcacaactaacaagtgctaattgaccctattttattttgttttgttttattttatttttagagacagagtcttgctctgttgcccagggtagagtgcaatggcactaatcctagctcaatgcagcctgaggtgggagaatcacttgaagcccagaggtggaggttgcagtgagccaagatagtgccactgtactctggcctgggtgacagagtgagactctgtctcagg

SEQ ID NO: 396067 - DNA, 661 bp, Homo sapiens
agggatgaatacattttttaaatgtggtaagtatgtgatagatatctatatctacctacacacacacacacacacacacacacacacacacagatgtataccatttaatatttagcctttaaaaagcaggaaatgtcatttttgtcagcgtggatgggcctagagaacatcatgctaagtgaaataagccaagcatgggcagacaaataccacatgatctcacctatgtgtggaatctgaaaaactttaattcatagaagtagagagtagaatgtggtttccagaggctgggaggctgggggaggagggtagacagagaaaagggaaaaggtcttagctaaaggttacaagtttcagttaggtagaaggggaataagttaagatgatctattatacaacttggtaactatagttaataatactacattgcatatttcaaaatagctgagagaatggactgtaaatattctcaccacaaagaaacaataagtatttgtggtaacaactttggtagcctgatttgatcattccacaatgtatacatgcattgaaatatcgcattataatccataaatatataaaattattacttgtcaatgaaaaataaaactttaagagttttgaaaaagttgtaaagtagaaataaaatgtgtctaagatt

SEQ ID NO: 396068 - DNA, 195 bp, Homo sapiens
gttttgacagcagccataaatggcaaggatatccatagttctcaaaactattcccaacctttctcctgccccagttgtcctcttcttatttggaacatcttcttgatgtatcagtgaggttaatgaagaattcattttgctgttgcccaggctggagtgcagtggcatgatcttggctcagtgcaacctccgtcc

SEQ ID NO: 396069 - DNA, 619 bp, Homo sapiens
gactgaaaaggaaccctcatagagaacaccagaaaagggtgttatagacaccagcttcctaccacctgagacattaccaattgcatttctaaaatacaagcatgagctcctccaggaagctggtcctttacctgtccaaatccttcccactcccacctgggttaggtctactattctctggctggcatggcatcctgtgcatacacatacgataacacactgtactggaactgcctgaacactgctttgccagtcttcattaccataggagtatcttgtgatcagaggcttatgtcttactcatcttctaccatcttctacctggcatagttggtgcttagcaccccccaaaatgaatacttaaatataaatctaacaaaacacgcatggtattgatatgaggaagaactaccaaactccaatgaaagatagcaaaaaaagtggtaaataaggggagacagtgcatgtacttagataagaagactcaactttgtcaagatatcatttttttcccaacttcatctataggttcagcaaaatccttatcaaaatcccagcaagttattttgtggatatcgacgaacttgattctaaagtttacatggagaggcaaaagacc

SEQ ID NO: 396070 - DNA, 522 bp, Homo sapiens
atctaggacctttgatccctggagtctgcagatgtcgctgttataggcttgtccccctctccaccccagacgtctaccaccaggtctcctttcccgggagcaagcccatccctggacgctgccgttcagcgcttgggagactgcaggggcggggagcgttgtgtgcctggttttggggtgctggggggcgagggcttgtaggtcccgcgacccacggggagggggcaggcgagcaccccgctccggcctccggctaatcccccttctccagcgtcggttccccggtcccgtgttattcaagacagaaaatattcagccccagagcctcccctggggaggggaggggaaggaggtggagtgggaggaggtggatccagggaggaagaagcgagaaatccgcccccgggaaacagctccgcgcggccacggagcgaggcgcttctgtcacttggcgttcgcgggcgccggagctgggccccggcccggcccggcgaggcgaggggagagtccggcggccgccgc

SEQ ID NO: 396071 - DNA, 447 bp, Homo sapiens
aaggccaatttaaagaatcccccgaccatgtcgtggttgttcgtttaaagagaatatagagtgacaggaggtggaaaccctgcttttcgtagcccaacttccgcagaaggaaatgctggtggcccaaaagttgcaacaaacctctttaaaaagctcttaatacggctgggcgcggtggctcctgcctgtaatcctaccactttgggaggccagggtgggcagatcgcttgagatcaggagttcaagaccagcctggccaacatggcgaaaccttgtctctactaaaaatacaaaaaaattagccggtgtggtggtaggcacctgtaatcccagctactcgggaggccgacgcaggagaatcgcttgaacctggaaggtggaggttgtagtgagccaagatcatgccactactctcccagcctgggcaatagagtaagactccgtctc

SEQ ID NO: 396072 - DNA, 381 bp, Homo sapiens
aataaagaaataaagcaggtacagtgaggccaatcggccaatataaagcatctggctaacggggcagggggaaaaaaagaatcaattagaccaatgggcaataatgagggatgatggtcagagacatcttcccaggcaccgtgctaagcaattttataggaattatctcatttacttcactcaacaaccctgtaacataggctgtgtttttaatctcacttaatagatgaaaaactgaggcacaggttgatgaaataactgaatatacctctgatccctggtctgcctgtcaccggagcctggctataaccaccacagtagactccccagtggccagctttggtcagcacgtgaggtgctgccctcagtcccttgcattta

SEQ ID NO: 396073 - DNA, 209 bp, Homo sapiens
agacaacactggaccttctcaggtccagggggcattcagtgagctaatgcacaaaagatctggtccacagtgactgcttaaaaaacatccaacaagcgcctctgaacctgtctctcattctgttcattatgctcattccatctctctggtctgctagccaatgaccttcttctaaacacagcaatatttagaagaaggtccaggtattc

SEQ ID NO: 396074 - DNA, 246 bp, Homo sapiens
actcacagccaccctgtgatgcaggctccatggctgtccccatgttgcagatgaggaaactgaggcactcaggggttaacatcgcttgcccaaggccacacagccaggaagtcacagatcagaattgcagccatgcgcagttcccaggggacggcagtgcctcccataggagctgtatttatatgtccagtggtggtggtgcctgcgtgtgccctcctcaaattctagacccctcctggcccaggt

SEQ ID NO: 396075 - DNA, 481 bp, Homo sapiens
gagagcaagacggtttggagccagcctgcctgggttcagatcttggctctgctctttgtaggcagtatgatttggggcaaattatttaacctctctgtgcctgtttcctattctgtaaaatgggaataatacagagtgcctacctcgtaggctagaataaggattaaatggttgattatttgtaaagtgcttagaacagtgcctgatacataataaacactatgtaagtgttcgtaaaataaatctaacaaagaatctagcaaatgaagagcctgccttgtaaagcagtaaactcttcaagggctcatgcaaaggctggataaatctcttttaaggatggtgcagggatatccttcccttctagtctacagatgtatgcttcttaaacttcattatgcacagaaaccacagagggatcatattaaaatgcagattctaagccaatgagcctgaggtggggcctgagattcttttttttctt

SEQ ID NO: 396076 - DNA, 276 bp, Homo sapiens
aaggaagagtgtcctttaagcaaaaggaaaataatcaaaaaaagaaacttagagatataggaaaaaaatatagagcaagggtaaaggagatgcatgggtaaatataagcaaatattgacattataaaatgaagatatgtatgtgttttacagaagaatggaaaaaatgttagtctattaattgaaaggggaataaatggagttaaagtttgctgaggtccttgcattattctgaaagtgacaaaaataataatttatactaaattttaagtcagga

SEQ ID NO: 396077 - DNA, 553 bp, Homo sapiens
aataataaaaatatgcaaatcaaactacaaagtgaacatcttttcctctcataccaaatgcttttcggtgaatattcttgcctgaaatttcatgttatttgcgtatgactggaagctagagttttatcatgaggagagctattggacacagagacactagtcacagtagggttctcaattccttcaaccaactcagaatgcccttttccccactcatcaactatcagatttaatatagtgatcatctttaagtaggtcgacaagtaatttgacattccagaacacagaacctgaatatatatgatacactaaaataatccttccataagccaaaagttggctatgataaaacagataagaacaacaacaaaacctctgttaaagaggccctagataaaatggatttcctgtggctgaggtgctcaaagttaaaacagaaccaggcagacatagctcggtgagggagcagtcatgtactctattctcagagagatgtaaaaatatcacaggacctcccctttcagtcttatttataaaataaacatctaacaga

SEQ ID NO: 396078 - DNA, 766 bp, Homo sapiens
gtctcgaacacctgacctcaaataattcacccgcctcggcctcccaaagtgctgggattacaggcatgagccactgtgcccggccgtgtttggcttcttttatatggcataatgtctgcaaggttctaccaggtggtggcatgtgtcagaatcttcttcctttttaaggttgtcatgttgctgtgtgtctcgtgcacattttgcctccgcacctgtccctggatagaggctcggcctgttcccacctcatggtggttgtggttcatgctgctgggaactggggtgtacagatgcctcttgaagaccctgctgccagtgctccagaagtggaattgctgtttctcgtggtaattatgcttgaattttttgaagaatcatcctgtttttcccagcaccccaccatgctaccgaaacctcacttgaaattccatattgactttccctcagcagccctttccgcagctcctccagctccaggcgtatcctctgccgcacatcacctaccttgagtgaatgatgcggctccgactgctgcattgaaaaggcctggggtcagaggcggaggttgcagtgagccgagatcgcgccattgcactccagcctgggcaacaagagcaaaactccatctcgaaaaaaaaatgataaaagaaaagacctggggtctctcggtatcacctcttcctgtctgttttcctctgaagaggagaagcccacctgctgtgcagtgctgaccgtccccctccctgagacccgctccacccctagc

SEQ ID NO: 396079 - DNA, 320 bp, Homo sapiens
agcaattggaattggaatttttcattagcaccaaaaaatgaaatacttatgtgtaattctaataagacatgtataagatatatatgagaagaaccacaaaactataatgaaagaaaccaaaggagatctaaataaatattccatgttcatagataagaagactcaatattattaagatttcacttcttctcaacttgatctatagactcaatacaatcccaatcaaaatctcagcaagttgtcttgtggatactgacaaactgattctaaagtttatatggaaaggcaaaagactcagaataataaacacaatatggaag

SEQ ID NO: 396080 - DNA, 367 bp, Homo sapiens
agtaatctaagtcaaagtccatgcttcttatccatgctcactgaagcatgttgcacagcctgcgttcagaggcagccacattctcagaaataggctaaagagcctccgagaagctgacagcagctcctagacttcccagaccctttctacaagaacctggtgattgcaatgcaaatgggtcatagatgagaaataaatgtagtgtagtgtctggtagctccactggtcatagaataataggtggttttcttttatgtctccttccgccacccaaatttactctctctgaggaaaataatcactaaacatttgaggaaatctcattagcttggagccagaggacctgcattctagccctgcctctaga

SEQ ID NO: 396081 - DNA, 458 bp, Homo sapiens
gatggcgccattgcacaccagcccgggcgacagaccaagactctgtcaaaagaatcatgttattcacatcatccacgtcctactctctcaactgtgtgatgggaatcactcgtaggcatatggcatagacctctaatgcattgttgggattttttccccaatatcatactataataaattttaaacataaagaaaagttgaaatgaatctacagtgaacatccacatacccttacctagatttcttttaacgttttacacatatctgcccatagatccatcccgctattcatttagcaagtcatcttaattttcctgatgcatttcaaaataagttacagacatcagtacacttcactccaacaaattattattaattatttagcgtgattattatcagctagagttcaaaatttatgttatgtttgcctagaaataaaaaaaaattgtttatgggtt

SEQ ID NO: 396082 - DNA, 462 bp, Homo sapiens
gccgggcgtggcagcatgcatctgtaatcccagctactcaggaggctgaggctgaggaatcgtttgaacccaggaggtggagtttgcagtgagccgagatcgtgccactgtactccagcctgggtgacagagcaagattccatctccaaaaaaaaaaaattctaagaggaagcacaggcatcaaaaaaatgtaagttgaaaagtgattcagaagtagtagaacttgaatgtagacttgttttattttctttttatacatgcagaagcataatatatttttaaactacctaaatgatgtgtaaaacaactttttttatatataaaataaaaattctaataggaaaacaacaacaatgaaggctttaaacgtctataggtttgaaaggtctacagagttaaatgcttgataacaatggtgtagtcactgggagggaaatgagtgggattcaagtgttcaagatc

SEQ ID NO: 396083 - DNA, 262 bp, Homo sapiens
ctggccccagcacaccagcgaaatgtgcttgtcatctcctaagcatttgcgcaaactggctcttttcatctaaaaacaaggctgtttgggtagtgacagttactctcctagggaaagtactactatgatctctttctgcccctgaggatggcagagaagggaatcatcagcatggaagggacctggacgtgagaatgccgcagggacccagcagaggcagggcaagctaggagctagtggacttcagagggagccgtgagga

SEQ ID NO: 396084 - DNA, 380 bp, Homo sapiens
acctcaacgcttatacttctcaacgctttatacttctcaacgctttatactgctcaacgctttatacttctcaacgctttatacttcataagaaaataccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaag

SEQ ID NO: 396085 - DNA, 567 bp, Homo sapiens
catggagagagacttgggtaggtcactgtcgaggctttctgtgatattgttgagactaggaagcctaaggaaggctctggccaccaacaagaccattgaatttgccccatggaatcttctcaggccttgcacgtcatctctgttgtggtaacttcactccccaatgacctgtcacatttataactacagctgtgattgctcctctaagtcctacacttatatccccctgattacttgatattttgacttcattatcagggtctctgtctaaagtcttctcccaaacaagctcattccaatttcccatccacatgcacttctctgccatctcttcgtgttccaatgaaggacacccccttcacacagatgcccatggaggcctgaccccttatcctggtcctgactcccctcttctttgcacccatagacatcagcaagtctcagggtctctgcctccagcacaggtcctggacttcaccccatctctccatcgttacctccactgccccctaggtcaatccatcaccttcctcaacttcgattcactggtacggcctcccagctggt

SEQ ID NO: 396086 - DNA, 138 bp, Homo sapiens
tgccaggaggaaactgatgttcagagtacttaaatggggagcccagagacagtcccgggtctgggcttctccgctctcaagtccatgttttctctctagggccacgtggggagccctgcgagatgggcctcaatatag

SEQ ID NO: 396087 - DNA, 318 bp, Homo sapiens
tctccaatctcaatataaccacatgactactattagacttttattgactgcccttctacaatttatatgtcttaaaaaattgaattgtacatacttttttggtaacccttttttttcctctttacattttaaagattgtaataacctaagctaaatagaatttttaaaacaccttacataatcaatacctgttcttaaaatttaaacgtatcatgaaatccttccttatatttagtggatataaattattccatggccaggcatgatgactcacacctataatctcaacaatttgggacacctagatgggcagattgc

SEQ ID NO: 396088 - DNA, 490 bp, Homo sapiens
tgcaaattgggatatgtgaattggggtatgattggctcctctccttggcaggtagaataacaccaggcagagaaacagcagccaggcccttcaccaaaccaaaagatagaggatgggtgcctttcagtctggtattttgctggtctagtctccccaagaataggttgatttaatggttgcctactaactgggagattcctagaaaccctggcctggtcccagaaaccaggacagacaccaccaggtggcaccaaactgtagccaaactgagaagagattggactggaccctaaaaactcccagcgtaggcttttgttcatctgtctccatttatacaaatggacgtgcgacatttaaggcgggtgatggaagtcttcaacaactggattgtggtgctggttgcacagctctgtgaatcattgaattgtacattagtgaattttatggtatttaaattataccttaataaagctgtttaaaaaattataat

SEQ ID NO: 396089 - DNA, 558 bp, Homo sapiens
gaaacagtgcagcaatatcatgagctaattcctatatttattttacttttacggtatggttaattgctttgatggttattcacttaaccttttattaatttattcatttgttcagtaaatatttaccaagcttctactatatactaggaaaaaagaaaggtgctagggatatacttggaaacaaagtgcttaatttttttcatattgtgtgataactcaaaaaaatataagattagaattaatgtgaaaaatactataatgaagccagggtaagatactaaaagagtacgaagaaagggcatataactaaagtggagcattgaaaagtttcttagaaaaaaagatatctgagagaagggttagaatgtttaaaaagacagagcaagagtgtgctggtcaatatctaatttcaatgttcgaaatagagaacaataagaaatggtcccagaaaaattcaataatatgcataatttacatagttttggaaatcacattcacaacatttgtatttatcttaagagcaaaaagaaaaacaccaaattaatccaaagagattgc

SEQ ID NO: 396090 - DNA, 347 bp, Homo sapiens
aaatgtgtgtcctgcggaccacttggatgctcagttctgccccctgcctgaagaggaggacacagctccctccaggctgttctggggagccggccttctccgggaggagctgggtggaagctcagcaaatcatcattccatggaggaaggcccttggggacaggggacagaacagcctcccacactcagtacatctggatgtgctctgagatatacgccctagcaccagagatggactctggagtcctcgcaacagccttggcctgaatcttggcctgtctttctgtctgaaaagcaaatgtagggagttggggaccctagagaggaagcatttcccctcacctata

SEQ ID NO: 396091 - DNA, 242 bp, Homo sapiens
gagtgaagtgagaagttccagaacagaatgcaaagaccgaaaagaataagcgtaatgtgttggagttatacacatcaagtaggtagagtaactgccctgatagaaatgagctaagtaatgtattctaaactccagaggcaagaataggaaaatcatttaaaaaccttaaaactctccaacattgactaccaagaatcctaattagattaagaactcaatttttatgcgtccctttagctacc

SEQ ID NO: 396092 - DNA, 496 bp, Homo sapiens
taaatggaatgatgaaattttcattttgtcttagacatatcactctggtgtctgcatggatggagacaagttaaacttctatattggtccacaggtgggagtttggtagctcgggtaggactatagcaatggaaatgatgaaaagtagtcatacttaggatatattttggaagtagagctgacaacatggaccaattgaatgtgggctataaagaaaagagaggaatcaaggatgactccaaggtatggagcctgcataacttagtggtctcttgctgaaatgggaaatgcatcagggcagaaaatcagtggttctcttggccataatgatgtttgaagcttattctatattaatgcaacaaataataattgggggccgggtgaggtggctcacgcctgtaattccaatactttgaaaggctgaggcaagaagatcacttgagctcaggagtttgtgaccagcctgggcaacatagcaagaccttgtctctactac

SEQ ID NO: 396093 - DNA, 290 bp, Homo sapiens
tgagcaagacagagaggtgctggtaggtccctgaaaaatgctagagggaaaggatgctcaggaaagcatattgacaactggcaccatgccttcaagagtgtgaaacctattgactgtggcacaaatttgccctggcatcttcttgtttagtaagtcctggcttccagatgtctgagctatctccacttgttgagcacacttttactcagaagaaaaatgttttggaagaatactgcaaatgcaagcaccatcgcccttggtttttctttcatagacaacaatggcataca

SEQ ID NO: 396094 - DNA, 566 bp, Homo sapiens
aacaatagtaagcggccggtttattcatcggggctggtttgatcttatttatgtgccgtcgtcggcaacacaagagtgtatcttaaattcctggcctcaagtgatccttgtttgttatgctatcttttatgggttgaattgtgttccccgccaaaaagatgttgaagtcctaacccctagtagctcagaatatgatcttatgtaaagtttggaaataaggttgttgcagatgtaattagttaggatgatgtccttataagaagatggccatgtgaagacagaaacatactgggagaatgccatgtggccacggaggcagagattggagttttgcagctgcaagccaaggaacgccaaaaattgctggcaaaccaccagaatctaggagaggagaggaaggattcaccgacaggtttcagagggagcacggccctgcagacaccttgacttcagacttccagcttccagaactgtgagagaataaatttttgttgttttaagccactcagttggtggtcgtctataatggcacttctatggagctaatacactatcctcttaaaatg

SEQ ID NO: 396095 - DNA, 259 bp, Homo sapiens
ttaatctaactaaaggccatatcattagttctagttccaaagccaccaattttaactactgaagctttaccttggcataaccaaaaagatccaataaagtggttttctccaaacaaaggagtctgccctcaaaggaatattcaagcttcggggatggggggaaatgcctgaagcttttaatatggcagtttttccacgtctagccaacagtgtttctccaataaatcttgggatccaatctggcttgatttgtgggctt

SEQ ID NO: 396096 - DNA, 210 bp, Homo sapiens
ttttggattcctcagttcccagcaatcgactccagccattaagagttgaatctttagaagtcaaactttaaaatgcaaattttctaaaaccgttctgtggagagagggaggcttcctgtgaggcccacttcctgtgaagcgtttggtctatggacagcctatttttaaaaatgtaagtccttcctttgaggccccccggaactggcagca

SEQ ID NO: 396097 - DNA, 661 bp, Homo sapiens
tcctggttcactttagcatttagccccaccttgggcggagatagcaatcttgcaattgttccatgcccttcagctctccttggcttgaggcagggaggacctggtctttaatctgtcttgtctttaaccttagtcaatcaggagctgctatgtggtctattcttgttagaccagaggcgcctggtcgcatggctctttttgggaggacttaggttgataatggcaacctcatgctttagggcggacacggtgaacaacagacaacagagggctttatgcagcccgcatagcagcagcacacccctccagcaagcagttctgcttccccacatggtgctagccatgggggaagagccacagcaagccacacgcaggtcaaaggcattttgttgtgccccttgtggttgtgaccacacaccctgcttgctgtgccagttgtatttttctctaatttgatctttcctctaatttgctcctgagacagacagtagctatgaagtctagcctgtcctgaaggggctgccctgaagaggatgcttatattgtgtttttcacagaatacttctttatcctgacctaatgcctgattgtccagcctgtatccaggtgtccctctcacaggaagcttgtttatatgggcaggtgcccttgtggctcttgt

SEQ ID NO: 396098 - DNA, 206 bp, Homo sapiens
ggagagggttctgcgaggagacgggaccagtgagacaggcaggaccgggtggaggcgtctctacgagcaggagggcaaggaagatggggcaagacgcggggaggctgcagaggaggagcagggtggggtttggagagaatggagcctgcagaaaggagcggcagaaactggcgctggaaggctcaaaaaaggggccctggaaagga

SEQ ID NO: 396099 - DNA, 405 bp, Homo sapiens
tctgagccaaatatgagtgaccaaggcccatgacacagccctcaggcaatcctgagaacatgtgtccaaggtgcttgggttacagcttgattttatacattttagggtggcagaagttatagataccagtcaacacatgtaaggtgaacattgtttcagttcagaaaggggggacttccaggtcataggcagattcaaagattttgtagttaagttaccctctgaagacctggaatcaatagaaggaaatgtctgggttaagataaggggtgggggagaccaaggttcttatgcaaatgaagcttccttgtagcaggcttcacagagaatagattgtaaatgtatcttatcagtctttaaaaggtgccagactgttagtggattctcttctggatcagggaaaag

SEQ ID NO: 396100 - DNA, 224 bp, Homo sapiens
caaccggagccaaaattacagagaaaagttttgttgacattggaaattacatgatgaaattcttcagaaaatcttccaaaagtttgcattgtttcaacttgtaatttcctcttgctccccctgcaccgccccccccccccccccacctttggccctgaatctgaagcagtttcctcttatcccatagttaacatttttagtacaggaacatctgacattgaatg

SEQ ID NO: 396101 - DNA, 637 bp, Homo sapiens
gatcttgagtagtctgatgccatattgaatctcagtcctttatatttaaactggagttcttacaatttctttatcctcattattctgaaacacttggtgtgggtctcttttagttattctgctaggttcttagtaagggtctttttgatctgcaaaattatatcatttgattttgggaaatgatcttatattagttcctcaataatttccccttttcccccttctccattttttctgttttctcaattagtccccctgttttctgttccatgtctcaccttctacctggtgcctccttccagagcttgtttcttattggtacttccttctaaagcaacttgctcttcagccttttctgctctgcttatatttccttttcttctgctaagaatctgttaatgaatctatgcttgattttagctgaaaggctgagaagcaatctgttaatgaatctcagacagttttcttttcacctcaagatcattttattctacttattatatattttagtttttatttttaattctttttttttttaaatggagtctgactctgtcgcccagactggagtgcagtggtgcagtctcggagtctcggctcactacaacctccacctcctagattcaagtgattctca

SEQ ID NO: 396102 - DNA, 197 bp, Homo sapiens
ggtctgtttacccaagtgccattccccttttacttctgcccctttgacctccacaataggttagcaagtacgtttaatctccaaagtgtgctgcagctaatacaagacttaactgtgtcatgtaatgagaaaagccttaggatataatgaaaaaagtgagatacttaaaaaaagaaaaaaaaaaacataaaaaagtg

SEQ ID NO: 396103 - DNA, 443 bp, Homo sapiens
caccaaaaccctgatgatgttgaatctcactccaagtaaaaggcaaagtaaatccccgtgccctgtgaagtttggtggatttgtccccagttatttctctgatcatatatgctactacacttctccttgctgatctgctccggcaccctggtcctcttgctgcttgtcaaatatgctaggcctgctcctacctcagggccttcgcatctgttctttcctctgcctggaattcttttatctccagatgtctatatgacctttcacttttattgattctctactcattgaagtcttcacattttttgattcttaacttatctaaatcttcctggactactctttataaaattccaactccacacgtcccctctctctccaacactccctactcactttctatgatttatttttctccattataaacactcttatatttttgcatt

SEQ ID NO: 396104 - DNA, 260 bp, Homo sapiens
gtgcttagaggatccccccaccttatgcgtgggcgggatggtctcgatctcctgacctcgtgatctgcctgcctcggcttcccaaagtgctgggattacaggcgtgagccaccgcacccggccttttggtcagttttttttagtgcgcagtacttaattactataccttcaaaactaaacaattactataccttcaagactactggatttgattttaagttttactacatggcctgttaattcagttatctctcccccca

SEQ ID NO: 396105 - DNA, 402 bp, Homo sapiens
cctgaaataaatctatcgatacagatgaatatatgactacaggtttctcaacttcagatccatgatgtacgtagccaggtcattctttgtcatgggtactgtcctgtgccctgtaggatgtttagcaacattccttacctctatccattagatgccagtaacaccccccgccccaccccacaacacctgcaaatgtggcaagccataaagtctccagatattcccaaatgccttatggggtacaaaattgctcccagttaagaatcactgaaaaaaatacacctgtgtaggccagacacagtggttcatgcctgtaatcccagcgctttgggaggatgaggtgggaagaccacttgaggccaggagttcgggaccggcctgggcaacacagccataccacat

SEQ ID NO: 396106 - DNA, 528 bp, Homo sapiens
aactgctttctgtgggctggtggttctaacacctattcaggttatagagcactttcatgctacaaggatctctgcaaaatatcctaaaatagtgaaatacttaactctaccgtgtcaactaggaataatatcactaactgaagatatgacaaggtatataaggctccatatttaaagagtaacgaagcaatcttacgaaaaatacatttccaaaatgtccaactattagttgtttgctatttgtttttctgttttgttttgctagcattctgcggcaaaaatgggatatcaaactttaagaaatttttacaggagaaaaaccttaaaattgagaacattttattcatgatcttctctctttgaactaactagaaagagactgtcattttctagaaacaaaacactaaggccaggctatggcacacagttgagaaccactgctttgagtaaaaggctgtttagcatcagttatatctaaatctaaaaaacatttggggcaaggaattctttgaccagatctaaggtcca

SEQ ID NO: 396107 - DNA, 532 bp, Homo sapiens
ctcagcctcccaaagtgctgggattacaggcgtgagtcactgcgcccggcccatcatatcctttatgaataagaatttctagtcactaggtccaggagtctgtattttgaaattcctaggtgattttggtgaccatccaagtttgagacccactggccttaccgtcatgcctcaattttcaaatgaggaaactgaggactagggcgggaaagtgatttccttgcaattaaaggcagccagtggtaagacgagaccaaggacctttcggaggtcccttgcacccctgagagtcagtgactctctgttttcaccttggactgccgtgatgtctgactcatactgtagtcttcttcctaaaatcctcttctttttattttttatttttggcagtgtgttgaattctcctctagtttcattcagtgagtgctatttcttgcttcattataaaaggtggtgtgtcacaggtcctgtgtgatcacacaggctaagtgtaagctttgagaatgatctcttggaccctttttctcagatt

SEQ ID NO: 396108 - DNA, 597 bp, Homo sapiens
cagagtgtcaacccaccatttaactcactgtccagaggcttttttaaaaatctccaaatctccttctaatccactaatctcttcaggaccacccgacacagttctcatgctcacatacctctgcttataagatttagtcgtcagagggaatctaagatgcaaaataacctatattcaattaatcgacttggcaccaaaaataacttaccctgatttattacaaattgagtatgtaagtgtataaatgaatgggaactgatagagctatagtttgaagagcaaattgctggagttgccggcttgattttacattacactgcacttacattttactcctgaacatttggcactagagagttaaataactgatagcttgaaacaattaatcacagcgatccacgcacctggtgaattacgagttcatccatcaagagagcataggttcaactcaagagatatgatgtaagaacaacacagctccaaagccatgtgtcagagtttctttgccaaccataattagtgaaattactgacaccattcaagtgccaagaggttcaaagaaataacgaacaacacacacccatttagccctttgaa

SEQ ID NO: 396109 - DNA, 612 bp, Homo sapiens
aatgacaaccaaaaccccctttaaagacacacaagaaaatatccatgttacacggaatgaggttcttcaaatcgtaacaaaagaccatttttagatcatgaaaagaattttttcagcatgaaggctcactttacaaactctatcatccaaaatatcgtctttcaggttaaaaaaaaagaaaatctcaagtagcactgaaattaaaaagtgaaacaaatattctggcaagaaaaagaaaacttcagagtgatacaaaggacaaagatgtaaaaagacattatgtgaacaattaacctcacttagaaaaaaatctgctctgaagaaatggaagctggtaatacttggtattatctgagagctatcatcaagttttctggaaaaaaattttatatacatatactatacatatatatgcatatataagggttgaacctagcatataagttatgtttcataaatctgatttatgggtacttgctactactactcaagtaatacccaaagaacatcagctgtactcagaagacacgcctcattttgatggaaacttgcaatgattcttacacaagacgtgttcaaaatgttataagatactatgcgtaaagagcaggt

SEQ ID NO: 396110 - DNA, 231 bp, Homo sapiens
gccaccgcgcctgacctggaagacatttatatatgacaaatttggagaggcaaacaatagtgaaagaaataattttacaataaatagctcttgggaaaaactagataacagtgtggaaaaagtgaactcagatttatatctcacatcatatgttataaattttagatgtattaaaaagttagttttacaaactcttaaaactcagagggagcggtggtattttttcctcga

SEQ ID NO: 396111 - DNA, 493 bp, Homo sapiens
tctattccaaaactgacaaatgcttatttgacatcctgggaactagggccaagttcattcagatctaggaatcccttgagcagaattttaacctcattaaattagttccttgtttaattctctgcatgcttcatacttataacattttgattcactgttagtgttgccagtcaggttgagtctttgctctttgttctatcagtagttgggaagagggatctaattacaaggtctctaattgaataatccaggaggtcatttggaaaatagaaaatttcacgttaatgaacgttgatgaagcatttctgagctgagcatggtgtatgctgggcattctgtaagcattatctcagtaggtgcttagatagacattacagacatggaaagtgagtattattaaacatttagtcatttcagggccattgttgttttttcccaacacgtcctattcttcaactttctttcttcctaaattctgtggactcccctcgcc

SEQ ID NO: 396112 - DNA, 327 bp, Homo sapiens
ccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaag

SEQ ID NO: 396113 - DNA, 356 bp, Homo sapiens
tcaactccctttatcagggttaagttcacagagaaatactaacttggataaaggatcaggtggtaaatatgtgtcctactcagacacaaggatttttattgatagttggttaaattcccatctctctccacataatagaaaaaaataaaccaagccaggcgcagtggcacatgcctgtaatcccagcattttgggaggtgaagagggggtggatctctagagctcaaaattccagaccagcctgggcaacatggcaaatcctgttctctataaaaaatacaaaaattaactgggcatactggcaaacgcctatagtcccagctacttgggaagctgaggtgagaggattgcttgag

SEQ ID NO: 396114 - DNA, 464 bp, Homo sapiens
agactggtctcaaacttgggccaaagccatccacctgcctcggcttcccaatgtgctgggattacatgtgtgagccaccacacccagtcatgagaattattttaaatcaggtaaacaaaatgtctgtgggaatattgagctttatgatagatacctaagttttcccaaaaataattgtgttagcatttcagtgaatcactatacttaacctagaaatctaggttaccaataacagtctctttcaggtttttttcttttcctgtgtctttctttttactaaaatcattcataactgggatgacttatggagttgataccttaggtcaaatcccaatttagaaactcccaaaagcctgtcaaattttgacacatactttaaatgaactgttattgagtagatataatttagttgtaatagtttaatagtgtttgacctatccaaacagataaaagaactcatttta

SEQ ID NO: 396115 - DNA, 598 bp, Homo sapiens
tgcctcataaataacaggtgactagttttcttattacatctttgttgacatgtaattcatgtaccatacagtgaaccccttttaaaggatacaattcagtggtttttagtatagtcacagagttgtgcaacaattacaacagttttagaagattttcagggtgatgagtttttaaaagcctcccatataatttttatatgctcatctaagggggcttatttttttcttctcacaaattgttcatctgctaagaagccaaaagtatggaaatgtcatatgtgttttgtatatgttgaattactcgtgactttggaaaaatttggtgtaaaagagccaggaatagatgaataccaccaagaggccagtagataataggacaggagattgactatggaaggtatgggttatatgcctcaaaggaaaaggaatttaaatctgaggataagggaggaatgatgtcacagcattgtaagcgctaccctcacctcctgacttggggtggatgaggtaggagagaataaaacacctgtatttgaggcctgagagaagcactgtctttgggaagggagtagagctaccgtttccattatctgagagt

SEQ ID NO: 396116 - DNA, 339 bp, Homo sapiens
agggggcttcagtatgctacgaaaacacctgtgactggccactgcactccaacctgggtaacatagtaagaccctgtctcttaacaaaaaaggaatgttatgaaataataatttaggctttacctgtatacagggttgtttagaggagaggaagtgtgtaggaaaggcaaggaggagatcattttggaggcctcttagaaatagcccaggcatatggtaatgaagatgtaaactgatagtcataaataggcatggagaggaaggatccagtgaacagtagtgtggaagcagaattcaaaagacttggagacttgcattctgggagcaggagtaaggcat

SEQ ID NO: 396117 - DNA, 327 bp, Homo sapiens
catgagctgctgcaccaggcctcgagttgatttttgtataaggtaagagatgaggatccagtttcattcttctacatgtgagttgccagttatacctgtatagctgtgaacaaggtgatagctcttttggggcctcaagtttcttagtctgacaaaatgattgaaaaatgctttctaaactgtggaagcctgcatacttaaaccaagaggcaaattgtataggcagtccatctttcccctcacattatacctagaaagaaactggaatgtgatcttaccgtagctgatcactttatatagggtaaacactgcgattagaggttgggt

SEQ ID NO: 396118 - DNA, 260 bp, Homo sapiens
ttaaaaagacatcactcttgagacaagcactgattaatgaagggacatttctgctatacgatgtcactccccttagattatccaagcctgatacagtgggagttgtgaggctacgacagtatgcccctgcattgggatttgaaaatgcagaacactgaatcagtgactatctattcaacttctactctgtgtacaggcctgtcatagatgcttttacaagtatgaaatcattgagtcttcacaaccacactgcgaagtta

SEQ ID NO: 396119 - DNA, 193 bp, Homo sapiens
acaccatcgtagtactctttatggcaccaaaaatggttttaagtgtttgtttatgtcactgtttcctcactagattatacgttgctcaaaggcagggactctatccttcttgttcaccgctatgtctctcagttctataataatatgcctggcacaaagccggcttctagaaatacatgtttgaagttgtaac

SEQ ID NO: 396120 - DNA, 235 bp, Homo sapiens
ttggtgatcaacttcaccttcagcccctttcccctcctgggaggttgtgtggggtgggctgaaagtcctaaccctctaattatgcttttggtctttccaatgaccagctcccatccttaagctatgtaggggctgccagccatgaatctacccattaacatacaaaaagacatctctctggagattctaaggattttaggaattatattttaggaattatatgttaggaaactgg

SEQ ID NO: 396121 - DNA, 470 bp, Homo sapiens
cagctaagctacaccccccattcggcgcctcaaaactctcagttccttctgagaatttccagccttaccttcacacagtccattaacatgaaggtgacatcattttgttaatagaaattagcaggcaactttgttctgctttggtaaagttttatagattgcttgctgaatatgatcttttctttataagaaagggatttggattgcagagatctcactgagtatttgattctcccagaggcattgtgcccactgctgtgggagctgcccctgcagtggttgtgtgggctgcatccagcatgggcagggtagagagacggaacccctgatcgcagcaaggacggagtccaggctgggcgcagtggctcatgcctgtaataccagcactttgggaggccgaggtgggcggatcatttgaagtcaggagttcaagacaagtgtgactgacagaaaccccgtttctactaaaa

SEQ ID NO: 396122 - DNA, 323 bp, Homo sapiens
catgtggagtgcagggcgacttctctctgcttccagctgccactccctatttctagcgttgctgccaagaagatgggttattagtttggccaaagctaatcctaaaggaaattgcaggtaccagagagagagaagggagagcaagagagatttcaaacatgaaatctcatttttaaaaattgcatgtgtggttttgtttgtttgattttagagctggggtcttgcgctgtcacccaggctggggtgcagtggtacgatcatagcttactgcagccatgaactcctgggctcaagggatccgcctgcctcagcttcctgagtag

SEQ ID NO: 396123 - DNA, 1046 bp, Homo sapiens
ctcatgcctgtaatctcagcactttgggaggccaaggtggccggataacttgaggtcaggagttcgagaccagcctgaccaacatggtgaaacccccacctctactaaaaatacaaaaattagccaggcgtggtggcaggtacctgtaatcccagctactcggaaggctgaaacagaagaatgccttgaacccggggagcggaggttgcagtgagctgagatcgtgccactgcaccccagcctgggcgacagagcgagcgtctcaaaaaacaaacaaaaaaaatctgttgcataactaaaagaagattgagacttagtttaagaagaaatcacttaaaggcaatcctccagattaaaaccttgggattttatttaattacaaattcatcataagccaacattacaagtcgactaaaaaacttacagcaacttcagactgcattagtgtccagatgtgcaacatccagatccaattcagctaccaagggatattatttccagttccaaatacattttggaagggacattaacaaagtttaacatccttagggagcaatcgggatgataaaaatgataccatatgagaaatagttggaatagcgaaggatatttatctcaaagggtggaaaaactgtgaggggaagggtagagaggatagactaactaccttaagatatctaaaagattatcatgtagaaaacagatccaaattttatatagcttgagggcagaattaaggtcattaaatacaactgtaaatagtagattttaacccaaggatgggctttataacaatcgatggtagcaccaaatggattgggttgccttgtagattatgagttcctcctatcacttaaaggaacttcagcatggactgggagactgggttaaacctttccaagtctataattatcctgaagaattaatgctcagtataattcaaaacacatgagaattgccttccctgaggtgttaaattttatttcaagtcaatcaaaatagatgtaagtggccaggcacagtggctcacgcctgtaatcccaaca

SEQ ID NO: 396124 - DNA, 507 bp, Homo sapiens
agtgacctttgcagggacagctgaattgtatttaaaaacagaagtgtggttggttttctgaagagctatgaaaaaatatggattagtcccatatactttttttactttaatttgtaacacaccaccaaattcgagtagattagaaataatgaataacccctagaaacagtgtaagacagtgtaaaaaggcagtatagaaatgattgatgcttgagcaggccctgattttgacatgaaagaaagatggtggtgctgttgtggaaagtagctgggcaaatgtcatgtagttgagaactactgcaaccaatgaaaacacagcactcctctaaaaacagagtaatttctctttaaactcttaatcgtgtatgtgattgactacttttcaagatttgaaaaatatctcacaaaggtaaattcatttaacacaaactgaccttgtgtttaaccccaaacttctaaggataaatatcacaaaggtacctttttaaaaacctaaaagactatgta

SEQ ID NO: 396125 - DNA, 501 bp, Homo sapiens
gcgttatgtggatgatttgactcagcatggaagactgaggttgtcttacacccattatttcccaccccactcttaagtgccagcatagtgctaaacacacagtaggtgctcattatttgtctagttaaaaaacaaattaaggctgtagcttaatatagcctcaggatatgtgtgtgcctgtgtgtgtgtgtgtgtgtgtgtgtgtgtgtgtgtgtgtgtgtttaaacataagcttacatataagcgtatgtaagttaatgcacaaatatatttcctcaaattcacataggatactcaaatatagatgtataattttgtagtcccactgtgattctccatatgtataacaagaaaattaaaggcataatacagctgtgaaatagctgatgagtttctattttaagctgatttttcaccagaagtatagtttctgctgccaaagtaaagtataaatgtatttgtatatgtgtggaaaataaataatttgtgacatgtattggt

SEQ ID NO: 396126 - DNA, 408 bp, Homo sapiens
ttaaaagacaagcacagaagggattgaggcccacagaaagaaggaaccccatgtggtgctcatttgagttgaacaaagggacctgcactgatgaatatatatgggactggtcccgtacctaagttcccatccagaagagaagtcagaggaaaccagagaacttcagaagagcttggtgagcgccaacgggctcacacacacagggctgtgggagcctacagcccacagtccgcagctctgagaaacacattgtgttccgcctgtggggcagtgtcctcacagcaatccaggtgtgtttgaaggagaacgcctagcagcagctgaaataaccaaaaacaaggtggtaaatggctgtcctgggccaatacagggacaaattggcaaagtagaatgttcctcgcagagctc

SEQ ID NO: 396127 - DNA, 361 bp, Homo sapiens
ttgcaaagattcttaacaagaactacttacattggaagaaaaccacagagaattgtaaggagctatgtgacagagaggaccaggatgccatgaaaacggccttggctacatataggtcattcgatccttggctcactggcatctctctagattttcaataatacaatgttcaatatgctgtgcaaggtaatttcatcttgcaaagattcgatgttacattttaccacacatacaactgaattaaacttttacagaattggaaatgcacatcactgatcaaaataaatgaaacatgaaaagagtaggaaggaatacccagtgatggaatagcaaatatgaatggaaacagaataggactgct

SEQ ID NO: 396128 - DNA, 711 bp, Homo sapiens
aaacggaaatcagcctggcaactgacagggagagatagtctagtctatttttggaacccatcttttcattttttgaaatttgaaatttttttttcttaatttacttcttttgtttagttctttgttttatttggccctaaattgttctggttgtaacaactctaaggaaacaagtaattctgaagatcttttgcttccacatcgtgaaaggtcttttggtagcagtaacatgatgtattttcacttccagactaggggttggcaacccttttctgtaaagaaccagacagtaaatatctcaacctttctagtttttgttgcaactattcaacctgtcattgtagtaggaaagcagtcacagcctgtgtgtaaagaaataggcatttcaaattaaacttaatttacaaacacaggcaataggccccagttgtacacggataggatttaccaatgcacaagagtgaaaagatcacagtggaagtttataatttcctttgaatttttatgcctaagcaacagaggggaatatatggaaatattcagatacatgttcctgtgcatgttacaagcacagcagggtggcgtattttactatgtccctctgcttcccctgtttgtttttttaaggcatcaagccagtaacgtgaagttgcagttacaatgcgtaattgccatgtaggtctgatcggctatagttcttttgcctgctgt

SEQ ID NO: 396129 - DNA, 444 bp, Homo sapiens
ttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcgaacatcggactccacgttcttcagtttggggacttggactggctttcctcgctcctcagcttgcagacagccttttgtgggaccctgtgattgtgtaagtcaatacttactaaattcccctttttataaacatacatatatatcctattagttctgttcctctaagaaaactctgaccccagactaacacagactctggtaccaggagtggttccagaggaacagaatgttaaggatggagttcttttgttggtttgggggt

SEQ ID NO: 396130 - DNA, 911 bp, Homo sapiens
caaccgagaacatcaaaggcttctctgcagtgtcaatccgataaagcatgtaaagtataggacacagtcttgcaattgcagtgtaaaagatggcagcgattctagttactattcactggccttccatattccagcagagtttggactgccaccagtgtgtgcctgtattgaggctcttattgtgttgtgtctacctacatatctcgctttctctttagaacaataaacattgtcaaacgaaaaaaaaaaaaaaaaaaaaaaaaaaaaaaaaaaaaaaagggcaaaaaaaaaaaaaaaaaaaaaaaaaaacaatttgggggggggccagccccccgaaaaatatctcaacaccccactctgtggggggagcgcccagccccaaacagtaagtagagcaaaccagctgcgtcatcacggtgttcccacaaaaagaaaagccccgggagcacaaacatacgcggggatgagtcacccaccaaacaaaaaacccgcgcgggcggacacaccagcggtgtttgagacacaacaccaatcgagggcattgcaaaggacaccaacgctgagcttacaacacaaggagacaccagagagggacagtaaaaaataaccccgcccggcagaagcaaaaaccaccagaaacagtgaccaagacgaaaacacaagaaaaaacaaaagagcaaaaagagaggaaacaagaaaagaacaagaataaaaaaagaacaccagagacaaacacaaaacgaagagaagagagaaaaaagagcagagacaagaagaaagagaaagagaggaaaaacaaaagaaaaaagaagagaacaacccacaaaaaaagcacaagcaaaacgacaaagaaaaaaaaaacaaaaggaaacaagagaagaccaagaaaacaaaaaacagcgcaaggataa

SEQ ID NO: 396131 - DNA, 213 bp, Homo sapiens
tgaggtggtagggatcgcttgaacctgggaggtggaggttgcagtgagccgaagtcgcaccactgcactctagcctgggcaacaaagtgagaccctgtctcaaaataaacaaagttccttgctgcagagtagcggggagattggaggggtggggcaggaagccagaagtgagtttagaggggcttgccatgatccagggatagagggtagtca

SEQ ID NO: 396132 - DNA, 833 bp, Homo sapiens
tgtggaagactccagcaggaatatcaaagaaaaatagtcactggcagcttcagtgagaaaccagagctcatggagatgtcttagaagttactgcttctggctgcttgattgggattagagatggtgaggtctgtgcagtattcatctgagattaatggcttagtgcttcacttctgcctttcctattccattcaggttttcctttttttttttttttaacagcattttaaatttttttttatttttaatttattatctatttattttgagaccgggttaagagacgggctaatttttgtatttttggtagagacaggttttcgccatgttgcccagtctggttttgaactcctgacctcaagcagtccacccacttcagcctcccatagtgctgggattacagttgtgagccactgcgcctggcccattcaggtttttctcattggcaaagtttagcaagaaccatacaggaaacgccttctggaaaacagttctgagcaccagattgcagtggtggtactgttaagtggacaaaggacattgcagtatagaaaagtagctgagacatattgacctcaaaactggagatggttttagaaactttgagagggaatgcaaatggtgcctaatgtctttgttcagttgttttgggtacctgcagtattattcttttaggaaatggtgactgggtgccatgttcaaatgtattccccaaaagttcatgttggaaattgaatcctcaaatccatatgttgatggtatttagaggtgggagcctttgggaggtaattagggatagatgaagttatgggggtggctccctatgttgggat

SEQ ID NO: 396133 - DNA, 439 bp, Homo sapiens
gcaagggggaagtgactcatcaaaaagtctttgcttaggtgtttcagcccaatcagattgctttcctaagcccctatttatgatccacatgagaagtggggagcttttcagaaaagagaaaaagtgatgtaactgtggaacatgtgacattagaggttaggcaagcccaaggggactcgcactgagaaaaatttcaaaagccaaagggcagtgtgaaggcattacatttttgtggtgtaacagagggattacaagaagatagatgttagtagcagaggtgaaaaagaacaaacacttaaattattttaaaatcggactttgtgttggccattttcctattttttgtatgtctagaatgatatagccccatataagaaaaacagggctacattttaggactggacccaggactagctggtagggcaacagcagagtgcat

SEQ ID NO: 396134 - DNA, 361 bp, Homo sapiens
aaggagtggaatttatgaaatgtttgctgcatccagcaagcagagctgctataatacagctgcctcctcagtggtttgctttgatcctgtggaatgaaaggacaggaggatcagctcaggtctaaatgagattacagctggttctgcagcttatctggtctattgccaactagtgtggctttgcacgtcctaaggggtttacaacagaaactgtttattgagtatcatcggtttactcaacacaagcaggctaatccttcccagcctcagcatgttgtagaattgtgcaggagccaaaccaaaagctggtgtagccagaccctctagagccctttgtctcgctgtatattgatttttacct

SEQ ID NO: 396135 - DNA, 614 bp, Homo sapiens
gtcagacagatgtgttttctttgcatggcagcattgagatggatccaatctgcgaaatttgctgcccaaatagcatttctaatggaaactggaactaaacaagggcacggatatgggagggaggggagaagagagaatacacgaagaagagtatattcagagccactgcatggcattttgagtacaggaggttttcaggaacgatctttgcttcattagtctcccctgtgggctcctgatgtagggagctatcagggtataccaagatgagcactgagacaggcctttctaggtctgaggctgaggaaagcagcggcaacttggtgcctgtcccccagagctgtctacagttcagaagccaaaagcacagctacttctaatttggggatgcagtagagtgcctactgatccaggtatttgtgaaagatggaattcttggtgctatcatagtatacattgctaaagagcagatgaaatcggctgcttaaggaggcctgataatatttatgttggttaattctcatgataatgataactgcacttgtctagtattttcagaatgttaaaattaccagtgtggcttaatgcatgtttacaataaatagagagggaca

SEQ ID NO: 396136 - DNA, 714 bp, Homo sapiens
aataatttgtcacacaacttgtaaatcttcatttcttttaggtcagccacatgaactttattttgtttctttggtagtctcatgtttccttgattcttcatatttttaaagttttgtgttgaaagaagcagtcacattttcaagtctttactatctgtcttcaaagaagaccttcacaagtcagcttaactagagattttgagggtctctcaggccttttttatgggtttgcccaccccactgctcttttttcctcctatgaggaagtcctgggattgtgtgtcttctcttgatcctgttaagtcaagccaggtgttgagagcctcctctttatttttcacatggcaatgccctgaagtatttaatcttgtataccttttcccagtcctgcagagttgagctggctgctgatctacatgcactctctgtgagtatttgctcgcaccatctcagcagcgcacatagaatgaagagggtgcatattagccagtaagggacactgcagatgaggttttccatagagctcacgggtgggcctcttggtggagtccataagccacttagtaggatatatggccatattttgagatcttcacagtggttgttttgaagcctcatcccttcttacctgctcctagttccccccaagactatttagtcatgccaatcacctcagtaatctgggagtgggaagaccagtgtaagcctcttggg

SEQ ID NO: 396137 - DNA, 426 bp, Homo sapiens
caacaacaacagcaagaaaaacaatgataacacccaaaaataatccttggcttattaaaatattggcataataaaatggggacagggaaattttcataaaataaagagaaatatcaaggaaataaagagcatgctagaaagcaaggttttaatttattcttttaatttattattttccagctttattgaggtgtaattgacaaataattgtatctattcaaggtgtacaacttgatgatttgatatatgtgtactgtgtaatgattaccacaatcaatcaacatatccatcacctcagatagttacccttttgtgtgtgtgtggtgaggacacttaagatctgctctctcagctgactccggaggcttacggttggggaggatctctttgagaccggggggatttaggctgcagttagccatggtt

SEQ ID NO: 396138 - DNA, 177 bp, Homo sapiens
ttgacctactatattttactgattctactgatcctaagacatgttttcccctacattttcatttctctaaaactaaagtgcaatctaaactaataggttacactttagttggcaccattttttctttctcattgatacataaaataatgggcacatcttacaacttacaactttgac

SEQ ID NO: 396139 - DNA, 335 bp, Homo sapiens
ataccccatgcagcacagggtgttaaacttgttccccagctggtctagggggcgaggttggcccacagcagcgtccttcgaagctccttttctctattaaaagtttgttcaaactcagcattctgttccattaacgtgtagcagcagttattggaactgtcaggttttattatcaaaataaagccttccctctagtcttcagacaaaatagatcttcagaaagatgcgtcaggctgagagcctgtagtttctagcatgccatggcacacagacacactctgagggccactgcacagctgtgcatgttgtgcactgtgcaaagtgcctggctgaga

SEQ ID NO: 396140 - DNA, 309 bp, Homo sapiens
ccagggtcgtgagaaatagctgtgtccattttaaagcaagaaaacaaatggcacgattgctctgctgttcctgtcctagggcagagagctaagtcaagcactcagtggactgcgtctcgtctcccttggactggtagtgacagggctgccctgcacgccacactgctctcctgttcctgtagtgtcgctcatgtaaaatgcactgcaggctggtgctgctgaatcggctcactttctcccatttccttctcctccactttcagatttctttcagcactctccaacttaccttcagaaatgcaacaatgg

SEQ ID NO: 396141 - DNA, 362 bp, Homo sapiens
caacattaggaggtatgaggtccacttcctgttttgtttgttgttgttcataaacctgagacttagaaatcaaagttaacttgttcagggtcacagaggctagttaaggggcaagccagcatttgaacctggcttgccactgcaaacaccctgcctgctatactggttaaaaacattgtttcttccaggtgtggtggctcatgcctgcagtcccagctgctgaggagactgaggcaggaggatcccttgagcccaggagtttgaggctacaatgagctatgattgggccactgcacccagccccagtttgcatttctaacagccttctgggtattgttgatagcttgaggtaatccgtaggg

SEQ ID NO: 396142 - DNA, 227 bp, Homo sapiens
acttaccacatttgcctcaagccagttactaactccaggtagtcactaactttcccttgggaacacttaacctggttgtgagtaaaaaaagaatgaacatttgagatgttgaaacaactatcgggaagatgtcaatgaacagctcaagactggaattaattccacagagaaatgatgactgaatagtcaatttagaaagtaaaaacttggacttaaattccaaaatg

SEQ ID NO: 396143 - DNA, 397 bp, Homo sapiens
aactcaaaatatagaagaaaaaaacagagacttcagaaatgcataaccccatctatctgcaacgaaacatccaaaaatcccaaatgaggaagattctacaaaatgtgtgaccgctgctgctgtcaaggtcatcaagaaaaggaaaaaaagaaaccatcacaatccagaggagcccaagaagatatgacaactaaatattaggtagccacctggatgggatcctggaatagaaaaacggcagtagggaaaaactaatgaagtaaaattaaactctggagtttagttaacagtgatgtacttaaattggttctttcacagtgacaagtatactatagaggttcttaaaattgacattttattgaagagagtacaataaaattataatcaccaaaccaat

SEQ ID NO: 396144 - DNA, 573 bp, Homo sapiens
ataaactccaaaacaatgcaacttttttctctctagttttatcttcagcacagcttgactcatcataattttacctttaagtatcacctgcattaataaacatacaactaggtatcaataaatttctgtggaaaaggaaattatcacaagatcaaaattgaagaaccagtctcatttcatctaatatgaaaatgatcaacatatataaaattaaatgcataaccccatctatctgcaacgaaacatccaaaaatcccaaatgaggaagattctacaaaatgtgtgaccgctgctgctgtcaaggtcatcaagaaaaggaaaaaaagaaaccatcacaatccagaggagcccaagaagatatgacaactaaatattaggtagccacctggatgggatcctggaatagaaaaacggcagtagggaaaaactaatgaagtaaaattaaactctggagtttagttaacagtgatgtacttaaattggttctttcacagtgacaagtatactatagaggttcttaaaattgacattttattgaagagagtacaataaaattataatcaccaaaccaat

SEQ ID NO: 396145 - DNA, 397 bp, Homo sapiens
aaaggttcttctcgtatgtaagcaacgcggggtttgaaatgcataaccccatctatctgcaacgaaacatccaaaaatcccaaatgaggaagattctacaaaatgtgtgaccgctgctgctgtcaaggtcatcaagaaaaggaaaaaaagaaaccatcacaatccagaggagcccaagaagatatgacaactaaatattaggtagccacctggatgggatcctggaatagaaaaacggcagtagggaaaaactaatgaagtaaaattaaactctggagtttagttaacagtgatgtacttaaattggttctttcacagtgacaagtatactatagaggttcttaaaattgacattttattgaagagagtacaataaaattataatcaccaaaccaat

SEQ ID NO: 396146 - DNA, 426 bp, Homo sapiens
  misc_feature (20)..(20): n is a, c, g, or t
  misc_feature (65)..(65): n is a, c, g, or t
taaatgaagaaattattganagtgaatggatgtaagagaaattaaagaaagaaataaaaggctanaaatgcataaccccatctatctgcaacgaaacatccaaaaatcccaaatgaggaagattctacaaaatgtgtgaccgctgctgctgtcaaggtcatcaagaaaaggaaaaaaagaaaccatcacaatccagaggagcccaagaagatatgacaactaaatattaggtagccacctggatgggatcctggaatagaaaaacggcagtagggaaaaactaatgaagtaaaattaaactctggagtttagttaacagtgatgtacttaaattggttctttcacagtgacaagtatactatagaggttcttaaaattgacattttattgaagagagtacaataaaattataatcaccaaaccaat

SEQ ID NO: 396147 - DNA, 390 bp, Homo sapiens
agttaatttcattcaaaatttcaatattttccctcagaaatgcataaccccatctatctgcaacgaaacatccaaaaatcccaaatgaggaagattctacaaaatgtgtgaccgctgctgctgtcaaggtcatcaagaaaaggaaaaaaagaaaccatcacaatccagaggagcccaagaagatatgacaactaaatattaggtagccacctggatgggatcctggaatagaaaaacggcagtagggaaaaactaatgaagtaaaattaaactctggagtttagttaacagtgatgtacttaaattggttctttcacagtgacaagtatactatagaggttcttaaaattgacattttattgaagagagtacaataaaattataatcacc

SEQ ID NO: 396148 - DNA, 450 bp, Homo sapiens
attctatgagacccccaaaggcaaaaagcaccccacattttggaccagcagcttggcactcagcctccttcagaggggcttcaccagccagccccagcccaactggtttctacctaaatactcactccctatgcactatagctactgactttgcctcaaagtgatttctctctcaaacgcctagtacatcaacgtcaattggcactggtttctgttaacgaacagactggcctgcgccaaccacagcttaccacacgtgtactcggcctacttccctattttcaatgcctaatgatttttgctgcgcctgaacacatctggagggagccaggcccactggctgcctctcgtcccactccaggccctcctacaaaggtgcactcagcaaaccctccaagtacagacaggttctacaatgttgctccaagtcagagaggaggcctcaaacaa

SEQ ID NO: 396149 - DNA, 382 bp, Homo sapiens
cgctacggacgctgcggagcacagacgggcgctgcgagagacggccctgcacaaaagacaaaaaggaccaaggcggcaggaaaaggagaggaggaaaaacaagcgggcagaggccgctggaaattgtcttccacctgatgcatggggcttaaagcctaggagacagagcctgcgtccacgcagcagggagggccagtgtggaggcacacagagcgacccgagtttctgtcttgtgtctggggcacccaacaacagtgtctcgcacacagcagatgcccagcaggtgtctgatgcgtccgtagcggccactgggctctcctggatttcccttggtgtctgcattgttccaccatcaatggcccgccagtgtctattggtgtgt

SEQ ID NO: 396150 - DNA, 463 bp, Homo sapiens
cactggcatatggtagactttcagttgtcactgtgagcagtcatttagctggtatttgttttatgttaatgtataacagcttctaggacattaaggttcacatctctgttttctagattatatagagatgaaagtaccattttacccaacaaagagatacacgtaacaattttaagtttgaacatttttacagttgtattaaaaatagaaataagattttataagactctcatttgaagttagcgtttagaaaattttcaatagtatgtagctttgtcagagaatagaatattgagttggcaggaatcaaattgtgttttggattgttttgtgattacagaaggtctgagtgcttacaatttaaaaccccatgtccattgatgacaatagaatgtagaattgggagatgatgtaatcctttctatgttttgatatttaactatatatatgacattgatatcca

SEQ ID NO: 396151 - DNA, 406 bp, Homo sapiens
taaatccaagatccaattaaggagcatacattgcatctggttgtcatgtctctccaatttcccttatctagtctggaggcaggagggacgggactggcttttggacgttgacatattttgaaaagtgcctgccagttgtcttggaggaggtcccccgtaagttggatctgcctgttccctgtcatgagattcgggtaatacatgcttggtaaacacagttcctgggtggtatgtgctttctactgtattattaatcagttattgataatgctaagttcgatcacttggttaaggtggtatctgccaaatttctccactgcaatgatatagtttctcctttgtaactaataagtaatctgtactgcaatttgagattttaagcatcttgttccctaacaaattttca

SEQ ID NO: 396152 - DNA, 531 bp, Homo sapiens
gttatgacttagtgaccaggaggataaatgctgattctggggggagaggatgtagagcagcaccctgagaggtgagaggggtacagatcaagagattgatacaagaagttgccttggagaggacagtctgtttactggaaggaaggaagtgaagattattgaacacctgctttgtctacatgaatcaactcatataatcttcaccccaagctgctgaggtagatgtaagtattttctccattttacagctgagcatagagcttttcaggcacttctgtaagatctgagaaggggcagatgcagcatttgagcctaggcagtgtggctccaaagcacttgctcttacccaccacaatttgcagagaaaatagttacagatatagggtgcatgtatatttgacaatgggaaaatctgatatcctcttctgattgcatcagttttctctatgcaacaggaaccaaggccattagccaggagtagggaatagggagagtgctggagatgaagaaggatggagaagacatagtgtg

SEQ ID NO: 396153 - DNA, 574 bp, Homo sapiens
atttttgatttgcatgctaacattatcaaaaatgtcccactttttaatttgtagcctaagtagtgatactcatgtgctttacaaaaataatcagattgactttcaaataggagagaagctcaccgctgttcctcatgtgtcactttccctgtgtccataaatagggccgccggcacttcaaccttgtacacctcatttatatgccatttgctgcctggatagacttacataatgaaataacctggttttttatgttccgtttcttgtatagttaaaaaaaaaaatatgatcgggccgggcgtggtgctcatgcctgtaatccccagcactttgggaggctgaggtgggcggatcacctgaggtcaggagttcgagaccagcctggccaacatggtgaaaccccatctctacaaaaaatacaataattagccgggcatggtggcccttgtctgtaataccagttatttgggaggctgaggcaggagtatcacttgaactgaggaggcagaggttgcagtgagccgaaattgtgctactgtactccagcctgggcaacagagtgagacttcatctc

SEQ ID NO: 396154 - DNA, 349 bp, Homo sapiens
aaaacattccctgatcgcttaagactgaggtaaaagatgttttccttcctctctccactcaacgcaattgaacactttattcttccacaacacctgggttatactctgttatgtcttcatggttggcaaacggttcatggcttggcagctggctccccatctacagattccttcttggccgaatctgtatcttgtctcccgagcaccctcatgggacccagcacagctttacacccataggtgcttcatgcacctttgaataattctcataacttgatcttcttttaagccccaaaaggaaaaacaccaccacctccacagagcctgcaattcatgtgaatcttttttt

SEQ ID NO: 396155 - DNA, 659 bp, Homo sapiens
gtataaactacatgaggacaggaattctgtctatccttttacagatgtatcctcagggcctatcacagtcccaaatatgtgacaaatcttcattaagtattggtcaagaattaaaaaatgaatcactaaatgttatagtactctttcttaaaatcttgcaatatcttgttgctgtcaatttctccagttttgtctctcccttttctccaccatgctgttgagcctgtaggtgaggtgaagatatagaggaactggagctttcatacgttgatggtggaaatgtaaatttgtacaagtactttgaaaaactatctggcagcttgctaaactttataactaaagttgaacataggtctggtgtatgcctgtcatcccagcattttggaggcctaggtgggacgattgtttgagcccaggagtttgagaccagcctaagcaacatggcaaaaccccgtatctacaaaaaattaaaatattaaccaggtgtggtggtgtgcacctgtagtcccagctactcagtaggttaaggtgtaaggatcacatgagccagggagtcaactctgcagtgagccataattgcaccactgcactccagccttggtgacagagcaagaccctgtctcaaaaaaataaataaagttgaacataagcatacctga

SEQ ID NO: 396156 - DNA, 362 bp, Homo sapiens
cgagctggttgttaaatgaggccctgggctgtctgtgccagtacagaccctgctccgcagccccacagggcctgagtgacagccagcctgtgctagcctgtgagacactccccagtcagaaaagagggtcactgacagcagggccgtgagtgggtttggcttccagagtggagacacaggacaataccagtgattctaagaccccaagacctcgctgatgccagacacaatgacagatgccacccatcaagccgaggcggataagggcatcataacttgtcacaacccgtcggcacatttttatttccggagagtctttgtatcttataaccgctttccacatgctaaatctgagttcatta

SEQ ID NO: 396157 - DNA, 559 bp, Homo sapiens
ctttattctctctttagaaaaaaaaaaaaaaaagtagtgggagaaatcttagttctttacagaggtaattgtgataactggtgaggaggagataaagacgagaaagttagaatttgaaagcaagagaggccaggaagagaaatgatggtaatacgatgtggggtggagagatggaaggcaagccagaaacaaagatgtatgaaagcatgtattttcctaaacagactttcattatgtgtgttggacagtaagcaaatgcaaacactgagctaggtgaagcagcatttataacacacatgacaaaccaatacttaaaccatttaaataccaagacactccatgcaagttttttgaaagtgaaccacatgaaaactgggcaatgattatgaatgagcagtttgccagagagaaatagccagtaaaaaggaaaagttaatctcagagaattgctaagtaaaataagataggtttttctcccctgggatgtaggcacaacttaataatatatgacatccaatgctgttagaatgtggagaaatgctaggagctatatatattg

SEQ ID NO: 396158 - DNA, 431 bp, Homo sapiens
ggcctcctttaaagaccaccaatcccattcacaaggagggggacctcatgatctaatctccccccagaagtctcaccttttaatatcaccagcttggagattaagtctcaacaggtgaattttggagggacacaggcatttggatcatagcaccgggggactctggttttcagaatgaaagtaggggccttgtctatccgctcaagctgcctcctctgcactgaaaacgatgcctagcccaacatggatggatcagtgtttgctgaaatgctgaatggttaaatgaataaataaatattgctcatatagcaggcaataaaaaagcatacagaacctatcactaagtgaatgaagctactctgaaaaggcatatgctgtatgatttcaactatatgtgacattctggaaaaaggcaaaactatgaagacagt

SEQ ID NO: 396159 - DNA, 184 bp, Homo sapiens
agtaaaataacattcagaattcacacagtaggtaggtagtggggccaggattcattctaacaccagaactcatactcaggctgcactataaatgactgagtatgacctgcataccttccatgagtggtgcctcctggaattgcccatcatgcagaactgaagccttatcagtgcacaggactgt

SEQ ID NO: 396160 - DNA, 266 bp, Homo sapiens
attaataatctctacagtcaacttgaatttcccaagttttctgtctttgctagtagttccaatgtttattagtcacctacacttgaatctttgaggctgtctttgactacttaattatctatatcctatccattagcaaatcttatcaaatcttagaactatttctcctttctgtagccattcattacatttctactaccatcacctcacaccttaatgctgtaacaaccttctggaaagcttacttgtacctcattgttattctc

SEQ ID NO: 396161 - DNA, 411 bp, Homo sapiens
caaaattcaacatcaatgttgttagaagtgtataaaactctaataagctctaaaatgcagtaaagcattttaatttggcactatgaaaccatgacaggttatatacacaccaataacaatatagtgtgctaaaatagtttaattaaatttaattcataaaataaatataacatctacacataccaaaattttaatctaaatgaatgtgcttcactgggcataattcataagaaaccactaataaaacataataatttgtaaaaatagaactgtcaatcacattctcccacaaacaaaactagaaataaataacagaagttatttaaatatcagcaagaatatatctataatacataaacactccattcctaaataacatttggtcaataaatgagaaatataaacccatta

SEQ ID NO: 396162 - DNA, 303 bp, Homo sapiens
atactgcaccactgcatttcagccagggtgacagagtgagaccccatcttggaaaaaagaaaataagattggaagtctgtcagtgtgccattgtaatttattggtggagtgctatcattggtaacaatatcatataaatgtatttaacccctcctagcttttgaagtaagattcatgttagagctagaatttgtctgggtgcagtggctcatgcctgtaatcccagcactttgggtggatcacttgagcccaggagttcaagaacagcctacgcaacatggcgaaacccagtctctacaaaaa

SEQ ID NO: 396163 - DNA, 616 bp, Homo sapiens
aaaggataaagtacaatgtgtccaatgcatatagacaaaattttggtgtgtcatgaggaaatacagattcaagctgttgaaattcacacttgaatctgaattccaagacttggaataatggaacaattgtggtttggcagacttgtatagcattacttccccgaccaaacacctaaggcttcagaacacaaaataaatctcattgactctctataaaaagttaatattgtaatattgcctacaaataattcaacttcagtaaaacaggagaaatagataaaggaaaatattagtatgatttcactatgaaacccactctatttaatctttagaaaagatgatacggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggtgacagagcgaga

SEQ ID NO: 396164 - DNA, 318 bp, Homo sapiens
ccctgtctcaaataaaaaaagaaagatacaattttaatttacatactagaaagctcaccctttaaaagtgtataattcactgggttttagtgtatttgcaggattgtacaatcatcaccataatttcattttagaacatttttatcaccctaaaaagaaacctgatatctgttagcaagtcactctctagttccccagtccccagtgtcttttttttttttttagctccagataaccactaatccacattctgtctgttgatttgcctgttttgtgtatttcatatttatagtgtcatatagtattggtcttttgtaa

SEQ ID NO: 396165 - DNA, 699 bp, Homo sapiens
attgcattttaatccagactcataaccagttactattttgatatctacttgggatctcaatccatacatgaagaaaaactgagctgctgatgttcactttcccattttgaaacttattagtcttgcaatagtctatgtctaagttaaatgcattcagttgcttacgctaaaaccgagaagtcaaccttgattcttctctacttggctattctctactttcccattcaattctcatcacttctatctccgaactgtatccaaaattcaaaagcttcttaaccgttgcactgttaccattctggccaaagccatcatctatcaccttaattattgtaatagtcttctaattgctgtgcatgcttctatttttttccccattttagtctgctttccagagatcattcataattatcctcttaaacctaagacaccttgggccaattctctactcaactcaagttaccagtgaatttaatggaaacttctttaaacatactgcaaattatttgacacttctcccatcaaattatgtaaaatatgtcctttcaccttaagttgccttgtgtctcatttgactaatcgagaactgcagaaatgatgctatgtgtcttcgaaaggtagatcttaaaagatcatgcagctttcgccttgttcactggaatgctctctcacagcactgagtctgtattaactgattcg

SEQ ID NO: 396166 - DNA, 361 bp, Homo sapiens
ctgcggcgactctagaggaccccaagcagttatacagactcagtctagttcctttctcccccatgttctagagcttaggattatgagtttggtggatctgtggtttttaacttttcaccaaatatagaaaatttacagccattattctccaaatattttctcttctcccctactcctttcataaattccaattacatatatcttaggccaccttaagttgccttgtgtctcatttgactaatcgagaactgcagaaatgatgctatgtgtcttcgaaaggtagatcttaaaagatcatgcagctttcgccttgttcactggaatgctctctcacagcactgagtctgtattaactgattcg

SEQ ID NO: 396167 - DNA, 731 bp, Homo sapiens
acatctcccctcttggagaaaccactaggggcagccgtcagtgtgatgggtgggcgcctggccccagagcgggctccacactcggctgggcacctccctctccagggcctgttccagcactgagtgcgcctttggggatcgtgcaccgtgagcagcacagctggaccccaggtgagggcacttcacctcccaggcctggtctccacacccgggtcacagagagacatgtcagctgaggaagcagggcaggcggcctcttccttcaacacctttaacttcctttaaatggagaagggaggctgctcctggggaacacagagggccgctccactgtaaaaccacagcagctgtgcaccaggatgggcctcagggaccagccagcccagggatggccggtgcccccaccctctgacaaatgcacccaggagtcaagcatgggggtgtcctcggcacctggattggaaggttcttgccattgtggatggggtctaacctcctggacttcagtgggtaaccgaaggctccagcacgcagcttcagaaagaccagagccaggcccaggtgccctctccagccgacatccgggctgtggcctctgggctgcttctccttcctgtggcttccaagtcccagggtacatcggtgcccttctgtgtcctggcagttttagagaaaaggaatgaagcagctgtattcacatacatgtagtaaatgtgaaattttcacagcag

SEQ ID NO: 396168 - DNA, 416 bp, Homo sapiens
ccagtctagtgtcctttcttggactagtgaaaaataacacctatgttttaggacttcatacctgacatgaaagtagttacacagaacagggaaactaccactcaaatatatttcttttcataaccctgacgtatggtcatgattctctttaagaagttaattccattttcagtctatagtacctcttaggttgttttaaatcctgccttattgaagtttctaatattttttgcagctacaaaaatattctgtcctggctttggactacatgaaatttaaggagtttttcagtggttctatttcggcatttcccatgtgtgttaatagtcatgtaagtttataggagagaagcaagggcaccagaaagaacatgtgcttcagttaacaagttcctttcaagccgagtggagtagatg

SEQ ID NO: 396169 - DNA, 984 bp, Homo sapiens
gagatctgatggttttataaagaggagttcccctgcacaagctccctctcttgcctgccaccatgtaagaagtccctttggtcttcctttgtcttctgccgtgattgtgaggcctccccagccatgtggaacttataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaatcccttccaggcatggttcaagttaaagctgaaactgtgtcttcgtttcagctcaagagaggttttgattgtgtcgtggcttttccttgtgtattggttgaggaactgtgccttggaggggcggggagtcttgagaatgggtcaactgatggagggggagtggaagacattggttgcccaagaaaatatgtcaacatctgtccatcactgcaactccggcctgattatcattttttctgcttctgtaagcaccaatgagacaatgccactgaaccacattctttgttgcctgcagtatttcccaccactgcgccacctctgatatgctaatgaggaagcccagggtttgtgtggctgaaaagcctttcaggcacaatcagtgggtcaacaatctcaactctgtacagcggctcagcctgctctgtgagaggctcctctttcggaggggtccttcctcacaccttttctgtgaagtgcgtctgtgcttaaggagggcattaacatctggctgttgtccctggagaaattgaccgaacatcaaagaataaatcataccttgaaactgccagtgggcatgactgtccggtcactggggggaagccctaaccacggttgatttcaatgccccggccgggttgaaattggaaacacgactcggaccggcctctgaacccacaaggcgaaaacccggcaacc

SEQ ID NO: 396170 - DNA, 297 bp, Homo sapiens
gatcatttatctagaataatccttataagattcctttgattcctgttaattgcaatccaatacataaatattgaaggcttattatgaggatcatttatctagaataatctctattttctagaattacttaatgatcattgtctttattcagcctaagtaacattgaaatttttcttcattcaaataaattcatactcatgaagcctttccccacttttcatttcatattctgtttctactagtattgttaaccattgcaaagaaatactgttgccctccattaaaacctgaactgcc

SEQ ID NO: 396171 - DNA, 1764 bp, Homo sapiens
gagatctgatggttttataaagaggagttcccctgcacaagctccctctcttgcctgccaccatgtaagaagtccctttggtcttcctttgtcttctgccgtgattgtgaggcctccccagccatgtggaactgtactcaaactgtggcccaagtgctggtagcattagcatcaactggaagcttgttagaaatgtagaatctcagatctcaccccagaatggactatggactcagaatctgcattttaataagattcacaattcacagtataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaatcccttccaggcatggttcaagttaaagctgaaactgtgtcttcgtttcagctcaagagaggttttgattgtgtcgtggcttttccttgtgtattggttgaggaactgtgccttggaggggcggggagtcttgagaatgggtcaactgatggagggggagtggaagacattggttgcccaagaaaatatgtcaacatctgtccatcactgcaactccggcctgattatcattttttctgcttctgtaagcaccaatgagacaatgccactgaaccacattctttgttgcctgcagtatttcccaccactgcgccacctctgatatgctaatgaggaagcccagggtttgtgtggctgaaaagcctttcaggcacaatcagtgggtcaacaatctcaactctgtacagcggctcagcctgctctgtgagaggctcctctttcggaggggtccttcctcacaccttttctgtgaagtgcgtctgtgcttaaggagggcattaacatctggctgttgtccctggagaaattgaccgaacatcaaagaataaatcataccttgaaactgccagtgggcatgactgtccggtcactggggggaagccctaaccaatggtctgaatctaaaaatgacccagtggcaccggtttgtagtaaaactttgaagatagaactccatgcaaattctgactccatagtgctggttcttgatgtaaatctcccaatgtaactgtcaaggtttaaaaatatcttacgtaggtgttcagaatcataaggtcatagaattataaaatgttaaccggcagaagtattttcatctttgtcatacgaaaaagagtaatttgctcataataagccttcaatatttatgtattggattgcaattaacaggaatcaaaggaatcttataaggatcatttatctagaataatctctattttctagaattacttaatgatcattgtctttattcagcctaagtaacattgaaatttttcttcattcaaataaattcatactcatgaaaaaaaaaaaaaaaaaaaaaaaaaaaaaaaaaaaaaaagagaaaacaaaaaaaaaacacaccaaaaggggcccaaaaacatatacgtgtaaccaccagagatagttcaggaggaacaaaacagggggcccccaaattaggagaagaaccggtagataattgaataagcgacaagcgcaaactagggtcacgccgtaactaaaacaaaaagcgtccagaaacagcgggaaaacacggggacaaaaaggggaagaactatgagcgaacgaaagcccactctcgtagaggggcgaacaatatggggaccacactatccaaa

SEQ ID NO: 396172 - DNA, 1857 bp, Homo sapiens
caggaaacagctagtacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgacgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacctccccagccatgtggaacttataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaatcccttccaggcatggttcaagttaaagctgaaactgtgtcttcgtttcagctcaagagaggttttgattgtgtcgtggcttttccttgtgtattggttgaggaactgtgccttggaggggcggggagtcttgagaatgggtcaactgatggagggggagtggaagacattggttgcccaagaaaatatgtcaacatctgtccatcactgcaactccggcctgattatcattttttctgcttctgtaagcaccaatgagacaatgccactgaaccacattctttgttgcctgcagtatttcccaccactgcgccacctctgatatgctaatgaggaagcccagggtttgtgtggctgaaaagcctttcaggcacaatcagtgggtcaacaatctcaactctgtacagcggctcagcctgctctgtgagaggctcctctttcggaggggtccttcctcacaccttttctgtgaagtgcgtctgtgcttaaggagggcattaacatctggctgttgtccctggagaaattgaccgaacatcaaagaataaatcataccttgaaactgccagtgggcatgactgtccggtcactggggggaagccctaaccaatggtctgaatctaaaaatgacccagtggcaccggtttgtagtaaaactttgaagatagaactccatgcaaattctgactccatagtgctggttcttgatgtaaatctcccaatgtaactgtcaaggtttaaaaatatcttacgtaggtgttcagaatcataaggtcatagaattataaaatgttaaccggcagaagtattttcatctttgtcatacgaaaaagagtaatttgctcataataagccttcaatatttatgtattggattgcaattaacaggaatcaaaggaatcttataaggatcatttatctagaataatctctattttctagaattacttaatgatcattgtctttattcagcctaagtaacattgaaatttttcttcattcaaataaattcatactcatgaaaaaaaaaaaaaaaaaaaaaaaaaaaaaaaaaaaaaaagagaaaacaaaaaaaaaacacaccaaaaggggcccaaaaacatatacgtgtaaccaccagagatagttcaggaggaacaaaacagggggcccccaaattaggagaagaaccggtagataattgaataagcgacaagcgcaaactagggtcacgccgtaactaaaacaaaaagcgtccagaaacagcgggaaaacacggggacaaaaaggggaagaactatgagcgaacgaaagcccactctcgtagaggggcgaacaatatggggaccacactatccaaa

SEQ ID NO: 396173 - DNA, 1628 bp, Homo sapiens
gagatctgatggttttataaagaggagttcccctgcacaagctccctctcttgcctgccaccatgtaagaagtccctttggtcttcctttgtcttctgccgtgattgtgaggcctccccagccatgtggaacttataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaatcccttccaggcatggttcaagttaaagctgaaactgtgtcttcgtttcagctcaagagaggttttgattgtgtcgtggcttttccttgtgtattggttgaggaactgtgccttggaggggcggggagtcttgagaatgggtcaactgatggagggggagtggaagacattggttgcccaagaaaatatgtcaacatctgtccatcactgcaactccggcctgattatcattttttctgcttctgtaagcaccaatgagacaatgccactgaaccacattctttgttgcctgcagtatttcccaccactgcgccacctctgatatgctaatgaggaagcccagggtttgtgtggctgaaaagcctttcaggcacaatcagtgggtcaacaatctcaactctgtacagcggctcagcctgctctgtgagaggctcctctttcggaggggtccttcctcacaccttttctgtgaagtgcgtctgtgcttaaggagggcattaacatctggctgttgtccctggagaaattgaccgaacatcaaagaataaatcataccttgaaactgccagtgggcatgactgtccggtcactggggggaagccctaaccaatggtctgaatctaaaaatgacccagtggcaccggtttgtagtaaaactttgaagatagaactccatgcaaattctgactccatagtgctggttcttgatgtaaatctcccaatgtaactgtcaaggtttaaaaatatcttacgtaggtgttcagaatcataaggtcatagaattataaaatgttaaccggcagaagtattttcatctttgtcatacgaaaaagagtaatttgctcataataagccttcaatatttatgtattggattgcaattaacaggaatcaaaggaatcttataaggatcatttatctagaataatctctattttctagaattacttaatgatcattgtctttattcagcctaagtaacattgaaatttttcttcattcaaataaattcatactcatgaaaaaaaaaaaaaaaaaaaaaaaaaaaaaaaaaaaaaaagagaaaacaaaaaaaaaacacaccaaaaggggcccaaaaacatatacgtgtaaccaccagagatagttcaggaggaacaaaacagggggcccccaaattaggagaagaaccggtagataattgaataagcgacaagcgcaaactagggtcacgccgtaactaaaacaaaaagcgtccagaaacagcgggaaaacacggggacaaaaaggggaagaactatgagcgaacgaaagcccactctcgtagaggggcgaacaatatggggaccacactatccaaa

SEQ ID NO: 396174 - DNA, 191 bp, Homo sapiens
ctgtatccaggaattataggagatacaaaatgccgaggaatgcactactcatgatcttttttgatccttttaacaatccagagacatgggctgtgtaaagccacagtgcaaaatacaattaggaaaacacagcaataagaccactgtagctttgaatggtgctgttcactaattattacctccccacccat

SEQ ID NO: 396175 - DNA, 346 bp, Homo sapiens
aaatcccctgccttcctacttctgtatacagaggagagaggaaagggatgggttaatgcttcaagctctagtctccagtctcagaaggaagccagtgtgcatgtgaggcactggaaatcaggggagtgagaaaactaatacttaaaggtcggaaacgtccagacataaccctttaaatatgccttgatctgaggtctctgccaaaggctgaatttcagaactccttctggccatgccatgcttggttaaagacagagtagaggtctgggtgagtgatcatctgtacttcaggcacctctgcccatcacagaaagcattaggagtcatagagctcccagaagcagga

SEQ ID NO: 396176 - DNA, 221 bp, Homo sapiens
cagtggaggacagaggaatggaacaggcactgaagagcttacacttgaggacagagaaatggaacaggcactgaagatcttacactggaggacagaggaatggaacacgcactgaagatcttacactggaggacagaggaatggaacaggcactgaagattgtacactgtaggacagagaaatggaacaggcaacccagtgctttaacaaacacataattt

SEQ ID NO: 396177 - DNA, 328 bp, Homo sapiens
cctccagccttcagtcaatgggaatcaaaacaatgatttcaagctattttattcagtctacaggcaggatcactccatggaggcctgctcctttccttccttttcccccatttctaaactgtgatccatgccccactctgaaagaaccattttgacagtctattgtgtagccttcttaggacattagccaccccaacgcaaacaccccggcaatgggagttttccagaggcttctccccggcccccgccctccctgcttcttcaaatcctagaggcaatgctgcagaaacctataagcagagaggatttctaatgcctgccacttgct

SEQ ID NO: 396178 - DNA, 347 bp, Homo sapiens
tggtactaccaatcttgaaaccttaagtaggttcagtagtacacattatgatacttctccagtctggttaaggatttagctttcttgggtctgctaagtccaacctcatgtagccatctgcttttcaacttccaaaatgttgtcatttctgctcctttctattctttttttccttctgggcttatgatttttgacaaatcctgttgctttcatttttgtgacaatccaggacaggatatagagatacacttgcatttggtctgccatttttaaatgaaatcctcattaaactaattttataaagaagaatttccatcgataaattgtatcatactttgtctcaatgc

SEQ ID NO: 396179 - DNA, 335 bp, Homo sapiens
caaacccacccagttaactgtgttttgaataacatattgtcttagcgcacagaataatatttttatgtgttataattgtatcctttttgcactatatttttcaactaacattaaaatactctccaatattttatgtagctttctggaaagaaaaaactccatgtgcatataaagattatacaatacaccattgtgtttctatgccacaagttacttaaccttgtcttataatttgatttgttatgtaagttatgttacataaaacaaaacttgatatttgatttgtttataagcttgactattataaatgttaacaatgtatatccttggaagta

SEQ ID NO: 396180 - DNA, 335 bp, Homo sapiens
cacatttcactttggaaacacagtagactctatcgaggccaggcttggtcacttccttcccatcagttctgtgttgagttgccatctctcaagatggtaaattgtttcctgctcgcttttatcctctctggttctcttacttttaggacccttttttcagtaagtaatttgtttattagccaggacccaagactaagttatttacatgtccattgtaaatgcaatgtaaatgagagttctgataaaatatttttgtattttgtaatatcaaaggaatttctatatcgtaggactcagtggggacttgcatgcacatccaccattgtctctgagta

SEQ ID NO: 396181 - DNA, 848 bp, Homo sapiens
gtgtatttaaccaatagatagtttttcagtcctcaccctcttccctccctccagtcttaggtagtttctggtgtctgttattcccttctttgtgtccatatgtcctctgtgtttagttacaagtgagaactaataaggttttctgtcctgtgttagttcacttaaaataatgcctgttttaaattttattaatttctgctctttattattttattccttcttgctttgggtttattgtgctctttttgttgagtcttgaggtagaagcttaaataatcaatttatttctctcttttttaatgtaaacagttagtgctataagttttcctcttagcactgcttttgctgtgccgctctattgtttccaaactgtttctttgctatttttacttccctgtgtcattagcaaaactaaactccaggaaagcagggaaaggtacttgctttttgcttttcccagtatatagcatagtgctgtgtatttgaaaataatttttgagctttaaaacttagatctcagcttggcagcttacatctgcttataaccaggaactggaagaaacacaatacaaatattccctaaaattagaagaaaactatagagggtttattgcaagtaaaattctacttaataaatttatttttgtttgttgaaaagcatatggaaaacactgtatgggttaagtctttagcagtgtgttttttgtgtttaagaatttatatagagaaacatttgagttttttaatggcaaaattaaagagcagaggcatgaatatttagtctgaaaccagttccaatctctcagcaaacattaacatcctcccagtccattcttagagcccgtgga

SEQ ID NO: 396182 - DNA, 591 bp, Homo sapiens
tgtgggcctctccatagggctgttcacaacatgtcagcttgcttcagagccatcgaggaagaaagtctgctagcaagaacattataattctttgtaatgtcatcatggaagtggcattccattgttttccatagtctgtggttagaaacaaatcactggtcctgcctgcacccaagggaaggagagtactcaagggcctgatcaccaaggaggcaggatcactggggaccatcctagagtctgtctgctacagtagtcatgaggacagatgaaaaggtccacttaacttggtagttaattggtagtatatagtatactccttgtgtatgtaatttgcccttcatctgttgtattttctgtgcatttttattgtgctctatgagtcttctgcaactcacaggtaatagatgtcacaggcagactaaaaatcaaccttgagaatgttttatatacagctgtaattctcaatgcactgtaactgccccagaatcataccatttcttctcctctaatatcccttctgcatgtttggcaatatctctaaaaactggttttggaacatgatgaacatatttggtaccaaaaaagctg

SEQ ID NO: 396183 - DNA, 352 bp, Homo sapiens
caaatgtctggtgggttgagtgggcattctgatatcacagctcctcctctggctgattaatggggaggtacaacagacatccttgcagtctaaggtgacactttaaaaataaaatctcttctatcaggtaagaaaaatacatatatatgattcaactgctgaatctacaagatccgatctcagatggaaaggactgtaagagacatcccttcgattgaagatacaaagagattaaaaggccagaaaaagatatagtatgcaaaaataaaccataaaaaaagtgaagtggctatactgacatcagacaaaatagactttaaaacaaaaacatttatagagacaaagggaaaca

SEQ ID NO: 396184 - DNA, 411 bp, Homo sapiens
cctttcttgccctgaagggagttactgttgtttttacagataaggaaactgatgcttggaaaagcatagggggctctatgccttatctttttgaggatgtcttcatgggttcactcatccattcaagaaatgtttattgagcacctactgtgtgttaggcactgttccaggtaccgaggatttagaaagctaagacataaccccaagactttggtgcctagttgaggagaaaggcaagtcaaaaacctagagtgaaggctgggcatggtggctcactcctgtaatcccagcactttgggaggccaaggtgggcggatcacttgaggtcaggagttcgagaccaccctgaccaacatggtgaaatcccgtcctaccaaaaaatacaaaaactagccaggcatggtggcgcac

SEQ ID NO: 396185 - DNA, 405 bp, Homo sapiens
ctttttgtaaagggcagtgacctatgtggtgggcttgtccactgcccgagtctgcggctcccacaggtcactgcccggctcatatccttcccctttggaattggcttggagcagggtctctcctccccggcccctatgtgcccaccatctctggggtcagtggcccactcatgactctcagggcggggagggggcttggagttcagtaacagcaccctgggtcattcttgcacctgtcaccctgagagccactgaccagttttctgtgcctagaatcgctgcttgcggcctttctcaggggctcaatggattgtaattgatgtttgtattttgcacttgcccggaggtgtttcacgggaagtgagcattttttaaaacaaaaatagaatttagaaaaaaaaaagg

SEQ ID NO: 396186 - DNA, 642 bp, Homo sapiens
tccaagcttgtattgttgtgagaatgtggtctacatcacagacataacagctaacatttattgagtgttatgttctgggtactatgctaaaggttttttacctattatctcacattattatgtattatcctatgtattatgtattatgtattatcctaacattcccattttacagaaacagaggtacctaagtaacctgcttaatgtgacagacctagtaagagggagctgggaagttgaacccagcaatctgaaaaagcaggatgtgatggggctaagagaaagccatgtgcctagccgggcgtggtgactcacacttgtaatcccagcactttgggagggccgatcacttgaagcctggagtccgagttcagcctggccaacatggtgaaaccccgtgtccactaaaaatacaaaaattagccaggcgtgcacacacctgtaatcccagctacttgggacgctgaggcacaagaattgcttgaactggggaggcggaggttgcggtgagccaagatcatgccactgcactcgagcctgggcaacagagtgagaacctgtctcaaatacataaaaatacattgtgtcatatcgatttgtgaaaagttcctactttaagagagcttacatgtaacagaaaac

SEQ ID NO: 396187 - DNA, 490 bp, Homo sapiens
aattgatgttcctcaaagagaccagaacaagtggaatgaattctaccaccaagatttcacataatttttagattaaaagggctatatgcccagaatataccagctgatgccaagaataatcttaaaatattatgtattttaaggtaagaaaaagaattggcttaataaggtaaaaaaaaaaaccagaaagtttactgaaaaggagaaaaatctacctgacctcaggcttgctcttgcatactcttgaattcaggagatgttgaaattaatatctactgttgtgagggttaccgcctaagcatgtttttaccagaccaaggcagtgtttacataagaagaaagtagaaatcatcctcaaagtggaaagaatataaaatatttccacctaatagctgcttgaaaaaaaaaaaagacctgaaagattccttagttggaaataagcataaagaaattaggtgagcctggacaacatggtgaaaccctttctcta

SEQ ID NO: 396188 - DNA, 283 bp, Homo sapiens
ctgacacatcagagaacaagtaatcctaagaaaaatttattttctaaaataaacacattacacatttattactttacgtaggaaaagagtatttgtaaaagaaagaaaaactcaaaggttgataatgaacaaaatgacaccagctggtatttttaccatcaccctagaaaaacaatttctttccccccgcgaacagaacaaagcaaatcacaaaaataagtctattaaaattcctaagtttacaaaaataaggtccactggatcaagtgtatacccactggat

SEQ ID NO: 396189 - DNA, 265 bp, Homo sapiens
agatttgtaactctagtccggaactttcttttgagctttagacttatacctgtctacttcataccccattttgataagccataggcatctcatacgcgttccacattgaactgctgattttcttcacttttcttattagccttttctgttttaatgaatggtacctttctctatccagttcttcatgccaaatttggtattctttggcactgtcctctttctcaacctccccacatcaaatttattacaaagtccgttgattttt

SEQ ID NO: 396190 - DNA, 171 bp, Homo sapiens
ctgcaaagaggcatcaaggagggtggctcaaaggagcctgcagaggaggaggaagaggaaaatgaggctggaaatgtgaagggagaaagaccacagtctcaacagctgtgaagaccaaggaattagcctagaacagaagaagaggtgtctttcctgtgaagaagaaaggat

SEQ ID NO: 396191 - DNA, 236 bp, Homo sapiens
ccaaagatatggcaaggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaa

SEQ ID NO: 396192 - DNA, 298 bp, Homo sapiens
aacaacaacaacaacaaagaagcaacaaaagggaatttgtacttttagccatagagccttcaagtttgttataaccactggggagaaaacccttcatttctacttcattcctaaaatgggttaatcactgattatacatagaaaatttactcaaatgaaaacaaaccaccaccagattttacctttaaatatattttcttggtattattttaggttctggtagcaaaaggtgcagagataaggacatgggttaatgacatgggttatttattgcactctgcatacagcagcaagaatg

SEQ ID NO: 396193 - DNA, 566 bp, Homo sapiens
ttatcctagaaccacacagagcacaagatcaagatagaaaatcatttgcatttctttatactgacagcaaacatttggaaacaagttaaaagcacaataccattggcaattacaccaaagaaagtgaaatactatggtgcaaatctgacagaagatgtaaaggatctcccttctgaaaattacaggggccttttcttaactagtgaaagttcctttgggctgttctcatgtccatctggaatttttcccatttcctgcctgaattcctggattctcggatgattcttgtcttcctgtcaaaatcaagagatgtcagatgaggaccatgataaagccagttgtaagttttctgatgtctacaccaagaaactcacacttagtgggatgtctgctctcaggtagaacctaaccaaccagttaggagataccaagagcatagtctttaatgcctgggaggacgggagcaagcagagatcttggttaataaaagcgttcaaaaatctatttgtgaaatcaatgtttattcacttaattagaaataaatatgtaaataaatggaattctgt

SEQ ID NO: 396194 - DNA, 404 bp, Homo sapiens
tcaaattctctagcctcaagatcctttatcaatggttcttaatcctgactgcacatgaaaacacctgggaagcattttaaaaatacatcagtttcacagtctgaagtggggctcagtctggctatgttttaagctcccatgtgattctcatgtgcagccagaaatgacccaaatgatccgacccctctacctgtctaatgtcactcagtattcattctctttgctcattaacctgaattcaagctagttcccatcttcggacttgctcctttctccacctggagtgctctttcccacatttccacatggctccttctcatcctttagaactgagctcaaatgccacgtcctctgcggcgtcttccctgaacctactctcctcacttgaacctgttgttttgttt

SEQ ID NO: 396195 - DNA, 198 bp, Homo sapiens
caacaaattacacaacttatattaaaaaaaaaggaaattcttcaaaagacaaattaccagaacagactcaacaagaaatagaaactctgaatagatccctaacaaataagaaaactgaactacttattaaaaatcttcacactaagaaagcctaggcacagacgatctcaccaatgatttttatgaaatatataagaa

SEQ ID NO: 396196 - DNA, 336 bp, Homo sapiens
aaagagcttctcctctgaaaagccatgatctggatggggaactttgggttggaaacatttgaactgtcacctggatcctttgtgaagtctcagaaatgcaagtgtttctaagcgctagagagaccaggggatttaggggaaacctataggtaaagaagaaaagctgcaagtgaaaagccacaccttgctgtggctgcttcagctctgcctcagtgatcccagcacctgcagacacagtttctttctttctctttttagagatggggtcttgctctgttgcccaggagttcaaggccaccctgatcaacatagtgagccctcatctaaaaaaaaaaa

SEQ ID NO: 396197 - DNA, 348 bp, Homo sapiens
ctgtgtctcctgcccggtgttcacccctttatcataaagctacagaaataaggaagcagcaggagaggggcgagagacaaacctagccctgcccttccctccctggtttccactcctgtttttctgcaggctgcagggctctggacaggtgaggacaccctgctgggagaactttcccttccccatcgtagcttggttttcagggttgccttctctggctggtgagaagccaggcatttaattgaatagaaccatacaaggtggttgctatctttgcatccctgagagctgaggacacctgctgtccatcctgccatggagatgaggccactgaatgttcccaggcag

SEQ ID NO: 396198 - DNA, 438 bp, Homo sapiens
agaaggagacccctacattatttacattcataaggtttctaccatgaattttggtttgaaaaacaaattgactttacacatgaggatttcccatatttgttacaattcagagtatcactcttgtgtggaggatgacttcatacagatttcccacatgtattgccttcatatggtttctcccctgtgtgagttctctgatgattgatgaggtttgacttcacataaaacattttcctgcattcattacactcaaaagggttcttcctggtatggggtctctgatgcacagtgaggtgtgatttcatacagaaataagtaacagatttgctacatttatagggcttctcttctatgtgagttctctggtgaatggtcaagggtgacttataacagaaggatttcccacatttattacattcatggggtatctcccctggg

SEQ ID NO: 396199 - DNA, 304 bp, Homo sapiens
gttttcccttctcttcacctataaggacttgtcattagatttagggcctgccccagtccgggatgatctcatgttgattctaaattacatcttcagacacccctttttttttccatttaaggtcacatttacacgttccaaatggacatatcttttaggggctactattgaaacctgttataactctttttcttccccctgtcctggagaatgctagccataacttttctgctcatgctcaggtaggattcagccactttaagttaccaacaaggtctcaatttagtaactagaatatctaatt

SEQ ID NO: 396200 - DNA, 460 bp, Homo sapiens
cttcaaaacgtgtcttttttcaaactaaattttattgtgtgtatttaaggtagacaacatgatttttaagagccaaagtaattttgatgtattgtaagtttgggaactactggtctaatacccctgacttaatatcacattcctgataaatattactaaatgtaagtcacatcatgtctgattcatcatacttatattttgcaccttcttaccttcttctgttattaatttgttgctttttcaacttatattttagattgagggtacatatgcaggtttgttacatggtatactgcatgatgctgaggtttgcggtatgattgaacctgtcacccaggtagtgagcatagcacacaacaggtagcttttcaactcttgcccccctctctccctcctccaaaatctgtcttaagtgctatggtatatacaagaaggaagacacaaaaccacgtgggctttt

SEQ ID NO: 396201 - DNA, 142 bp, Homo sapiens
gtgaggtcaggggtggtattgacccctcttggtttccatttatttgtgttagtgtttggcatatacaaagggctcaatgctgtgtctctctcttccagaggtgtcctcctgtcctcttttcaaggtttttgattaaaaattt

SEQ ID NO: 396202 - DNA, 164 bp, Homo sapiens
ggcgcgtgcgtcaagaagcttagtatacctagtacatgtaactgatagtatccaccaagaaaaaatctatgagaacgcacaaaagaaaatcaaagcacatcactataataaaaatcaacaacacataaaggaagacaggaagaaaggaaagaagggacaaaaaa

SEQ ID NO: 396203 - DNA, 657 bp, Homo sapiens
gttttatttttttcttcatatttttctgcagtatttattggtttatttttgctctatacatagactccagttgaaaaaagtatttaaaaatatatactataattttctcagactgatagaacatctcaacttgaagattaagcacagaatttggggatgttcatccagatctgtatatttactttgcttttgttagggagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctatgtttgcttaacaaatatacgccatatagcttaacgagtatagctaaggagacctacctgaggattcttctggtttagaaaagaattatttctgatagggagacaatcatgttgggtgtattttaaaatgcttgatataatcttcaaaatttattatgaa

SEQ ID NO: 396204 - DNA, 226 bp, Homo sapiens
tggaagtgtctcagctgtgtgacaggaagacaagaacacaccaccagaaggaataccatcttgaccgttcataaaacttccagtggcagcatggtggctcacacctgtaatcccagcacttcatggggctgaggtgcatcgcttgagcccaggagtttgagaccagcatgggcaacatggggaaatcacatgcctactaaaattttaaaaaattaagaccaggcgc

SEQ ID NO: 396205 - DNA, 262 bp, Homo sapiens
cagcagactcagcacagatgagaggtgagcgaaatctccaggatgatggtaaatgggacagccatgtatcagagctggagaatagacagattgaaccagaatgtgccagaaaggtccagaggaaacttcttcaagaggatgaaaggatagaatgcttattgtgaatgcacttcttgcgaggtgatttagataagtggaagagaacttggattgaattggtcataaagacatagataaccaactgagctgctgctgctgcttt

SEQ ID NO: 396206 - DNA, 496 bp, Homo sapiens
tcagaggagaggtaatacaggcctgaatttggaggatagagtagggataggaactggagaggcaatagaggaagtggttaagaatactgactctggaatcagacaggtctttatctgagtcccagcttagacatttactgactgagttacattgggaagattatttaatatccctgagcctcagatttctcattcatgaagtaaggataataacatttagcttagagagtggttatatggattaaatgagataatgtaagtaagtgtttagcatagtagcggaaacatagtaaaaacaggaaattgttgggctgggcgtggtggttcacgcctgtaatcccagcactttgggaggccaaggcaggcggatcacgaggttaggagactgagatcatcctggctaacacagtgaaacccctcctctactaaaaatacaaaaaaattagccaggcgtggtggcgggcgcctgtagtcccagctactcgggagactgagg

SEQ ID NO: 396207 - DNA, 427 bp, Homo sapiens
tgctgtcctccagctgggatttgaggaaagtcatttcttccagcttccctaaaatccttctcagagagccaaggacctctcctttcgtgggtctgaaacatctcagggttccatgagtggcaactggcttctctctctaagagctctttgtctggcctgacacggaataaaagtacctagcatcaccaattctcccacctctcttcctccctctcttcctctctactttcttccttctcaccttccctccctctctccctcacccactgttcctttcttcctccttactttttgaaaaaaatgtgctttccgcccccacccccatggccatatttacattcctctgttattaaatgttagggaatttttacattgcagaaatttaccttaaacccctcctctttcctgattccaggccatccccacc

SEQ ID NO: 396208 - DNA, 434 bp, Homo sapiens
ggataaagagaacagaagccagatggctggcagcaacagttgggtgacgaggccatgatggaacattagaccttggatcaaggctcaaaaattcagacaccagcgagcccaggcaggtaatggaagcaactgtagctgactggacctaagaagcagtggcacgggtgccaggcaccccagctgacctgccttggtgctcagagcagcagggctggccatggtcagggagtctggggaggtcatgctctgtccacagggttctagccagcttctgccaaattgtctgttttttctcaagagaagctgggaaggccagttgtggtgtctcatacctgcaatcatagcactttgggaggctgaggcaggaagatcacatgagcccaggagttcaagaccaggctgagaagcatagtaagagcctttcccttaaaaaa

SEQ ID NO: 396209 - DNA, 366 bp, Homo sapiens
ggggacttgaaagaagatgagacaggcttaaaagcctgtgcctgggagatggatgctattgacaagatcaatagagaattcaggaagaagaccatcagatgtgtgtgtgttgttaggattgagttttctttgttggttggttcagaaagaggagataaaggtgtgtggagtttggggtatgtgagatttgttgtgccagtgagactgcttgtgtagatgacacagcactaggtactgtgcttaggattcatgcattgggaggttatagttgaagccctaggcatggatgagactgtcaaggaaaatcgtccttataggaaagcggagaggttaaccaagatgaaaccttgaggaacacttactctt

SEQ ID NO: 396210 - DNA, 355 bp, Homo sapiens
cagtgtgattcagagtaaccagatcatcccaggaaataaaggtaatgagccctgccacagattagtaagaaagaattatctgaagaagtaggttttaaagaatagagtgggccatgatggtgggggaatagttggaagaaatgcctggggtttctttttcagcttagaagttacagtcataagagtcctctttgagtttatggtgagacgtgattgtgccactgcattctagcttgggcaacagagcgagaccgtgtctgtaataaaaaataaaaagcctttatcatcccaagtcatttagatttgcctttggtgggtgggttttctttttcagtactttcccattttgaagccc

SEQ ID NO: 396211 - DNA, 151 bp, Homo sapiens
gctggacacggaagggaacatactcctgggacctgggattaggatggggacatcttgggcggttgctgtcatgctgccttccacacactggccatcaagctctgcggcccccaggcagatgctgtgctgcagtcagagggcagagaagctg

SEQ ID NO: 396212 - DNA, 372 bp, Homo sapiens
gatgattggcagacaactaattgacttagacaaccaatcaaatctatccagtaacttgttaacagtgttattgttccattaatatgctctttatgttccattttatatttgtcaaagctatttcacttttgcggggggtgcagaattctcaaaatgacatgagccaatcagggaagataaaaccccatttaatagatgagaaacctgagtcccagaggtttaaagtgaaacctaaatcagagtccaaaatcaaaccgtatatcagcgtgcctcaggaactgcatgcagggattatgacaccaagtccaggatcctttttagatgccagttgcacagttttaataaagcttttcaaaagccctgtttggctaa

SEQ ID NO: 396213 - DNA, 440 bp, Homo sapiens
ctgtccggtatcaacaatctttaaactataaatttaacgctgctgaagaaaaggggaaataacattctcattgtactgtcctggtatcacacttacaaaatgaacaaataatcagactatttccacttatctagcactctgcatctgaggatctcaaatggcctgacaaacgttaattaactaagctgcacaacactcctgtgagggtggcaggcagcatgatcctctccaagcgacagatgaacggagatcctgggaggcccttcctttgaaagtcagtggctcaacttggaactcaacttccagaacttggaactcaactccccaggcccatggttgagcatctccgctgaagccaagtagcacaaaatgtagatgttacaactgacagacttttctaaagaaatttaaactggaaaccaagatcaatctcaaggaga

SEQ ID NO: 396214 - DNA, 465 bp, Homo sapiens
tgtctgtatgtgcatgcatgcttgtgtctgtgtgtgcatgcgtgtatgtaggtgggtgtgggtgtacatgtctgtctttcctgggctcccagtcttttggtcaggtgggctttggtcctgcagggctgagtgtgacacctttccctgtgggccctgcctcacctttacaagtgccgcacctaagcaggagcttgatcaaatgtgccattgatagaatgcacttttggatcctctttgctgccctagagtcttcttttctccttgccatttgggactagcactggaacatctgctcagtatgtacgtgtgtgtgtgtgttcagccaggaggcgggctgactgggccaaggaagattgttcaggagagcttgcagggaggagaaaacaatttccacgtcaaagtaccttgtttaaagattagagctgtatcagcccagaagctatctcccaaccctccccaccccac

SEQ ID NO: 396215 - DNA, 414 bp, Homo sapiens
actcacacttccagatttcaaaacttactacaaagctacagtaatcaaaacagcgtggcactggcataaagacagacatatagaccaatggaatacaatagaggcccggaaataaatcatcacatgtatgctgaaatgatcttcaacaagcgttccaaacattcaatggggaaaggatagtcttttcaacaaatggtgctgggaaagctgggcttccacatgcaagagaatgacactggatcttttcaccacatacaaaaattacctccaaatggacctaaatgtgaaatggaaaacttaaaactcctggaagaaaacatggggtagaagcttctcactgttggatttgaccaggcatggtgactcacatctataatcttagtactctgggaggccgaggcgggcagatcactt

SEQ ID NO: 396216 - DNA, 454 bp, Homo sapiens
gtactaaccatttggccatcactgcccaactaatgaaagaagtgaacactgaagaagatgctacatcaaaaggatcaaatgttttcaaaaaagaaaagaggactgcaaagttgaaggctgatttttaataacaggtatctcaaatagagacaaattaaccagacagaagaaacccaaaagtggtaacagttctaaaaatctaaaagtttttagagctgcagtttaaaaaccaagaggaagtcctgaaacaagcaagcatctgctttgttcaaaggcaagaagtatatgaactcagtaataataatgactgtgaaaaaccagttgggaggtcgagcgtggtgacttacacctgtaatcctagcactttgggaggctgaggcaggtggatcgcctgaggtcaggagttcaagaccagcctgtccaacatggtgaaaccccatctctattaaaaata

SEQ ID NO: 396217 - DNA, 453 bp, Homo sapiens
cccgtcatacgctgaactatgcgaaatttaaattggaatgtattctttaaacattaaatgtgaccatcctgaaagaaattctcctttcttgataggttcaaggaatagtcagaatgctgccaagctccttgaaaccatgtagtgagaaatgtagagagaattaagggtgaggggagatttttttttgctttgaaaatgtagtcatgcttattaaagaaaatttgagaagtttagaaaagtataaagatgacaaaaattgctcatattcctgctacctcagtgctaaccatgtaaacattttagtttaatgttaaaaggtcactcagggttattgtgagatttgatgagatcatggctacaaggaacctttaactgtatgaatgaaaaatctaatgaaactgcaaagtcactcctatttactaaaaccagtgtagtggctgtttctgcctcttt

SEQ ID NO: 396218 - DNA, 302 bp, Homo sapiens
ccctctccgatcagcatctctggtctgctgcactgtaatcctatagggacagctctggcttttattactgacaagcagtgcactgtgcagccataggcaccataataggaaacaccgtggcctgtcataaacaggtctggagagtagaaagtacaggcctgatgggagcaagatgcgcccatcagatacacttaagtcacagcacaagtattatttgtgtaaatattattttgttgaataatttttaatgtagtaaacaatactggtaactgaacatttttcaattaatagaagtagaggag

SEQ ID NO: 396219 - DNA, 490 bp, Homo sapiens
gccattttgccgtacggcactggctacgcccggactccggtgcgcagccagtggagctcttttcacccggtgcttctacgactccgccaatcagaaacttcctgcctggggcccaaccgccggagagtagcgcgtagggaggaccgagcctcgtttccaaggaggggcaggggaaccgaacagggtggattaggaattgggctttccaaagctgtgcagagtttcagggaagggcagaagtctcttaaaagggaagtaaaaccttttctttcagttgggctattggcaagctatctggccctgctttcctgtcccccaggttcccatttccacggcttattcggctgacccagccccttcccctgcaagggcggcgcgctccttgccgctgtccagcagctgtttctactgccaggtgctgcgtcccgcgatcgttataacacatgcgtacaaatgagcacaacgcgccataaaagtgttattgttatta

SEQ ID NO: 396220 - DNA, 130 bp, Homo sapiens
gacgtgttgtgctgggttgccatccagaggaaattttgagtgggtgctctctagtcggaacgaagtagatccccaaaccactggtgggcagggccagacagacccagtcgcactgaaaatgtatgtgttg

SEQ ID NO: 396221 - DNA, 591 bp, Homo sapiens
agtaatgaagaggaagaaggcagtgtttaccctcaaggtgttgcttgtctgaccaagtaagacagtgccgtgtaatgagtgcaacaatacgggtattacaaggtattcaggaggcagagagaagcaaaggatgaattctttcttgcatagagggggataatgagggcttcttggaggaagtgatgctggtgctgatacctgaaggacaagcaggagcccacccacaagacaatgctgggaagcacgttctggaccaagatgtgtaaaactgtgttaagtgctgggagaaaccttaaatattcctgtattatcagagtccaggctgtgcaaaggagagtgtctaagataacaactagtaccagatctggaaaggtccaagtgcactgctcaaatatatttagaatttattgtgtacattatgatgtcttaaacttctgtcattcatgtagccccttagtgattttcttcatatcagctacctgagttttttgcttcattttttttagaagttcaactttttaacagtgcaggaaatagaaaacatggatcctttgttaaagaaataagaacaacaaaacccaaatgatgtta

SEQ ID NO: 396222 - DNA, 293 bp, Homo sapiens
cttctctgtaaatgggggaaggagagtggtggtaaaaagaataaatgattaagtactctataattgatagcaattactagagtagcatcattggattttgtatgagaggatgaggacactgttaatagctcctcttctcttttcagactgtcagcatctccctactgtatacatgcttgattaatgctattaaatatggtaggttcactaaaagaatgcctttgttggtgcagttaaaatggtaatttgcatcactgtgagtagatcaaagtgagctaaaaagttgcaagttt

SEQ ID NO: 396223 - DNA, 188 bp, Homo sapiens
atgacaactagtccttttgaaaagttcagatacatcactgggagggcataggctgaacacctagtacaattgaatttacagctgtacttgctataaatcagctcagcagattgaaaactgctcagcctttccagggcaactgagtgtgaaagcaaagatctatattatctataaactataaactctca

SEQ ID NO: 396224 - DNA, 193 bp, Homo sapiens
acacatggctggataccagtgaaaaatgtggcttgatctttgtaagtggtttgtgttatacctggtgttcccccctcgcccaaatcatatataagtatatactcacaaaccaagacttctccttctctctctcattgtcttaaaaaatatcatttctggtttggcgcagtagctcacacctgtaatcccaata

SEQ ID NO: 396225 - DNA, 479 bp, Homo sapiens
caccaggcaatgtgaggtatatttgtaaatttcatgagtatttttgtgaactcacaaatgaaaacagtcctaattttaagactaagtactccatcatttactttcctaaaactgtatacatgcaaaatggcaaaaacatcttaatttgtacattagttcagatgttatagctgagttttttattgaaacaaaaatggaatcatatgaaatattttaacttttttcacttagtatataatgttgtcatcagaatttctgtaatttaatttttaattagtattttatgaacagatatatcttaaaactgcccgatagacacagttttgttatcaaaaacacatctaaatctttacacgcttccatgactcaggtgaaggtcacctttttaactgaagggtggaagtactgttctcttttcctctgtgaacacattgccacatcgattaaagtgtctacccaacatttatctctctctcctt

SEQ ID NO: 396226 - DNA, 454 bp, Homo sapiens
  misc_feature (421)..(421): n is a, c, g, or t
ccatgacaacaacagcatggaaggcaggaagggagtgaatggagttgattcttgcattatctgggaagtggtacattttctgatctaaggtagattgataactggatgtatgttactaaatgaacaaaaaagaaagtatgactaataatgtaataaaaaggagaaaatgtaatgataaaataattacttgattaataaaatagaatgcaagacaggagaaaaaaggaacaaaaaagagatgagataaatagaaaacaatgtggtaatctggtttgatatatggaagaagaaaggacattatagtggaaaaactgcagaagtccaaatcaagcctgaagtttagtatagtagtattgagtgtttagtacctatgtgggtttctaagttttaacacatgtactgtgataatgtaaaatgttanattaactgaaagaggagggtgttcgtaatccga

SEQ ID NO: 396227 - DNA, 586 bp, Homo sapiens
atcagcaataggtctacaggtgatgtggatattgaggttatttaactaactataattaatagatttaaaaagtagattctaaaaatagagactatcactagaaaattagaatctataaaagcatagtcaaatggaaattctagagctgagaggattaagaagtaaaaaaatgagtttaactgcagattagagaacagaatagagaattagtaagctgaaagtagataagagaaaatgtaatgataaaataattacttgattaataaaatagaatgcaagacaggagaaaaaaggaacaaaaaagagatgagataaatagaaaacaatgtggtaatctggtttgatatatggaagaagaaaggacattatagtggaaaaactgcagaagtccaaatcaagcctgaagtttagtatagtagtattgagtgtttagtacctatgtgggtttctaagttttaacacatgtactgtgataatgtaaaatgttaaaattaactgaaagtgactgagggatatataggaatgccttgtactatctttacaatttttccgtacatctaaaattatttcttccaaaaagtttatg

SEQ ID NO: 396228 - DNA, 441 bp, Homo sapiens
tggtttgggcagataacttctaaattacgttgtaaaaacttaaggtaaaaacccttttctcctttaaaatatagattgattatatgtaaatgtgattttatgtactaatcagtcaccaaatatactagacagagaatgaatggagtcactttagcttttcaaaggagtttttatagccagttgcatgcgttggagctgtcgctattgctctgtgcctagatggatactctgcccagaactgcgaattgtagagtaccacgtgtttgctatcttgaggtttaactagctgggtgttaagttcatgctctgcgccatggcagtctgctcagtgagactgccatgcagtgggactcagcatagcccctttcctttaggagcccagctgctaataggaacaccgagaagtcttttgatatttcccctgcagtgcgataaggattt

SEQ ID NO: 396229 - DNA, 261 bp, Homo sapiens
ttaacttagcttctctaacacctaaaaaaattcttctttgtattttcagctaatagaagacagttcttcttcatcttgacacctagagccctctatgtgattcacagaggacttaaaatacttcttactctgttgaagtgtttaattgtacagaatatatgtactctacagtatatgtgaatcagcactcaaagcagagaagtgataacatcccaagcttcccccatacttctactgacatgccctcagtcttgaagaaca

SEQ ID NO: 396230 - DNA, 435 bp, Homo sapiens
gaagtacttctagctagtaattgaaactcataaggtggctggttgctgctttctggccaccaggctgccattcacagcagagccactggagccactgcagttcacacttgaaagttctggggactgaaactgacctcatgtttttctttctttgttcaatccagctatatcaactgtttgaactctgtgttatggaggaggcaaatttaatttctggagcttactgctagctaagcaaaaatgtgcagcttctcattcttgtaacggcaaatagttaaaatttcatctgtgtcaagtttcttttctgggagtttttgtaagtaaaaagagtaggattagtgagtaaaatcacgaatgaaaaatatttaaatcttattaagtaatttaggatactttttcatatctttagaaaaatatatatatatatatgaaata

SEQ ID NO: 396231 - DNA, 415 bp, Homo sapiens
ccatctctagaaaacattgaaaaattagacgggcatggtgtgcctgtggtcccagctactcgggaggctgagccaggaggatcccttgagcccaggagttcaaaggtgcagtgagctatgtatgatcaaatcactgcactatagcgagaccccatctctaccaaataaataaataagataaattgtgaaaatataagaataggattttaaaatcagttctttccttctagttttaaaatgaaacccagtaattagttttaaatagtaatctctttcaatgttgagtttcagtgtgaagctaacctatatgttacaggaaagaatcagatgtaattatatgttaaattccaattattggctatgataaaaaatttttgattttacttttcattattagacttttggcttggcagtg

SEQ ID NO: 396232 - DNA, 694 bp, Homo sapiens
catggtggctcatgcctgtaatcccagcactttgggaggcaggcggatcacctgaggtagggagtttaagaccagcctgaccaacatggagaaaccccgtctctactaaaaatacaaaattagctgggcatggtgctatatgcctgtaatcccagctactcaggaggctggggcacgaaaatcgcttgaaccccgggaggcggaggttggagtgagctgagatcacaccactgcactccagcctgggaaacaagagcaaaactccgtctcaaaaaaaaacacaaagtgacatattcacagcataaatttttgactcatggcactgacaaagaaagaggcagttactaagtacaacattaaagaatcgttctccatcttaagccaaggttagaaaacgtttttctgtaaagggccagatagtaattcttccaaggccaaaggtctctgttgcaactactcaactgtgtagttgtgaagtgaaagcagccataacctggccgggcgcggtggctcacgcctgtaatcccagcactttgggaggccaaggcgggtggatcatgaggtcaggagatcgagaccatcctggctagcacagtgaaaccccatctctactttagaaaaaaaaaaattggctgggtgtggtagcgggtgcctgtagttccagctactcagaggctgaggcaggagaatggcg

SEQ ID NO: 396233 - DNA, 541 bp, Homo sapiens
caggtgctcagctctgcagggtgggggcaattgaaggcccaagctgcccgagaagagcggagttgccccatggggaccacgctggcctgtagcatgtgcaccaaagccagccccaggcagggcccccacagggcttctgcggagccatcctgaggctttgacatctatgagtgggcggccagcaaaggcgcaggccccagcacagaggagcagaggcggccggaacaccctgtcccttgataccagccccaagcagagccacctcaggataaggtgtttggagccgtcctgcagctctgagatccacgaggtggcggtgggagtagcaccagactccactgatttggagtctgccctgtctgattcaggagacatgactagcagcacatcggcaccagaagacgccagaagagacagggtttcactgtgttgcccaggctggtctcaaacccctggcctcaagtgattcactcacgttggcctcccgctttgttgggatgacaggcaagaaccaccacacctggccttgggagctgctcct

SEQ ID NO: 396234 - DNA, 162 bp, Homo sapiens
tggagggcaatctgttttattcaatctaccaattctaatgttaatcttgtccagatatcccctcacagacacacccagaataatgtttggacaaatgtctgggtacctcgtggcccagtcaagttgacacataaaaaaaccatcacatatgcattcatttct

SEQ ID NO: 396235 - DNA, 646 bp, Homo sapiens
  misc_feature (52)..(52): n is a, c, g, or t
tctcgaggatcccatgcgcgagctccatcaaactgttgcacaaagacacttntagactgggtacagtggcctgtcatcccagcactctgggaggctgggactataggtgcacaccaccacacccggctaattttttatctttttagtagaaacagggtttcaccacattggccagactggtcttgagctcctgacctcgtgatctgcctgcctcagcctcctgagtagctgggattacaggcacgcgccaccacgcctggctaatttttgtagttttagtagagatggggtttcaccatgttggccaggctggtttcgaactcctgacctcaagtgatctgcccgccttggcctcccaaaagataaggagttcaagacctagtattacaggcgtgagccactgcgcccagccagagcctcctatcctggctcttctcactgggctgcaaggctagggccgtcacaacagaaccagtaatacaaaactcatgtttgcagaggaaatgcttcaaaatgttaatgaaacgtttcccttctgaatagaaggcagaacaggccagatggtttttattaacgaggcctgaatttaggaccttctctacttaacggcttctgtcttgatggaagcgtcgcgcatggggatcat

SEQ ID NO: 396236 - DNA, 284 bp, Homo sapiens
gttgagtctgcagtgagccgtgatcatgccactgcactccagcctgggcaacagagcaagaccctgtctcaaaaaataataataataataataattattattataacttattacatagaagtaaaatataaactagatgtcatcaaaaatttgagaattatctttttctaccttgaatttttttggctagaaagaagtatttggttctgcaaagccgtaagaatgatacaatgggttttagggactcagcggaaagggtcagggagagtaggggggtggttagg

SEQ ID NO: 396237 - DNA, 453 bp, Homo sapiens
tggagccaaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggtgaagatctgctgcagaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaattttgtcat

SEQ ID NO: 396238 - DNA, 339 bp, Homo sapiens
aggccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaattttgtcat

SEQ ID NO: 396239 - DNA, 347 bp, Homo sapiens
cttttaagtctttttttgtttccccctcccttgcatatatagctgtacttgtttcaaagcactatggaatttgcaaggggtctgctggagaccgtatttgacttgcggattgcaggccaagtggatcagtggttattggtaggaagggggacggtagggattggtgggaccttttagcagcccttctggtcaccacacagagtggttacccactgggccaatgagtagagccatctctgccctcaaattttctttctgattcagcctccaactctgaagtggcaggagaggtggcctgttcaggagagcaaaacacaactgaggaggcgggctttaggtgaagatct

SEQ ID NO: 396240 - DNA, 412 bp, Homo sapiens
cctcaacctccggggctcaagcaaacctcctgctgcaacctcccaagtagctgggtctacaggcatgcaccaacacatctggctaatttctaatttttttgctggtatataaaaatactaattgattatcttattttgtatctagtaatcctgatggagcagttgattaaaattgtatatcattgcacgtcattctctttttaaaaatccaagcctagtgaaacccatgtttctaaaaaaaaaaaaaaaaaaaattagccgggaatggtggtgcgtgcctgtaatctgagctactcaggaggctgaggcaggagaatctcttgaacccaggaggcagaggttgcagtgagctgagactgtgccactgcactccactccagcctgggtgccagaccaagactctgtctcagaa

SEQ ID NO: 396241 - DNA, 591 bp, Homo sapiens
cgggcgggaggcggggcctggaagaaggggcggggcctggaggaagggcagggccgcgggctcggcactgggaacaaaggggaccggcggaaggaacgcccccagtcgatcccggagcgatgcccgggtggaccaggggcttagctccggagagaggtttcccactggattcgtgcacagcccctcccctgcggcgccggctctgcgagccccagtttcctcatctggcagctggaaacaaatccttccggaagtgtccaggacccacgaaagtgttttaatttcttttagttttggtaaaaagtactaaacgcgaccgggcgtgggggctcacgcctgtaatcccagcactttgggagaccgaggctgacggatcacttgaggtcaggagttcgagaccagcctggtcaacatggtaaaaccccttctctactaataacacaaaaattagctgggcatggtggcgggcgcctgtagtctcagctactcaagaggctgagtcacgagaaccgcttgaacccaggaggtggaggttgcagtgagccaagatcacaccaccgcactccagcctaggcaacagagtgaaactgt

SEQ ID NO: 396242 - DNA, 340 bp, Homo sapiens
cagaacattaatggtggctctgtctagatagaggaattatgatgatttatattttattatttatcccttactgagtttttacaagttttctagttaatgaacaaatattcctttggaattcaaaagacaaaccttttttttttttttaggtatgaaaagagtctgaaaacggcatgccctttagtaaaacctcccagttacaagcaaaaagtcacaggcgataaaatgagaccctcaccttcagaaagtcttttccttctggatagcaacagaacatgggcaaaaaggagaagaggaagcaggaaggggaacagatcgtagatcaatgcttctcacatga

SEQ ID NO: 396243 - DNA, 630 bp, Homo sapiens
taacccaaaccaaaatgccataagagtcctttttttcctaagtagatgcttaaaacaaattcccgatatttttgttgcatttccaaagtatggcagtaagtatcaaaagttagtgcaaaaatctttaaatatctatttttgttgttgttgttgttttgtctcgttctgttttgtttttttgagacggagtctcgctctgttgcccaggctggagtgcagtggtgcaatctcagctctctgcaagctccacctccagggttcaagtgactctcctgcctcagcctcctgagtagctgggattacaggcgcgtgccaccatgcccagctaatttttgtatttttagtagagatggggtttcaccatgttggccagtctggtcttgaacttttgggttcaagcaatctgcccggctcagcatctgaaagtgctggaattacaggtgtgagccaccacacctgacctctgtctctccttccatatctttctcatctcctctgtgccaggctctgtcctgggtgttcatcatacaacaaagagaaaagagacaagattcctgcccctatggagttggcattcttgtgtggagaagagaataaacacctaatatgtggtataacattttcacacgt

SEQ ID NO: 396244 - DNA, 444 bp, Homo sapiens
cagttgaagtcccttgtggaaaacactttcatgagctgacttttaaaactgagtagttctacatcactcacaactggttaaccccactgactcagagtcattcatcatgggtcatttgttaggtagggaagggagaggggatgtagcatttcgtgagctgctattacatgccaatgctatgtttatgtgttttatgttcactcttttatttactgcgagcagtattccagatagatattatcatcagctttacagatgaggaagttgagcctcagagaaattaaataactggtcgaggttgcccaggtgatatatggcagagtgggggcctcttctcagtggccatgcctcccaattgacgtggcatcagccccccaaatgtatatgtaaatcactgagcaataaatatttaccagacacctgctatataacaggtactatgcc

SEQ ID NO: 396245 - DNA, 337 bp, Homo sapiens
gcgagaagacgacagaaggggggcaattcacatagtcacaccctcaccccccaccatctcccagagagagggtagtcctgcacgcgaatgattaaaggccaggtttccaggcttaagtaaactaacttatctagatcaattcccttacacttccttgttatctactctgagagaattcagctgccttcagccaaacccttttctgaagctttcgtaaaaccttccggccttccaagaagctttgcatctttctccaaattttcctaccaccctgaccgatctcctacatcaactcatgatgaccaaatggtaaatagcattaaatgaatgatagagg

SEQ ID NO: 396246 - DNA, 951 bp, Homo sapiens
ggctggttggggccacatgcctttctttcctagatagaatgttttcctgtgcaaatgtattaacttgcccattacctcccctgatgggctccaaaattgttcaacaatgtgtatgtccagcaatgaggaccatcgctggcacatagaaagaactcagtacgtatgtatttattgtattgctgaatgggcagagagctgtagttaacaacatcttctgtttggataggctgctaggaaaagcatgtactattgaacctgtgaggagcactcatatcccacttctaactcctcatttcttcatcggtcagcctggatgtctcttcctttagaagcctttgctgatcactccacttcttccaaatacagtagatgtgtctgctgtgtatttatacaacatcctgaactacttaacatgctgtttatttacttgtttgtattccccattagaataggctctgagaaagcaaagactgtatctgtcttgcttatcattgtatccctgacagctcgcccactggctggcttttaataagcacaccataaatatttacttgaaatactcatttttaaaatgaacagatgaatgaatgatagatggatggtggatggcattatgtagctaaaaattgtgtcctgtctctacctatttttgaagaccatcctttagtttgcgtttcctgccatgtttgaggggcctttttttggtccataactcttgtcttttattcaaattaaaacaccgaacaaaagcacattcgattattgaccatgaggtttttattctgctgtcagtgtcaacctcatgtctaaatcacctgaggtcaaacttacatatatctggatagcctttttgatgacgatggtagtctaatttgtgtgttatgtgctcttgaaatgttttgctgtaaagacactagaactgaattttgctttattgcaatgatgatgaat

SEQ ID NO: 396247 - DNA, 445 bp, Homo sapiens
ctgccctcagcctgactgatgtgatgagggaaggggacaaagaatgagctccgaaaggacatttcgggcaacgaccagaaaattagcaaatgcagtgatccccacttaacaattttataaattccaagactcatttcaagtttctcccaactgaaagaaaataatatcaagggccgggtgcagtggctcacgcctgtaatctcagcactttgggaggccaaggtgggtggatcacctgaggtcaggagtttgagaccagcctggctaacatgggaacacggtgaaagcccatttctacaaaaaatataaaaattagctggacatggtggtgggtgcctatcatctcagctactcaggaggctgaggcaggaaaatcacttgaacccagaaggtggaggttgcagtgagccaagatcacaccactgcactgcagcatgggtgacag

SEQ ID NO: 396248 - DNA, 505 bp, Homo sapiens
aggtaggtaagtgggtaagtggatgaatgaacagacagatgacttaatatggggtggatgaagaagagagtgagtagatgggtggatgggtcagggatggatcacagatggctagatggagtggtggctggacagatgaacagaaggaatggacaaacatgcaggaagaaataatagggggccagaaagatgatggcggggagtcaggcgagctaacagtgatgaaaccatgtcatttccatattcaaaaccctcccacaggcttattactcacaaaaaaaatcccaactcttcccacacggacataaacaaggcccagcatgacccactcccaccctgactgatctcacccccaatacctctcattagttatgcctaagccacacctaccatctttcccttattaaaaaataccagactcctccctgcctcggggctgctgcacttgctgttccttctgcctggaatgcccttcctcagctcttcatgcaactgtgccttctca

SEQ ID NO: 396249 - DNA, 838 bp, Homo sapiens
agcgaagcgcggcggcggcggcggcgcctaggggagggaggggcggcggggccgagcccacctagcggagcgcgccggccgccggtggccgccgccagcatgccccggcccgcgggccgctccgccgccagccacccccgcggccctcggcggcctgcgctcggcccgggggcgcgggaaccgcagccggagccggagcagggctgggggagaggccgcacctgcgggtgacagggtgtcctgagctccccgaggcctctccactcggagcccatctcacgccttctgcagtcgcaggggtggctgtcaccatccgaggacgggctgtccaaaggtcacacagcttgtgtgggtgggccccaaccgccacccccatggtccctgtcacatgagttatctcctgccggctcagtatcctcaacgagcgccctccccaaccgaccccagctgtctgacacagccctgcggctcgaagagactgcaccaaacctcacagctcccagccagactgccccagcgcgcagcctggtccctgacccacggaaggcctttccccagggtggagaagggtttgtccccgtttcccaggagggcagctcggggtaaaagccagccgcgtcctgacaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgaga

SEQ ID NO: 396250 - DNA, 479 bp, Homo sapiens
ctactagagaactctctatgcatagagaaatgttccaaatccttatttctggccaaagacctgtgtattatttttactttcccagataattacctttaacattattggatttttcacatacagttagatgattttcacactgataatttgggaattacattgcccctaagttaacccttttctacctaaaattaaattttgctgctaccccaaaacatgaggaaattgaatgcccccaagggctttgtagttcaagtcataacacagtggtttaacacctatagaacccctctctgatcttttgggattatttttatcaataaagtgaaaaaatgagggagggaagagggaatacaggagaaaggcatcacactttcctgatatttctcaacataaccagcaactactttccattcctttcaatgcagccactaggccctgaaatacagtgcacagatggtgttagaaaggactcaggc

SEQ ID NO: 396251 - DNA, 511 bp, Homo sapiens
atataatggtcagttgtcatcagcttgcttggttaataccgaaataactagaaattttgaagatttagaatcttggcacattattttatttttatgttataaaatattcttagaaaaaacagactttcaggatttacaactgcattttattccataaagggtgtgccaaagctatctttaataacgttttgggtacattacaaaagaattacagcaatttaatggtacagtgaggtggtgatccaaattctaagataatgttaaaatttgcagcctaactcatccatcccactgtttataccatctatacctataaagcattcttgctagttagtgctggacatcatcttactaagtgggtggcagctgcctgtcatctcaataattctgaaaaaaagccagggaatttgttttaaagcatttgtccagattaaaccacatgtggcctccagggtgctctgggcctaaagcctaagcctgctggctgtgttgagccatcgagcttattcag

SEQ ID NO: 396252 - DNA, 629 bp, Homo sapiens
agacctacaggaccagatactgcatgctaggacttgggaatctataatttaatgtgtttatataggtaatttaaatgtgtttccagtttggggaaccatagatttcgaaagtattttgccctgggagctctagtccattcaacttggctaaacttgttaatcttctattcactttgatagctctgaatgaattttagggctggaatataatgattactgactcagttgacttcatttgaaacaagtgggtgggacttagtgtgctaaagtctgtttatctttgaaatatttgtatcttggtttatagtccagaatttatgcagcattggccccactgcgtagctctgtgctttagaaaaactaggtggagaggattaattaaatgcaaatcactgaatctctctgtgtcactggtcagctaaataaatagcctttgtgtcctaacagcagcagacattttctggtttaggttttccacatggtttattatgaagtatgacaacttgtcatgtgtaatcagcatcacattagtctcaagagaataagctctcctttaatcagctgcttttctttaatctggtggggtgaggcatatggtaaccatgacatttttgtcatttgctttgtgg

SEQ ID NO: 396253 - DNA, 112 bp, Homo sapiens
aaactgccttccatcttacggtcctgaccatggttccaacacacatccacatttacgacctgtgacaccctgggcaagtcatttaaccttgattctatttctattccaattc

SEQ ID NO: 396254 - DNA, 326 bp, Homo sapiens
aggctgtgtggtgctggagagaggcagcaggctggacctggttgggcaaggctgagtggttgtgggataagaggagatgtttcagagcagcacccacagaaccgctgtgatgggagaaacaagacttcgagttaggagagtgggttggactcttggtgcagcctatgtgaccttgggctgatcttgtctcttttgagcatcactttcctcatctggaacctggggctcttgtggcttcctgcctctctcaagggtgattcgggaggaagagtgggagagagagagagagagggagaggatggaggcgagagaggtggagtgggaaa

SEQ ID NO: 396255 - DNA, 568 bp, Homo sapiens
tgtgagtttacaaaatgacattctaaaccaataggaaagccctcaaagtctgttatatcttcaaatgtttggtgaattgtggccactgaattctcttattctataattttgctctagaattttgtccccagtctatttctaacgtggccttatttcccttttggaacagaacttcgcaggactaggcaaactccaattttccaatgaatgcttagcattataaggacacagtaccttcctaagcttctctttaaatagcagtcttatttgaagccaaatatcatatggctatattgaacttaatatgatttctatcagccaaattacattagagctctgatgggaacagggataagtaatttggcaggctttctcttttctattcacctccatttgcttaccttgtttctaagaaaagattagaagacctgacaggttggctttatctcagagagaatatataggtaggaaataacagggagttggaaaaccaatttgtcagcccgaaccaggaaaagagtttcactgatttaaggctaaagcctttaaacatcccaaggtcatctct

SEQ ID NO: 396256 - DNA, 368 bp, Homo sapiens
ccccatgtcccctctggaactcctcacagttcacaccttgaagcccaggcacttgcgatgggaccagcgaggtcaaatgcaggacccctggtcctcactgttaccatgaagtgatgcaaatggccggtcttcagaaaccagagctagccccacccgtgccaccaaggcacaccagcccctgagcagtcgcagggcccaggcagaagggtccggcaggctcctcactcatgacgtggcctgagggggctgggcagctggtcctcggagcccccacctggtgcaccaggccgtgaacctcagcaaaggccccgtctcttgatgcccaaggtttggcaatggttgggggttactttctccagaccacagca

SEQ ID NO: 396257 - DNA, 434 bp, Homo sapiens
tctgtagtaggcaaggcacagtggctcatgcctataatcccagcactttgggaggccaaggcagaaggatcacttgacccccaggagtttgagcccaccctgggcaacatatcaagaccccatctctgtaattaattaataaatatatgttttgcagtgatggcgtctcaatatgttgcccaggctggtctcaacctcctgggctcaagagatcctcctacatcagcctcccaaagtgctggaatgacagatgtgagtcaccacactgcctggcctattctctccttctcacagaacccccattttatttagagtttttagatatttatctccccacattcttccagagctaaggatgtcaatgtggccaataaggtacaagtgaaagtcactgggtggtatttttggaaaagcaattgattacctgattcaaa

SEQ ID NO: 396258 - DNA, 435 bp, Homo sapiens
gcatttacatgtggcagcaacactcgaaatgactaatcactagggtggataaaatgatagggaaaatgctgaagatagaactctgggaggaaacaagcatttttaagggtagaaagaaaagccagtgaagaaacctgtgaaatgtggtaggaggagaaatggtagaatagtgttgagaaagccgaaaagaaagattgtatttccaaggagagataggaaagattttcaaatgtcgtgaagtaggctgagcctggagaataggcctttgaatctggcatgtagattagtcaatgatctgtgagagaaagtagtttgagaagcatgttgggggcacaaatcaaagtggaggatgaggaagtagaggtaatgagtataaagtactttaatgtggacggaaggaaagtgaaaaaactgggtgaagggtgtgcttaagct

SEQ ID NO: 396259 - DNA, 377 bp, Homo sapiens
tgacaatgttccggctgatgggatacaacaggaggatattgtggcagcttcctagaacctcattaacagactgctgatgcatgcccttggtcttcattttctgtgtcctttcctctatccctttaagcctgtaacttaaattgtggaactcaaattttggaagctaccataccaaccatcatcaaagtccaagagaaataagcttctaacatgcatgccactcttatttcatggctcactgccaaatctaacacaactggtatattgaatttgcttagagtctagaaagagaagataggcataactccctggtatgcttcccaaatcttcccccatttacattaggttggacaaaacatgtatagttttgtatgaaa

SEQ ID NO: 396260 - DNA, 409 bp, Homo sapiens
ctaaagaggaaggagtttaatctacctttaatctgtgaatgtagaatttaggtggggagactgtatattagggttctgtagaggaacagaactaataggatagatgtgtatatgaaggggagtttaggctgggcacagtggctcacacctataatcccagcactttgggaggcccaagtgggtggatcactttgaggccaggagttcaacaccagcctggccaacatgaaaccctatctctactaaaaatacaaaaattagccgggcatggtggcatgcacctgtaatcccaggattacaggagaggctgaggcaggagaaatcgcttgaacccggggggcggagattgcagtgagccaagattgagccattgcactccagcctgggcagcagagcaagactctgtctc

SEQ ID NO: 396261 - DNA, 327 bp, Homo sapiens
aagaatatatagtgtgattctatgtgtatgatattctaaatgaggcaaactcgtttatttagaaagaaatcagaataaggatttgagcacaagtagaagtgactgtggagagggccaaggtaacattgtaagttgacagacatgcctgtatcttgagagggaagtgggtgacacaggcatatgcgtttgtcaaaacaaaatacaattcgctgtttaaaaaaagcccaatagactatacactttaaattgtggggccgggcacagtggctcatacctgtaatcccagtgctttgggagtccaaggcaggatcacttaagcccaagagt

SEQ ID NO: 396262 - DNA, 310 bp, Homo sapiens
ttgaaagcaaacagaagaaatcctctatttcaggcagtaaatatgaagcagagagtagatgtaagggatgctcccaaaactggccactctgttaatgacaaaacagagaccagaatccacattctcaacgctcagtccagcgccagacccacaaaaccatttggtttttgcaagagcactgaatttccccaaaataaaacccaaactatcactaacagatgttttagatggtcagtcttcatccttgtcttcattcaatgctcattcctccttttactgcaaaaacaaaaggtggctaaaagagtatcca

SEQ ID NO: 396263 - DNA, 478 bp, Homo sapiens
gacttcagggactatgctactctcaaaaccgatttgagtaactgaaaacagcactctgaatcctataaactaaaacagcatcgtatgaaaaacagtttctaccttaataaagctaaaaatgtgaaaactaacattcttgcggctgtggaaaaacgaatcgcacttggagtattttttctcttaatgtattataaatctcaggttgctgtaggttacacagaaaccaaagtaatcccgactcaattttcaggcctgacaccctccaacatcacccggacttttagatttccgggaacaagcagagaaggagaaaaagtcactgggttgctggtaagtgactgaagaacttgaggagtggagggcaaggtggccgcgcggcctcaaggtccccttctccaccccaacctatgaggcccagagctgcggcagctcctgcccgtcctactccacctcggggcggctacaggcttgcggccgc

SEQ ID NO: 396264 - DNA, 215 bp, Homo sapiens
gacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaa

SEQ ID NO: 396265 - DNA, 1683 bp, Homo sapiens
attattaataagacgatgatcatgctaattaagctactttattagagtttgatggattttgtgccagaaattatggtggggtctttgaaatatatagagtattttctcttagagcaagtcgtctagcatcattgaaaactttactgaaaactcttcattactcataacattgctcgtctgtttcaaaatgacacgatagtcactttcacagaaacataatagtatgcaattcaaatgtttaatttgctgctgcaaaagaattcacaatagaattctcaatgtggggttaattacatagtaatgaaagagtaaacctattgggaaaatgctctaagtaacattgctctgtttcctactgataaagacgtgcacgcctgatttattttttatgctgggaaattcagaagtaagagaaaaccttgaaaaggtatgcacatgaataataaagttttttatcatttgtcaacatgatgagaaaatgatgaacgtggataattattatattacaaaggctataatcacaaaatagtaatgtataagaatatagcattctattatacacaggagaacatgatacattaaaatcattgataacataatctaaggaaagacatcgctaatcagaacaaaaaaaggaagaagtaatagagcaggcactcaaaattgtgtccatgttttctacaaataatcttcaccctctctgcctatgagtatagtgttatattgctaggtatgttatgtttactccatatatgtcaaagactccactgggggaattgaacaatgagaacacttggacacaggaaggggaacatcacacactggggcctgttgtggggtggggggatgggggagggaaggcattaggagatacacctaatgtaaatgacgagttaatgggtgcagcacaccaacatggcacatgtatacatatgtaacaaacctgcatgttgtgcacatgtaccctagatcttaaagtataataataataaaaaatttggaccacaaaaaaaaatatggtatcttaataaatatctcaaaacagttataagattgacaatatgatccctactttgttaggtgaagaaaatgacacttttaaaaacataaaaagatttcctgtatgataggattcaaattcatatttgtttgtttccaagggctttttctcattcattatcctatgctgtcatgtaaattaatccatgaatattgcagcttgtatcagaagcttgaaagttcacagaaagaatcattttctacctaaatttgcccatcaaatttgggtggacagtgacagcagcacagtgttaggcttacttttaaatgacattatttaggatagtgagaggataaacaaatagactaaaagaacagaacggagtccagaactagatccacgcagatatggccaattgatcttccaaaaaggcaccaaagtgatgtaatggagaaaggaaaattgttttaaccaccagacctagaaaacttggtatccatataggaaaaaaataaatcttgatacttcataccatacacacaaaagtaattatagatggcacatagacctaaatataaaatcttaagctcaaaagtttctagaagaaaatatagaagaatatttcctggacctgagctaggcaaagatttcatagaaacacacaaacagcattagccacaaag

SEQ ID NO: 396266 - DNA, 286 bp, Homo sapiens
aaagcccctttctctgctgtcatatgacttggactgcacgctctatgtgcacacggtgtaatgaatgccacattatcacccactggctggggtgagccttcttgttatttatttccaactggaacaggatttcacatcccatgctcccacacaaaggtcttagaaacaaccatttcagacagttccttgcatcagagttttagggtactcttctgcacacaaactgttgttggaacatgagcttggatttcttgatgctacatgtcacggattggcaggaaatggt

SEQ ID NO: 396267 - DNA, 291 bp, Homo sapiens
gtcgttgggtataatgtgataacaggagcaagaaatgagtaatcaataaataccaattttattgaaataacagtgtttatttctctaaagaaagtaggagaatgagtctttagacttaaggagcatatactttaatgaaagagacagtacagatatcgtagaacaagtgactgaaagcacatgtctatttgtaaatgtctagaaagaaacattcaccctgagactaatcagtctgtgtagctatttagtgaatatttttcagtcaagggaaggaattaagactttaaattt

SEQ ID NO: 396268 - DNA, 583 bp, Homo sapiens
ggttacttaaatccacttattaggcaatggtgaactaaacaaacagtaattagaaacactccagactaccttttaaatctgttgctaaattatgtttttcctgcaccaaagcccatacacacagcatgtccacaagcatcacaaaaccaaagcctcagaaatatttacactaataagggcataagctacctctgggccttcacactggattctgcagggaagtaagggctgccttagaagaagactattcattactgttatttctcacatctgggtaaataaagcactgcccccatgtggttagaaatcccaggtgaaaatgaactctccaggggtctggaaatgaagaatacctctgatagactgtctcatttcctgaaatgagtcagaaatgaaagtaattcctcagaaaagaacatctgcactatggcacagcttataaaataatgccagatgatacctgtggctaagaagctggccccagagaagaagggagggcctgggaacagcaccagagcctctgcattgcacttaatctcaaggctgccgctgttagcttggagggtctgcaaatccaatgagc

SEQ ID NO: 396269 - DNA, 480 bp, Homo sapiens
cagaaatttgacaagatctgtaaagaggaagctgaatacaaatttaagagcctaataaacaggctcagggttttaaagacaatcttcacaccataaaccacctgggatggtaaacttcgaacactgaagcaccttctactcctcagcagaatgagcaccccaccaccaccatttccacagagcactctgcacacttcaaacagagcgcctgacattcaatttactaatgataattaaattattggtcattatgtctagactgagggcctcaaaagcagacactatgattcatttagctatctctagttcagctagttaccaggtaaacatttgttgaatgggtgatgaatggagcatttaaaacaactctgttatttgcggcctggggtcacgcaaaatggtgatctccctgtatctcagtacacacgtacttatgtgtaactttccaattccctcttgctccagccttgtgattccaat

SEQ ID NO: 396270 - DNA, 539 bp, Homo sapiens
gagttgagcagacttagagaactactgactggatgatgagggctataggtgtacccagctgagcccccctaccccattttaggccgggagaaatagcatggttaggtactctaaaccaacagcaaagctggccaagctgggaatatatctctatccttaccagagaaatacagacaccatgtagtatagtggataaccattcagaatcaggaaccagaccacctgggttcaaatcccagctccactactgaataggtacagcaaactgtgccaccctaaaccttcagctgtcctttctgggaggaagatgaagctgttgacaatagctcagtaaaccttgatgcagctttggcaacacagcaagaccccatctctacataaaatgaaatattagccgggcgtggcagtgtgcacctatagtcctagcaatggggagtctgagaagggaggatggcttgaacccaggagttggaggctgcagtgagccatgattgtgccactgcactccagcctgggtgacagagtgagaccttgtttct

SEQ ID NO: 396271 - DNA, 175 bp, Homo sapiens
accacagtatctgtcttagcttcctcttaacaggacaggtagtgatttacctttaaaaatacaatctctaaaattctgaaatttactcctgcactaaaagtactactctttttcatcttgtcgtcttagctcaacattctaatttttttttagtatttaggatacattgatttta

SEQ ID NO: 396272 - DNA, 659 bp, Homo sapiens
ctaggagagctttgccccagacaactctgcatcgaatcctggtatgactgtcatcactgcccaaactcagtgtcctcatctctccagcaggattaatgctgatctcagccttgcagaactaaccagagaacctttgagacacactcataaaccaagttgttcctgtaaatgtcccgtacctcccaggatgccaaggagaggagagcatcatcctctctggccacctttaggaggcagcagctaggcgctctgcaatgactgcctgatgggaactctggaggactgggttctggtcctgacttggccactggccccagtgtcaccttggacagcccttcacgctcactgggcctcagtctccctcttatgtaaaacaagattatcttttagatctgttttagtcctgccaccttacagtggaatggctgagggatgcttctcaaggtgtgtacagttcccataggaatggcttctcctggcctgtgggccgcctggcgggttgagtatagggtgatcactggagccctgggctgaggactgtagtctggaatcaccagccctggggatgaaccccaagtatgtctccttctagatgtgttattccggagaagtcatttcaacatcctggccttggtttcctcatctgtaaaatgggctga

SEQ ID NO: 396273 - DNA, 501 bp, Homo sapiens
gctcccacctcagcctcctgtgtagctgcaactacaggctcatgccactatgcccggctaattttttggtatttttaatagagaaggggttatgccatgttgcccaggctggtctcaaactcctgagctcaagcaaggtgcccaccttggcctcccaaagtgctgagattacaggtttgagccaccaggcctggcccagcatccaaatctcttggagaaattgttaaaaatgcagacatctgggacccatcccagaactactgggtcagaatctctgggggtttagtgctctggaatccgtgtttagcaagttacaggtaactgatacactttgcaaagcactgctttaaaagaccaggtgaagagggaagagtgggaggaagaatgactcattgtgctgttatagaaaaaaaccatgttcttgtcacacgaccaggaaagattaggctcgtggacacatagaagggtgaggagtggatttactgggtgaaaatttactgc

SEQ ID NO: 396274 - DNA, 358 bp, Homo sapiens
gaggctacagtcagctgagatcatgccactgtactacagcctggatgacagagctagaccctgtctcaaaaacaaaaacaaacaaacaataaacaaatagtttttaaaaattaaaggtttgggctgggtgcagtggcttgtgcctataatgccagtgcttttggaggctgaagtgggaggatctcaagcccaggagttggaaaccagcctggacaacatagtgagaccctcagctacttgggaggctgaggtgggaggattacttgagcccaggagcttgaggctgccagtgagccatgatggcaccactgcactccagcccgggcaacagaacaagaccctgtctcttaaaaaaaaa

SEQ ID NO: 396275 - DNA, 431 bp, Homo sapiens
tcttttccattggtatatttgtctgtttttatgccagcaccatgctgtttcagatactatatagctctataatataaattgaagtcgggtaacgtgattcctccagttttcttttggctcaaaataactttagctattctgagtcttttatggttccatataaattgtaggattgtggctgggcgcggtggctcacgcctgtaatcccagcactttgggaggccgaggcgggtggatcacgaggtcaagagatcaagaccatcctggccaacatggtgaaaccccgtctctactaaaaatataaaaattagctgggtttggtggtgcgcgcctgtagtcccagctactcggggggctgaggcaggagaattgcttgaacccaggaggcggaggttgcagtgagtcgagattgtgccactgcactccagcct

SEQ ID NO: 396276 - DNA, 349 bp, Homo sapiens
ctgaaaatttagctcagtcctagagtgcaggttggcggtaaacaataagattagatatcctggcatctcaggatcagaattgaagctggtttaatttgtggaaactagagatgcaatatttctttcatacatgagcctgtacgtggagggtgaaacccacaaaacagagtaatgagtccagatttgcagccagtggaaacttccatttggaaccatgcttgatcacgaggagcatagtttacttggatattgcagaaagaccatcctgtgtcatggagagagggtgccaggcaccacagagactattcaacaccatctttgtgccctttgaaacctgcctacctgagcc

SEQ ID NO: 396277 - DNA, 554 bp, Homo sapiens
agggcccatgggtgctctgatgtcagtgagcatcttttctgaagcccttccacaggtggccacctctagatgaccacacagtcaccttcctcataaccacctgtgagaagcacaatcaccccacctaatggatggggaatccggggcacagagtgtcactagggaacagcaagtgacatttattgagctttctctgtacagcactgtccgtgcacgtgcactaattcagttcgctgtgtgtgggttcagtgcctgctttacagaggggacattttggcccacacaggttgggtgacttgcgtaaactcacacagctggaagagcacgctaccacttctcagcagctggccccagacaacatgctcagacacgaggctggggacaactcttttaaaggcttatatgttaacaagtaaaaagcactgatcccaggagaggtgccacctggctgcagatctgcggcagcctgctctttccttctttctagaagttcagtgtacaatccaaatgggtttgtattaggcttatcaaaagaggaaactttagacacagtt

SEQ ID NO: 396278 - DNA, 167 bp, Homo sapiens
tttagaggacccccccgctaggggcaacaccggactcctcatcagcagcactcagctagagaaggcaaatacagcacagagtcccttgtactcaacaccggtatcacaacagaaatgctttggccgggcgcagtggctcacgcctgtaatcccagcactttgggagg

SEQ ID NO: 396279 - DNA, 143 bp, Homo sapiens
accacacctggccccaaaataatgttgatcccagtggccgccactgttctgggcagtggggttagtcagggaagaaaccactgatgccccttgggggctgggattctcagagaaggggcagtgagcgccgggcgcggtggctc

SEQ ID NO: 396280 - DNA, 312 bp, Homo sapiens
cacagaactcctttcttctggttggtatcaaggaaggctttgtggacctggtagcacttgagttagctctggaaggagaggcaggatttggacctgtggcgatatgggctggggaagacatgagcttggcatgtctgacagtcagtgaggacctcaggttcctggagcttaggatgtgtgatgcagaagaagtctggaaaggtaagaaacagaattgtaaatgatgctatgaagatatgccttagttctttaggcaatgaagagtcactaaggttttgaacactggcgtgtatggtgggttgtggggagaca

SEQ ID NO: 396281 - DNA, 869 bp, Homo sapiens
ctcatgatccacccatctcggcctcccaaagtgctgggattacagccatgagccaccgcgcctggcccattctgcttttaagaattaattagttaattaatattttttagaggcagggtctcactacattgcccaggctagtgttgaactcctgaggccaggagtttcctcagcctcccaagtaactgggactacaggcgtgcatcaccttgtccagcttctgtttcccttttttttttttttttttttttctgagatggagtagtggcgtgatctcggctcactgcaacctccacctctcaggttcaagtgattcttgtgcctcagcctcccaagtagctgggattacaggtgtgcaccaccatgcccagctaattttttttgtatttttagtagagacggaggctggttttgaactctcggactcaagtgatctgcccacctcagcctcccagtaaatgctggaattacaggcgtgagccactgtgcttggccggcctgaccttgcttttgtctccctttgctctttcttgttctttattcccattctgcaattaacccataaccttgaagctccttttccctgtctcttctgtacttcgcacactccacttactctactagtttgatttttgagtgtgtattgagcacttgctatgtgctaagctgccttcgaggtgcttattcactagcagaaagagtttataaataagggcaatgcaatgttacagttgctctgatagagttggaagagagtacagcatgggcaagggtggtaatgagacatggattctaccagggtggtgactagactttgcagaatgagatgggtgacgaattgaatggctttgatgactgactaggcgttg

SEQ ID NO: 396282 - DNA, 909 bp, Homo sapiens
attctgtccgtcctcaggctaatgctgcgtatgccttgagtttctcatagcattcactgtcaatgcaaacactccaaatacagtcgaaactctgaaatttgacctctaagcaaaacttttggtatttggaattttcaagtattttgatagatgatcccagattagcgctcaatggaatcttgtatacacagggcagaacgctaaggagtgcttttacagaagccaggaatggctcactgtctgctgccctttctactccttcacacacattccagcctcctcatcagtctgttcagagggagccaaggtagttctgccaactgggaaaatgtttgagatacaagtggcaggcagaaaaatgcagagctgatttggaaggctgctttcgaaattacatgaacccaaagattgtgggttgatgtcaaagccttcctgtgggctctgaaggccagcatttgaggattttcaccgattgatttgtgatgtgtgtgcccaactctgtgccaattaactttcccaatctgcatgcaccccatgtcccatgcccagtgcagacaagctggtgacactaacactggcagctttgaccaggactccatgaaagagcttggtccagatcagctttcctagctccagaccacagctctcatctggagtccagatcctgccgcaaacacttgtaagtggtaatagatttcctttactttgtctctcagccctccctactgtctggtgcattcccatctatgggcctccaggagcatgtgctctcccgtatgccattccctggggatgcaaccatcagctccagcccatatgacagtaacctggtctgtcctgtcctgggaccattactacacccacgcactccagccaaaccagaattctttcattttctcagttgtttca

SEQ ID NO: 396283 - DNA, 425 bp, Homo sapiens
taccaaccaactccaagtaggaacaaaggccccctggctactttcttatctctaaccacaaatggtttctctctaacagaacgcatttgaatccaataggtcaggcagtagaaacagctacaaagtttcaccctgtctggaaataaaaccaacatttctgggaatcagaacagttttggaaaatgactgagtgaagtaatggtgcacagttctaagaaacaaaacctggaactatctcagaaattcaatgctaggaattatttattttttcaattgttgcctctgactcaaggaatctgtcccctcatttctaaggacattagttctgtatggatgttgagcgtggtaagaaagggctttttgcatagtgcttttctttgggacttcccttacccaggaggtgggggagctactgtcccaaatgc

SEQ ID NO: 396284 - DNA, 410 bp, Homo sapiens
ttacatgatttaactacatgcacataataaaaagtcacagaaatagcatgtatattcagataattttcctttttatataaaaatggtttatttactcaattcatatgaaatataggtggataatatagtttcattatgtaacagttgaaaacattccaaattttcacaatttgtatggtgtttacaagacagcaaaaatgttacacggaagtgtaagggttataatatttgcagtatgttaaattagtgtaaactttttaactacaaaacaaagaatgaaaactagaaaacataatttggaacgcaaaaacgagaaactccctgattggataaagaacagatcagtgcgctcctgccctttaaagcaaattttttaaaaagtaattttgaaaagcaactgctatggtttg

SEQ ID NO: 396285 - DNA, 417 bp, Homo sapiens
tgggccagtgggaccagaggcttctggtttcttggcttggtctttgggatacatgaagagaaatggatacagcaaacctagtgggcaaagcattctgaaactctccacaaagcccctccagctcctccaagaagaatttctcccttcttgagatctgatatggtttggctctgtgtccccacccaaatctcatcttgaattgtaatccccatgtgccagaggaggggcctggtgggaggtgactgaatcatgggggcggacttcctccttgctgttcttgtgatagtgagtgagttctcacgagatctgatcatttaaaagtgtgcggcacatcccccgaaacccgcctcctgctccatcatggtaagatgtgtttgcttccccttcgccttctgccatgattgtaagtctcctgag

SEQ ID NO: 396286 - DNA, 481 bp, Homo sapiens
cagaactcaaagtcctccttctgctcacatgagacaaatgccatgtctgatttccttcctctgacctattgtttcactaaagccaaactaaggtagaagtggcggctactctacgccaccccacatgtagattgtgtttttggtgaaaggctggctgatcagagactcaaaagaatgcaaacatttgtctcttacttacctatgacccagaagtcctttaccccactttgagttgtcccacctttctggaccgaaccaatgtataccttacacatattgatgatgtctcatgtctccctaaaatgtataaaaccaagctgtgccccagccaccttggacacgtgtcgtgaggatcttctgaagctgtgtcatgggtgtgtccttaatcttgggaaaataatctttctaaattgattgagatctgtctcagagacttttgggttcacacccatatcctgaaaactacaaaacactgcttaaa

SEQ ID NO: 396287 - DNA, 391 bp, Homo sapiens
cacacgtgtttactgtgtgcgcatgcgcttgttttgtgtgtgcatgcatgtttagttactgtgtgtacctgcgcttgttttgtgtgtgtgtgcatgtgtgtagttaccatgtgtgcatgcgcatgtgtgttaccgtgtgtgttcgtgcacttgtgcgtgcgcatgtgtgtttagttactgtgtgcctgcgcttgttttgtgtgtgcgcgcacatgtgtttagtaccgtgcgtgtgtgtgtgtgcatgggcatgtgtgtttagttgctgtgtgcgtgtgcttgttttgtgtgtgtgcacgcatgtgtgtttagttactgtgtgcgcgtgcgcttgttttgtgtgtgtgcatgcatgtttagttaccgcgtgtgcctgcgcttgttttgtgtg

SEQ ID NO: 396288 - DNA, 525 bp, Homo sapiens
atgcagaagccgtctgcgtatggctgttctttgcatcagtcctcaataaaatccaagggcatgactttaaagggtaacaggctgatgattattacatttttatggatgacttaagcatctttctccattgttgtatgagaagagagtcaaatgagagatcatctggcttagggtataactgaaaatatcccccagtaaagagaagaatccatgcaacacttataattcttctgaaactctcctatgtataagtttgtacacattgtcatatagcaaaaaattaaaatagagcacactgtaatattttagtgtgaataaaatacatttttgctccgtggtccatgctatcatggaacggagacaataatgaccttcatctataaaacaatcagttatacaatatacatctaaattactaatgtgctaaaatgatatctcagaagaactgaatactagcaaaataaagaaaattaacaattctgtagtatttattttgagtgtcaaattacttgataagcatgtaaa

SEQ ID NO: 396289 - DNA, 769 bp, Homo sapiens
attacaagagggaacaacttgcagctcatctgcatatccgtgaagagaggaaccagtgtatgccattctatgactatcaagaagacacaacttttttttcctcctaaatgcatatacatagattattagaagcatctaatatatgacaaagacatatgtggcctgtcaatgaagacaaatatgctggtctcttctctgcaccatgcactgggcttgcccatgtggaaggatgcagcaggcagaggtatgtatgcagggtccttattgagatgaatggagggtccttattgaaatgaatggaggggccttttaaaggaacactgtcaaccagagtaggtcctggtggaaattaccagcttccctagaagcaaagggatacttttttcattaataaccacctccatcagaaaaggaaggtctggcttttattttcttatttgcctcctgatgaattttagggacaaagaaggcatgtggattttaggcttctcttcattactgcttagatgtcaaaaatgaccacaggtcatatcccatggtagcacaaattcttatgagataaaagagaagattacccaaatccagccaataatcctctttttaaattttatttttgagacattgtatactaccaatataaataacaaagggagcctgtattagtctgttctcacactgctgtaaagaaatacctgagccgggtatgatggctcgtgcctataatcccagcacattgggaggctgagacaggcggatcacctgaggttgg

SEQ ID NO: 396290 - DNA, 230 bp, Homo sapiens
ctgagatcgcgccactgcactccagcctgggcgacagagcgagactccgtctcaaaaaaaaaaaaaagaaaaagaaaaacgtatgaccacggtgttactaccacaactaaaatactgattgtaatgccctatcatctattaggacttttagtactcctgccattttccattttaaataccatttccattttgttgacaagtgaagaaaaaccagtacagtgatcgaccaa

SEQ ID NO: 396291 - DNA, 678 bp, Homo sapiens
agcttcacgagagggggcacagtcgtgcagcgggaggagcgagagtcggccactgtttgggtgccatgggtgtcctgggtagagttgagggcctcccccgggaaggataatgctgagccccaataggaaacactgccctgagctatctgatggccagccctctgtccatgggggagccatttcttttccttatctctaagctaatacccctctttcctgaggttctctcttactgcctaagctgtttggctctgggagttactggctagcttgtccccgtcgggatctcatccccatcggtatctctggcagggcttcttgaccagctcccccctggacctgcggctggagacggagttgtgccgctctctccgtcctagtttgccttttgaggcttacccactcctccacctgggctgttttaaaatgattagagcagaacctttcaatcaattctatcaaatgcatctgtagagctaagggggcggtcccttatgtgaaacctaatctttatagctaggccgatgggtgtgctcaccgccgaggcacgtcattacgatgctctttggctagtcattgtcattagaaatgtaaacactgattggggaccttcccgcaggagctgtctgggctgcctgctgtctccaagctattcaacttccaggtttacctttgcag

SEQ ID NO: 396292 - DNA, 159 bp, Homo sapiens
atgctgaaacttcagggaaaaaaaaaagaactttggaataggtaaaatagaggtaaatataacagactatcatactacgcatgagtttctttttatctttttttagttctgcttactaaggaagagttcttaaatcatatttgctggttgaagcaaaat

SEQ ID NO: 396293 - DNA, 509 bp, Homo sapiens
gcctgttcaagcccctagtaataggcccactaacatggtccccattgcagacccagcagcagccacgtaactcggctgcaaccctactcaactgcaatcctggaggcaatcttatcagcttagggacccaaaagaagaaaatctttacctaccaaaaccagtctgtaatgactggaggaagtgtctgctcatccaaatgcacaaacacgaacataaggctatatagttagtgaagaatcaggcaaacatgacactctcaagaaaatgaatacagttccagtaactgactccaaaaaaatggagatctgcaaatcatttgataagtaaatcaaaataattatctttaagaagctcaatgagacgcaagagaacacagatatgcagttgaacaaatcaagaaaaacaatgcattaacaaaattagaagtttaataaagcaatagtaaatgctaggcatggtggcttgtgtctataatcccagctacttgggaggctgaagcaggtggatca

SEQ ID NO: 396294 - DNA, 475 bp, Homo sapiens
aacttacaaatgtatatcaacatattataattcaaaagctgtttttatttgggaaataaataacaatgtgtaaagaccgggaatttgttctcctacctaagcctgatgattaaaagacagtgtaactatgcaggtgttaaacattttctatattcttacagccatctctgttcatatatccatttttaactccacgcccctgtaagcctttgagtttgtgatccctggtgaagacagtgacccacattgattttttttttttttaaggtttctctctctcttttttgctttttctctcgaatataggacctatatctttgttaaggcaaatcctttataatattcattactcaaaagttaaaagttcctgagtagtagtatgaaagaactagattatctttggagagttataatgacatgcctatatatgtagcagtaatttagaataggcatctatttagcttatgtgaaaatt

SEQ ID NO: 396295 - DNA, 545 bp, Homo sapiens
caaatgctaataagtcttttattagaatgatggcgtcttcataccatgaaggtgagtactgaaagatatataagaagaatatctataaatcaaaagaaaatagtaatgacatagaaaaatgagcaaaatcagttattcaaagaaaatatactagtgctaataaatatctctaaagatggctaaccttagggaaatgcacgttaaatgattttttttgtttgcctgtcagattgacaaaaaattaaagttcgataatgctatgcttatgaggttatgggagaccagattccctcatacactgtaggtgggaatgtaaatggtatagcctttttgtcagaccagtttggtatatgtcagaattttaaatgcacataccctttggcattccgtttctgtttctagcaaactgctcacattttgcggtctgctcaaggtcatggtctgctcataaccttgtcctgcttggctatcaaagatttataaattgtgttagtactatttctgaatttaataaaatacttcattgtcctgttcagatttttttt

SEQ ID NO: 396296 - DNA, 479 bp, Homo sapiens
ccagccacgggcgcgcctgaaaatattttctaaaaagataaaaaatatacataacgatgaaaaataatacaaggtttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcgggcggcggccggtggctcgggggccccccagccaggggccccccccagacctccagacattgggatttgaccctctctcagaagaagcggtggagcagctggaaggcgttcttcggctactgttgggagcgtcagtacagtgtgagcaccgggaactcttcatccgccacatccagggcctcagtctcgaggtccagagcgagctggccgctgccatccaggaggtactgagac

SEQ ID NO: 396297 - DNA, 312 bp, Homo sapiens
aaaaattcaagctctgttaagtacatgtctctgttaaattccatggcaagtctgggtttttccctgactcaagggttttatttagtccagatatccactcctgtgaagtcctcatctgaaccagtgtaatgggcagaaagaacttacatagaagtcaccagaaaatggttcatgctctagaatggtggttgctaaggtgagaagcctgaaaagatccatgcgtaagaggaaaaattatcagtatcccaagaaattttttatctttaaaaaaaattgagtttgaccaataatttagatatggattgacactgg

SEQ ID NO: 396298 - DNA, 253 bp, Homo sapiens
tgaaacggagtcttgctctgttgcccaggctggagtgcagtggtgccatctcggctcactgcaacctctgcctcccagcctgggtgacagagcaagactgtcacaaaaaatacaaaacaaatgtcgcattttatcaaatccctttttattatctattatcatgatcacatataccttttatcttttgacctattgatatactaatagttttattaacattaaaaaatcacattcctggaatacatccttccat

SEQ ID NO: 396299 - DNA, 607 bp, Homo sapiens
gtgtgagtaggaagcagaaagatcagttagaagggcatcgtccaggtggcgttgatatggtccaaaccaagccagtggggatgcaggggtgctacaggaatggggcaatgaggagggagatgagcttgagatgcctgtgggagatctgtgcagacacaacggatgcaggaagaaaggcaaagatctgagagtgcaggctgggggagcagagccagcagctcaccaccagaggatgcgaagtcagaaggaaccgtggaagaggcagaggagagccaggacaatgtgccaccttggaagccaagttgagaggggtgcagatgagaaggggttagtcaatattgtcttattctagaaagtggtcacacaggatgggagttgagaagaggcaacttagaagatgtgcctgacccttgaaggaaggatgtttcaggacagtagaggggatgaaattcagagtccaagggactgggctgagacagaagcagactctgggagaagtgaatatagccggctcttcaagtagcttagcagggaagagagggagataaacagcagtagctcgaggcaaactcaaacttgagagaggtttggggtttttttgtttttt

SEQ ID NO: 396300 - DNA, 612 bp, Homo sapiens
gggaagactagggtgggaggagcagataggggggtgataaccaagaattctgctttggacatgggatttttgagatgtttattcaaaatctactggagatattgtgtagacagttggataaatgagtacagaatgcagaaaagtggttgggcttgaaaatagaaatttgggagtcatcagcgtttcaatgaaactcattggcttggtaaacttgagtaattatagatcatgcagaaaaggcgagtctcaaacccataagacacatgggaaaccagaagatgctgaagatgtggtttgagaggcaataggacatagaacaattaagagtatggcctctggagccaaattatttaggtttacatcctaattctgctacttcctagctgtgggtctcatttctctcatctgtaaaatggaataatagtaggacccattacttacagacttcttacaggaagtaaatgatttaatatatgtgaagtacatcggacaatacctggtacattataaggagttatataaatgataactgccattatttgtaatggcattttaattgcattttcaatataattgaccactggaagtgaataaaattatttagagggactg

SEQ ID NO: 396301 - DNA, 944 bp, Homo sapiens
acgtggggattacaattggagatgagatttggacagggacacagagccaaaccaaatcacttcagacaaaagtgaagcaaattaaagtccatcccgccatccttccaaagagcaaagaaagtccatggaaattcatcaacatccagggtttcactcgcccaggatggggggactggcgcgatctcggctcactgcaacctccacctcccacgctcaagtgattctagtgcctcagcctcccaagagactgggattacagatgtgtgccatcacactccactaatttttatatttttagtagagacagggtttcaccatgttagcccgactggtcttgggctcctggcctcaagtgatctgcccacttcggcctcccaaagtgcttggattacaggcgtgagccaccacacccagccttaaccatctattactaagcggaaaaaaggaagaggaaatttggacacacaaagtgacaccacggctacagatgcataaaggaacaaccatgtgaagacatcttgagaagacgatcacctgcaagccaatgagagaggcctcagaagaaacgaaacttgtcagcaccttgattttggacttccaacctccagagcagtgagaaaataaatttctgttgtttaagccagccaatctgtggtattctgttatggcaccagctttagcgaactaatacacgtaataaaatgtaaagaaaacaaaaccaatgtaaataacattttctaagttccatctaaataaagttttccagccttccaagatgaatgcttacaccacttttttagaaacccgctgtcttgagtttagatcttttgatttcttcaactgtactgtaaaaggttttccttaatgtcttcacaggatgtgtttagctttcatacattctgagtctataagaccattcccagatgaaacactgagacggtgac

SEQ ID NO: 396302 - DNA, 659 bp, Homo sapiens
tatttttcaactttgtcacatcaagacttaattctccatctatatagataaaaatgcaatggagcttaaaaaccacaaacaacaattatccatagattgatgagcaacatctagagcttcctgggaataagtcaggcagtataattcattagtgcagagttaatgaatcatgcaggttggaaaattggtaacaatttaatttcatcaaggataatactttaaaactgcacgttatggccgggcgcggtggctcgtgcctgtaatcccagcactttcggaggccaaggcaagcagatcacctgaggccaggagttcgagaccagcctgaccaacatggagaaaccccgtctctactgaaaatacaaacttagccgagcatgttgccacatgcctgtaatcccagctacttaggaggctgaggcaggggaatcgcttgaacccaggaggcggaggttgcagtgaaccgagatcgtgccattgcactccagcctgggcaacaagagggaaactccatctaaaacaaataataataaataaatagataaataaataaaaaataaatacaactggaatttacaatgaaaatgtttccaaaggacataatgaattgtccccattatactttcaccatttatgtttaatatacttccatctcagac

SEQ ID NO: 396303 - DNA, 405 bp, Homo sapiens
ctgtgcagggagataggaaatagacagatgagagacaggtgtaaaaaggaaacttatttaccaagtacctttgaatttttaaccacttaaatatattacctattttaaaaactgaatttaaaaatttaaatgttccttaaacaattatttgtagcaaacagctgaaaaacaagaaagccaaagaaaggaggtattagaacgaagtaccaagagacaaagaaaatgtaaagtagccctgagaagtctgaggcaattcaaagagaggatgattcagattgtttgcagggaccagctgaaaaagtcagtgtgaaacccaacaaggacctcagatacttatgatagccaaaccagtaccagctggaataaataacagtatctcgaaaacgtggtgcacaacttttaggg

SEQ ID NO: 396304 - DNA, 445 bp, Homo sapiens
ccaaaagaatgagatgttatgtttggcctaggcctggatcacatgtatcgtaaaggctaggatggaatcagcctcagtccagtcccagagtctaggattgagaaaaggcagcagtagggagctgctgaaagatttatcaagagcagcatggtctgatttgcatttcataaagatcatcctggagcagtgcagaagacaagttacagaagttcaagcctggagggaggtacacctataagaataagggaggagaccacccctcatattgtcttgtgctcaatttctgcctccaaagaaagaagtaaaaactaaaaggcagaaatgaaatcctcaagcagacagcccagcgccacaccctgggcctggtacttaaagatcgacccctgacctaatcagttatgttatctatagattacagacattgcatagaaaagcactgtgaaaa

SEQ ID NO: 396305 - DNA, 376 bp, Homo sapiens
ccactcctcactcctcagagaagtactgaagctagctagagatttctgcagggtgtggaatggggagaaaggcagcgtgactgtgtgtcacatttgtttctgacacctttttgtaggtctgaaatgcttttaaataaacatttttaagtaatatatacgtgacaaaaattcaaacagcagcaaagtacagtgaaaagtcctccctcatccccagtgccctcccaccccaggtaatcacagttaccaggattcaatgcacatccaaacacaaacaaacacaaaccatggtgtgtttattgcccatggaggctctgtctcaggtccctgggaatcattgggagttgtggatcccagcactttgggaggctgaggcagg

SEQ ID NO: 396306 - DNA, 454 bp, Homo sapiens
ttgaagaacacattaaattagctctcacactgtggtgtggacttctttctgttttccaccagtgttcttcagggtgatttttccagtgggcttgattaggactgtgtggatcattgtgatgctttgttctcagtggggattttccagcaaagatgagcttcattaaacaatgactgggttcatggatttataattggagtgattttcttcaaactgtaataaatttcagtgttacctttttctgaacgccctttttaaaagggattccatagcaagtcttctggaataataccttttatataattctttaaaaactgtaatttttacatactgattcctgttaaggcagatgttattgtatcaagaaaagactcaaattttgaacatattaaaaatagtgtttcttcagatctggtggataggtgatgctcaatatatatttgtttaatggaat

SEQ ID NO: 396307 - DNA, 520 bp, Homo sapiens
gaatttgtttcttggattctaagtgcccattaccccacttaactcatcaaacattcattgtaagagctgggccataaacagcagcgaccgctatgcagagatatgagagcatggtggcttttctccagcatcagtttctagtccagagaagttctgtcagattgccctgctcccttggaaggagggtctgaagcataccttattactaagaattaaaaattgcagagtttgtgaacacctttgacttttgttttctaagcatagatttggtatcttctgctgttctttcttgatggcaagaaaagaggggtgcaggtagaattagctgagtacagttcagagcttggctctcccttcagacagtccttagtttgaatgccagctttgccactagtcagctttgggacctcagacaggtgactttaattctgcaagcctcagatgccttgtgaagtacccagcatgatgcctggaacctcggaagtgcataataaatgccaggcacagttgctatccttac

SEQ ID NO: 396308 - DNA, 357 bp, Homo sapiens
ggcatttcagagatctttgaggcagcccctcccatcacaagcccagatgtctaaaaggaaagaatggtttcagaacccaggcctagggtgccactgccctgctcagccttcaggacactgctccctgcatcccagctgctcaggctccaccctcagcaactagggccccagatacagcttagaacacagctctggagggtgcaagccatgagccttggcagttttcaagtggtgttaaatctgcagatgctcagagtgcaagtgtgaaggaagcttggcagcttccacctagatttcagaggatgtatagataagtctgtgtgcccaggcagaagtctgctgcaggggcagagcccc

SEQ ID NO: 396309 - DNA, 480 bp, Homo sapiens
ttggaaataaatgaaatattgttgcctattgtctgccttccccactacacagtgaactttctgagggcatggttggtcttgttgtccagtgggaccgccctgctcactgtgaatgaaaggatggatggatgaaaaagcaatgaatggatggacgtgtggatgaatagatgaaataataatagatgtatggatggatgaatagatgggcaaatggatggatgaatgtgtggacgaaaagatagatgaaagaatggatggatggatggatggaataatggatggatggatggatggataggtaattgtactgatgggagaagacttgtcttgctcccatcagccccctgagtagctggggttataggtgcacgccaccacacccagctaatttttgtaattttttgtagagacagggtttcaccatggtggccaggcttgctctcatactcctgacctcagtggtctcctcctcacctccca

SEQ ID NO: 396310 - DNA, 854 bp, Homo sapiens
atttctgtattgtcaggggagatggggttttgccatgttggccaagccggtgttgaacccctggcctcaggtgatccacccacctcagcctcccaaagtgctgggattacaggcatgagccaccccatgcccagctggaattttttaacttaaaaaaaaaaagtttcagtgtttgtccttacccattatgtgcccagttagttctataccagtgaaagttccccccaaaagaaaaagaaaaagaaaaaaaagactgtcattttcttgagcagctttcttgagctctgtgtgtgtatgcctatgtctggggcatacacaaggactctggcaggcccactaaactctaccacgtagttgccagatatgctgtaaactgtcacctggaagttgggatttactcttttatttttctgtttattttgcatgagtactgtatgtataaaaaagtagccacatatggatggtcaaagggtttcctagaaatatggatagtcagagggcttcctagaaatatggatggtcaaaggtatcctagtttttcaggtaaactccactagaaaccagaaccatatcccaattccatagcctttattatttcagatcaatagaagcagaatcaaaatgcatttggagcttagaggtcaattgatttggaaaccactccggtgcaaagaatctctagattcattgattttggagtattgtttgaggggaaaagaccctggttaagacagttttagggaatccagggtgtacatcaatgcgttattcacaaatttaaacaggtaatactgaactcatttgctagatttgacacagaacttgaagactccataatataccttgtcagaagc

SEQ ID NO: 396311 - DNA, 433 bp, Homo sapiens
gtctagcttctgacaaggtctgaattacttaaaagtgaaataaggatctgagaaaatacaacgtaattttgcaaggtagaatgattaattgataaatgagtcaaatcctggttgtgttttcaattcaaacaaaacagtgtcttcagggactgcagtgatccaagaagactgcagaggaaggaaaatttgcatttaaccttatagcgtggaggggaattagacatgaggagaggagatacaggaccatagcatgggagattacttcccacttgtagaatgagactattaccacttgctaactacacgacctatcatgttttcctgattggcagccagactgttctctgtcttttgtacataaacctgcctggggcaatactggtgccacctcccagtcaaagtctaatccagagtgaacaatccaggctaacac

SEQ ID NO: 396312 - DNA, 231 bp, Homo sapiens
agggcacatgtgtgtaatacgtgcatgcgtgagtgtggatgtgtgtgtgcacatctgtgtgtgggggttgtgtgtttgtttgctgggaccaggccctgacgccctctgcacttagggttggctgtcttcgcaaagcctggtcagtcggggggagagggggagcctcctgtttcttagtgagaagctgaggccggggaggccacatgacttagctaaggtcatagatctcaa

SEQ ID NO: 396313 - DNA, 681 bp, Homo sapiens
  misc_feature (525)..(525): n is a, c, g, or t
  misc_feature (527)..(527): n is a, c, g, or t
  misc_feature (576)..(576): n is a, c, g, or t
  misc_feature (586)..(586): n is a, c, g, or t
  misc_feature (605)..(605): n is a, c, g, or t
  misc_feature (609)..(609): n is a, c, g, or t
  misc_feature (642)..(642): n is a, c, g, or t
  misc_feature (652)..(652): n is a, c, g, or t
  misc_feature (675)..(675): n is a, c, g, or t
ggatttgtcctggcctcacttcacgtgcttataggcccctgctaagtggcgggcagtctccaggacattaaggacacagtggtgaaagacactagcccaatctatagagaacttcgagacggaaatagacaaacagctccaacaaggcaaaggaacccatcttttacttcggtgatgtggaatactctgtggatgagagtgctggctatgtggaagtgcaggtgtggagaacgggcactgacctgtccaagtcttctagtgtcacagtgaggtctcggaaaacagatcctccctctgcagatgctggaacagactatgtgggcatcagccgtaatttagattttgcacctggagtcaacatgcagcctgttcgtgttgtcattctggatgaccttggacaaccagcgctggagggaattgagaaatttgaactggtgcttcgcatgcctatgaacgcagcccttggcgagcccagcaaagccacagtgtccataaatgactctgtctccgattgcctaagaagcnanttcaaagaacgaatatttactggccagcgaaagtgatgggccagatagntaccatgatncataggagccggggatgtnccgnacagaatctttagtggggagctacccccccccngggtcttgcncagggggatgatggacctttaanaacgcc

SEQ ID NO: 396314 - DNA, 362 bp, Homo sapiens
atctgcacaggttttcccattttttcctcacaccactgtggtaaagcagggggatctgtcacctccactgaggagactgaggctcacaagaggtgataacatataaaactctatcagtcatttatggagtggagcagaggctctcaaagttcagcatgcatcatctgtaggtgtataaacactaattgctgggccctgcccctagagtttctgattcagaccatctggttgagacccaaagatatgcatttctaagaagttcccaggtaatgctgatgctactgctctagggaccacagtctgagaaccactggtctggctaatagacaaacaaacaaataaacaaaacagcatttattctt

SEQ ID NO: 396315 - DNA, 305 bp, Homo sapiens
gggtgctaagacaattcactgggggaaagaatagtattttcaacaaatggtgctgggacaactagatatccatacggaaaagaatgaattagacagtcacctgcatctcacaccacataaaaaattaactcaaggccgggtgcagtggctcacgcctgtaatctcaacactttgacaggccaaggtgggtgtatcacgaggtcaggagtttgagaccagcctgatgaacatggtgaaaccccgtgtctactgaaaatacaaaaattagccaggcgtggtggtgcacacctgtaatcccagctact

SEQ ID NO: 396316 - DNA, 516 bp, Homo sapiens
cttgccttagcctcctgagtagctggcattacaggcatgtgccaccacgcccggctaattttgtatttttagtagagatggggtatctccatgttggtcaggctggtctcgaactcctgacctcaggtgatccgcccactttggactcccaaagtgctgggattacaggcatgagccgctgcaccggcatccctgtatccacatgctttgctatatgactttcatgccctcccattctgatgctgtgcttggccatgtgacttgctatggccaatagaatgtggcacaattgagaggcacatgtatgttcctgaagtctcccttatgcctctgctatcatcagatgcaacagtggagctgagacctccactgtcatcccagctgaagccaataccacacacatgttcattcctggccaagatcagcccagcccagtctgcattagcaaaacctcacagacccgtgagctaaatgaacatccattgtggaggccactgagctttgaaattgttgtta

SEQ ID NO: 396317 - DNA, 439 bp, Homo sapiens
gggcaaagcggaggggctgacccaagggcagtgtggggatgattactccacagcctcggggagagggcaaaagctgagaccaagttctgatggaaagatcaaaggtggggagtaggagcaacgaagagcatgactgaacaatgacggggtcaggccgactcggcactcagacacagcagagccattctctggagagactcttagggtggtgctgctgggactcacaggaagacttcagatcttaaatggatattctgcactgccagacaatcctagtaaagtcatgttcctacactgccttttaccctttaccgccttcccctcttctcagatctccacatccccttgcaggcttggctgatgatcttgtctcatatttcacagcaaaagcagatacaaatggtcaaggatgacctcttccctccactgatttcgccag

SEQ ID NO: 396318 - DNA, 418 bp, Homo sapiens
ctctaatctagcccatatgcttagctgagttttcttcatatcactttaaatgatgatgtcccttgttcaacaattttctaaacattctttagataataattttatgggcattctttattgcattaggcttaaatttaatgcatcttaaggttttattgcaaaatattgccttgtttcctttttaagatgatacaatttataatatgcaaatttgctgtctgtcccctccctttatgtacatagaaaatgagcaaacaggtggccatgaaacagatggtcatagaattgtttcagtgcttgtgagtgcagcaacccaagagtgtcttatctgaaataccaccaggaatgtctggacacagtagacaaaggtttttcaacaggatgccttaggatacatgcttccaaaaacaaagtagcc

SEQ ID NO: 396319 - DNA, 488 bp, Homo sapiens
tgagaatttctctatggctagctcttacacagaaaggcaagggaaggttagagtaatatttctaggttttatggctggctttgagagagagggtttctagtttctatcacctgccttagggaagaggaattctagtttctatggcctgccttgggagagaggggagcaggagagatggagacaggaaaaggtcagtaacatcttgcttctgagccccccaatgtccttcagttcaaactactcagcatgacaaagcaccaaactttgggatatcattttctgagccccaaaaagacactgcgtgattcagtttgctaatactctgtttagagtttttatatctatactcattagttacattgacctgacactttcctctttggtcctgcctttgtcttctggtcctgagggtttttgttgatccagataaatgttctgggcactaaggtagtgtcccctgcctatctagaccatggggtatcagacca

SEQ ID NO: 396320 - DNA, 462 bp, Homo sapiens
attaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgt

SEQ ID NO: 396321 - DNA, 498 bp, Homo sapiens
ctaaaatctagtccaatgtcatacaagtagagaacagtggtgccaatattcaaaatcagtagttttatgaaaaataaaatagaagtaataatccacaaagtaggcaatgaaactcactgctacaaattctggttcccacaacatgtggttctctccctaagtaggaaagggtctttatctggaccagggattcctactccaaagcccaaaggcagtggctggctctgcagctatttgaggttggtatattagttaggggcttcagctgatgatccatgcatggatgtaatatcacctagtgttttataagttattcttcctgcctccaggtgaattgtccatcccccattgtatatgatttggacagaccaccctctgtttgcttttaatatccagtatctgtctccatctctctctctttctttctttctctctctttctcagtgactgaaactaaggaaaacagggtcagataactcttttctattttctacaaat

SEQ ID NO: 396322 - DNA, 615 bp, Homo sapiens
tttcttattttgtatcccttaaaaaacaacttctgaaattctcgccaatcccccaaaaactcatctgcactagacaaaaactgcttcctccagttctttttgcctgctagttaaaaatatacagtcttagccccaaacctagacctgctgaacccaaatttctatggaagaggccaggtaattttcgtagtttaaaaagaccatgggtaattcttataatcaagcaggtttggaaagcactgctgtcttgaactcttgttctcagcttggttgcacactgggatctcttgggaagtttaaaaaacccctgatgctggtgcctgctccccatcccatgttctggcttaattggaaaggaacaagtcctggacatctatacttttaaggctccccaggtgaccctaatgtgcagcagagtttgagaaccactggttttctgcaacctcatgcaaatattgtcccagatgtagatgggagaaacactgcaggcatagctgaggatataattggaagaaaccaaaaacccttattatgcaaatatttgccctaataagtctgcctgcaaacaaatataacaaagccaatttttcttcaaaaataaggagtcagcatcta

SEQ ID NO: 396323 - DNA, 378 bp, Homo sapiens
atctcttctctgttccctccacactcttcttttgctcctcttcctgtatttcagagtggttaagatcatggaagtcagacaagctatgggctctctccataatgtcactcacttcctaggcttgtggtgagtggcatatgaggtaatggtgcctggtgtagagtaaacactaaacacacaatgagtgaatgatattacagttttcttatttaaatccttattatatatatctttatccccattaagtaaacaaaggacaactgagaggctcagaacatcaatgtcattgtactcaagggtaagcagatgctaacaggcagaaccaggatttggaccttgatgtatataataataaaataatttttcacatgttttaac

SEQ ID NO: 396324 - DNA, 459 bp, Homo sapiens
attttccagattgggcctggcttttcttcggtcagtgtgctgaattagcactacaaaacgtcattagtggtgtgtgatttagtgaagatttttagctgaagattctgtcagaaggagttaatgtcagttctaaaattgccaagtttctgcctggagagttgcgtacacattgaacattgagaccattgacttcactactggttttttgtttttctttcttttctttttttgtttaagatggagtcttgctctgtgacccaggctggagtgcagtgacgtgatctcagctcactgcaacctccgctgcctgggttcaagcagttctcctgcctcagcctcctgagtagctgggattacaggcgtgtgccaccacgcctggctaatttttctatttttagagacagggtttcaccatgttggtcaggctggtctcgaactcctgagcttgtgattcacccg

SEQ ID NO: 396325 - DNA, 231 bp, Homo sapiens
tttatgccctttggcttgctgccaggtgctacctttcacccaaaagaaccacaggctcctcacggattttgcattccttcagggtcctgccagttactggcaaattcaatgataattgtgctcactgtataaaatactttctggaataaggtaaaatatgaatgaaaaaatgcacaaatgccaaacaaatacagttgcttgtgctgagattttgttttaaagaagaaagag

SEQ ID NO: 396326 - DNA, 469 bp, Homo sapiens
tccctctggccactgagcacacagattcaccccaccctgtgaactcggggactgtgccacccctgctctcccacgcccctttccctcacctgggcagcattcacatgccacctgtggtcagctctcagagactggaaggcccctcctcagctctccagagctgtttctttatggaactccctcttcttccatatttttctttgtacattccagccttcctggagccccttaactccacactctgtctccaccaggtcctggttcccctccctgccctgtggctggagactctgcaggtgacacgctgggctactgaggcctcacttccctcatgcccctctctggtcactgtccacacggcctgccaccagtgtctgaagcctgtggcttcatgcacttttgtttggctttctggttgattaaggtaggctgtgaaatttggtctgtatcttccaccatggctagaagt

SEQ ID NO: 396327 - DNA, 621 bp, Homo sapiens
aagttcctcactggggcctgtaaagcgccataggatttgggcccagtgaaccccatgtccaatgtcagccctcaaagcacagccctgcccactcgccaacttctccctgccttaggacccctcctcaagcctggaatatgctcgccaggctctgtgcacggcagatgcctctgcttcccgcagtgtcagctcaaacctcgcctccctggagaggccttcctgagcacccagcaccagcccacccaatccatgtcctctgcagcactcacagtgtgcacgtgcgtgtgcacctgtgggtgaactctctgaagtgtgcccgtcactagcacaggagccccaagacctcccctccttccagggttccacagctgaactcacaaataaataaggacaggtgtgctcggcggtcaccgtgccttcaccccgcaccatggtcacgaccgtgcttgccatcacagccccatgaaggaggtgcactggcccaagtcgcaggtgaggaaactgaggctcagacccgctgtttcttgccaagggcacaaagcccatcctccgaggcagggctgggttgcaggggagagctcagcccaggctgcccctttctgctggagacacctggccccg

SEQ ID NO: 396328 - DNA, 659 bp, Homo sapiens
atggatgggtgggtggatggacgggtgggtaggtgggtgggtgggtggacaagtcgatggtgagtgaagagacacatcaggctctgggcatagctcaatgcaaaggagagaaagcagctagtttaggggctcagttcttgggcaggtagaaggtcatcctggtttctagtccttgtagcagcagcactgtgcctgcacagccctggggcccctgggcatgactgagtgacagcccatcccatggtacagtaactcatgcatgtcaagtaccaagcccagggcccatccacagcagcatgtcacacctgtggatgatgaaaatgagtctaagtctagtgatttggtctgtttctctatgcagacagtgtacaagctgcaggttcacacagtgctggcctgtgcggtgtttcacaatagtcataaacactgaaaagtggaaagactttgcataggatgccaatatttatctagatgttattgaaaaaaacatagggagatacaattccagaccctcattctcacccagtaaaccctcagtctcacaggtgggtggtgggtggaggtgacctcctttccagaggcctgtgctctccagtttgccacagtaccccgcactccctacacggcgcccagctgggaagagtgtccactgccatctc

SEQ ID NO: 396329 - DNA, 620 bp, Homo sapiens
atgacattaggcgcgtctgcgtcctcaaatgagagggaaaaaactccgctagcgaactcagcacatggaccctgacagcgaacgtgccgagtgcccatgaggatgggcaagtcacaggcattcaggggccatcccaagggttagactatggagaggaagccagggactcctggctgcaaattcgtctgctagtgggccaggcttgaagggcttctgccacaaaacagcaacttcatcttgccccaattactcttaaacttgaaaccaaatgtctttttaaaataccttggtgtttctattttatcacgcactttccctccgtctgaatgaatgtgattttaacacatttacatggcatttcatggagatgtgcctgatctttgttggtactaagtttctacagtacctaagatttcaattatgtttccagaattaaatagataccagagaccctgccctaaagaagttacagattatgaagacgcaaaccgtcactaagccagctagggaagaacacacctttgatcttcagaggagcttatggcaaacactgggacagcccgctggctccccacaacacacacagcacgcagacgcgcctaatggtaccgagctcgatt

SEQ ID NO: 396330 - DNA, 645 bp, Homo sapiens
atgacattaggcgcgtctgcgtcctcaaatgagagggaaaaaactccgctagcgaactcagcacatggaccctgacagcgaacgtgccgagtgcccatgaggatgggcaagtcacaggcattcaggggccatcccaagggttagactatggagaggaagccagggactcctggctgcaaattcgtctgctagtgggccaggcttgaagggcttctgccacaaaacagcaacttcatcttgccccaattactcttaaacttgaaaccaaatgtctttttaaaataccttggtgtttctattttatcacgcactttccctccgtctgaatgaatgtgattttaacacatttacatggcatttcatggagatgtgcctgatctttgttggtactaagtttctacagtacctaagatttcaattatgtttccagaattaaatagataccagagaccctgccctaaagaagttacagattatgaagacgcaaaccgtcactaagccagctagggaagaacacacctttgatcttcagaggagcttatggcaaacactgggacagcccgctggctccccacaacacacacagcacgcagacacacacaaacacacacacacagacatcggacacaggtacacacaagcaga

SEQ ID NO: 396331 - DNA, 389 bp, Homo sapiens
aacacacacaaatacacaccagcagacacacacaaacacacacacagagacacagacacacacagatacacacacagacacagaaacacatttacatggcatttcatggagatgtgcctgatctttgttggtactaagtttctacagtacctaagatttcaattatgtttccagaattaaatagataccagagaccctgccctaaagaagttacagattatgaagacgcaaaccgtcactaagccagctagggaagaacacacctttgatcttcagaggagcttatggcaaacactgggacagcccgctggctccccacaacacacacagcacgcagacacacacaaacacacacacacagacatcggacacaggtacacacaagcaga

SEQ ID NO: 396332 - DNA, 201 bp, Homo sapiens
gacctccaagctactgtttatatatcaaggggtttatttcttcagtatcttaacttccaaaacaatagtttggatagtgtttcaatgctaatgtgacatgagcagacatgttgtatgggttcacaatattaattagcattaaccatagtcaagtaagcttcaagtccacgaaaacagcatgaaatgttggtgtcctgacct

SEQ ID NO: 396333 - DNA, 330 bp, Homo sapiens
tagctgggattacaggcgtgcaccaccacgcccagctaatttttggtatttttagtagagatggggtttcaccatgttagccaggcttgtctcgaactgctgacctcaggtgatccacctgcctcggcctcctaaagtgctgggattacaggcgagagccactgcacccggccattgattttttttctttatagatcattgatgtcaagtctaagaattctgtgcctggtcctagattctgaacattttgccctattttttctatatgttttatgattttaggttttacctttaagtttgcatccattttggattgatgtttatataata

SEQ ID NO: 396334 - DNA, 210 bp, Homo sapiens
caagaggatcgcttgagctcaggaggtcaaggttgcagtgagccatgattgcaccactgcatgtcagcctgcgtgatagaacaagaccctgtctcaaaaaataaaaaatgacaataaagattgcttgttaaataaaatgtgatttatttactttgcataaatactatgccttctgagaatgctgtaggtgcgggcatattttgtttttat

SEQ ID NO: 396335 - DNA, 317 bp, Homo sapiens
attagttgtagggcctcgggcaaaccacctaatctgtctcagctagattttattttattttatttttattttattttttgagacgaggtctcactctttcacccaggctggtgtgtagtggctcgatctcggcccactgaaacctctgcctcctgggctcaagcgattcttccacttcggcctcctgagtggctggaactacaggcgtgagccaccgcacccggccaggcagtgcttctcagcgccttccttcaagtaaatgagactcagagcccagagcccagtaagggaggcgacacacatagttcagcgtctga

SEQ ID NO: 396336 - DNA, 337 bp, Homo sapiens
accatctctactactaaaaatacaaaaaattagatgggcgtggtggcaggtgcctgtaatcccagctactcagagggctgaggcaggagaattgcttgaacccaagagatgaaggttgcagtgagccgagatcatgccattgaactccagcctgggcaacaagagcgaaactctctctctctctctctctcgctctctctctctctatatatatatatacacatattcatttgatcattatactaggttgaggatttaagttctttccaaaacatttatgtaaggccgttgatagatggtgagaagtcttaatctaagtatcaacgtattttctaaa

SEQ ID NO: 396337 - DNA, 743 bp, Homo sapiens
ggctcactgcagcttcaacctccctgggctcaagtgatcctcccacgtcagcctcccaagtagatgggactacagacgtacaccaccacacccagctaatttttgtattttttgtagagacacggtttcgccatgttggccaggctggtctcgaactctggaccttaggtgatctaccctcctcggcctcccaaagtgctgggattacagacatgagctacctcgcctggcctgattctaaatttggctgttgtgaatagtgctgcagtaaatatggagtgcagatatctctttgatatgttgatttcctttcttttggatatatacccagtagtggaattgctgggttatatggaagctctatttttagttttttgaagaggtttcatactgctttccgtagtggcagtactaatttatattcctaccaacagtgtacgaggtttcccctttctccacatcttcatctcatgacactacttcagagggttcttgttacccataggatatgttagtgtctagccaaacattgtgtcacaggtgcttaacattatttctaatactcacaacagtactaattattattatggtgggctcaatgagttctgttaagggtccaataaggtcttggagatgtttgaactagaatttgaaggatgaacagaaaaaagggtagcaaagttagggggtggtgtgtgtgtgtgtgtgtgtgtgtgtgtgtatgtaagggtagagctggtagg

SEQ ID NO: 396338 - DNA, 479 bp, Homo sapiens
tctgatgaatccgaggaagatgagtttgcctctggctgatgtagtaacatgtggtatcctgccattcacatcactgtgcttgtgagtctgaggggcaaatttagatccccccaagatgattcctccctatgggtacttgtggtcttccctaagcatcacgtctttggctcctccatgagccacgtgccttttcttcaaacggctgcacagattatgtgcgtaacactatgctttaaaccactagagagtgatccaagagaacatataattaagtgagaaattgtttggcataaactaaaagtgctacagaaattccgagagaataaggatcactgtggtgggcaattatccaaggagagcttcctaaaggcctatggtgttaagagggaacttgatgtctgggtaggatgtgggtgggtggaaagaaaaggaaggcattttttttttttctttgagatggaatctcactcagtcgccca

SEQ ID NO: 396339 - DNA, 606 bp, Homo sapiens
  misc_feature (534)..(534): n is a, c, g, or t
tcagtgttcattgagttgttctaatgtgacgtttgttcttatgtggagattttcctataaggtatttaaggctgaagttgggagcatcgtagaatgcaagagtttgggaaaaactggagataccagtcaagatggagaaaaggatggagttcaagggtacctgggcttcctgtcttcactgtgaagatggatttcaccatgagatctttactaggcagaaaagatggaacatcctgcagtagtgttttgtcatcgagcccacagccgaggccgaacagaagctgtatgttgttcctcaatggttgtgtccaaatgggaatgagtaagacttcaacatttctgaagatggatggtcaccattctcaattctgttttatgtatctggtgggccgttgagcagaagagatcccagatgtcaggggagaagatattaaattcatgtaagtggaataaaagtgtcatgaatggacttttcaactactttctctacagcttttcatgtaaatcagtcttggtgctgaaacttctctaaanggaattgtacatttcttgaaactgattccttattccctcttggcagctaatgggctcttaccacgtttacat

SEQ ID NO: 396340 - DNA, 677 bp, Homo sapiens
aaagtcttgtgtaatactatttagtacaaagcaattttttttatattctctccttattcaagaaagacttaagttcaatgtgaatgatatgagtacttccaggagataaaaagttgacttcagaatttcaatggcctctgtgacaattgcttagaatccttgctgtgagttcatttgactttagcatcttttttgaggctactttttggacagctgaaattctgtgttgcataaagtttttcctttttctctgaagtctcttaagggaagaatatatattttttttatcatgtgttcagcatgttaatcattttggtataagtcatttagctatagcaaaacaaaggtttaagattcattagatgaacttagatgaccgcagggccagccgtctcgctaaccataaagactacaagcagaaaacacttgtaggtgtaagattgtacatgtgtctcctgccataactactttcagtttaaaggacaaagactttcttccttatttgcttttagaacacgtgtattacagcctatactctgttggattaattgcccattactatttattgttcttattttctattttaaagtggcagttactttgatactgagaatattttgggaacagagcaagtttatgtggtaaattctgggactttagcttttagtatcaaagaa

SEQ ID NO: 396341 - DNA, 343 bp, Homo sapiens
aggttgcagttagctgagattgtgctgttgcactccagcctgggcgacaagagcaaaactccgtctcaaaaaaaaaaaaaaaaaaaaaaaaaaaattcagtgcagtaccaggcactgttaacactagctgcatgttctatgacatggacacaaaaggacatgagtagactgaggctcaaacaggttaagttgctgcccaagattgcacagtggcaggcactcaataactgagcgccccttcctctgaaatcacattagtgttttctgttgttctctcactgtctcaaatgcatggatcctgtttttcctaccacactcggagctctttaaggaaagaacagta

SEQ ID NO: 396342 - DNA, 419 bp, Homo sapiens
tctattgagaaatattcatttgtatgaactattatttcatttattagtttatctgctcaatacatattgattcacagatatttattaattttaaaacactaaactgatccaatattctctctctcaaaggtcttcaatagtacctcattttcctgaaaaacaaaattcaaaacccatttgcttaatgttttgttttatccgggaccttgtttcaaactaccttcactgtatttttatctttatataccacctgtcttttagataaactagatttctcatctttctaccataattttacttatgacatttcttccacaggggttgaattcccatcctcgcatctatcaaaatctcagcctgtattttccagatcaaatctttagaggcaactttggccaggcgtgttggctcacgcctgt

SEQ ID NO: 396343 - DNA, 541 bp, Homo sapiens
acctcctaccccacgattggaatcagagtttatataagcataatatactcagtgaagtgttttatctgccacaaacactgttctatttttataccatcattcagcatgcattcactaagcacccatcacaggtcaggctgcgggtggtaggagggataccaagaagaaccctgtggtcctttccagtcctttcccttcaaacagctcttaatcccatgaaaagacagcatgtacattatactgcctggtatgtactgtaataaaaccatggacaaaggccatggaaacacaggggataaaccagccctctttgcctaccagagtcaggagatccctggcagagcaaatgatcacccagttgggtcttcaagtctagttggaggttatgagctgggggatgaggtgagatgctccccatagaagggaggagaatatgcaaaaacttggcggagctggtacatttggagagttgagtgattgcaggggaccaaaggggctgtagcaagaaatgagactggaaaaataagtagaagcttataaa

SEQ ID NO: 396344 - DNA, 823 bp, Homo sapiens
ggtccctggcagcaggcatctggggcatgtagctgcctcttcagctgtcctgccaacagaagaaacttacctcccatcatctccctgagtgcctgcctcagccgccttgtatgtattcattgctgtgtctataataaatcagcgggtccttgctggaagcttggacgtttcaatggagagctttccaaacacctacagcacccttttgaatgcaactggaagtattggtgcctcaggagctacacaagcctgaaccacctgctacttaccagattctgggaaatccaacatcaaggtgccagctgaaaagtttcctggtgagggcactagctctggtttgcagatggccaccttcttgctacaactcaaacttgcaccaccaagcccttgccagatggcagaaagcagggcattggaaggtatttcctccctgttgagtaccagctccacttcaccagccaacccatgagacagtgttctacaatgccacaaagacaaatagccacatgcgtctcccatgtacccggataccaccttgaagggaagggacagaactttgaaagatattacatttcctgaagttatcaaagcagagaaaactgaattatctgatgggacagttaaaactattggattggactgaaatggcaagatggaactaagctttagttcttttcccacatcccagcaagaagaaagtaaatcagctcttctatagacaaaataacaaagctcacattttctctgtatacataaggaaaggtgagggattttggaccctgaaacatgagtttatgaatatacacatgcatacatccatttg

SEQ ID NO: 396345 - DNA, 454 bp, Homo sapiens
gcctaatcctgctcgctctcaaagtacacttaactcttaggtgtcctcatcttcttcatgttgtgaatttgcagccgtttgtgtttgattcataacggacaatatcccatgacttaaaatgcatacagccctttctctacctaaaaataaaacaatgacatttgacgctactatccaaaaaagtttaatgaaacatgacctgtgaaagtgcacagcccctggattacagctttaatgagtgttgagagtggtggacctagttgccatctggaatcctcagccaatgttctgaataaactcacggaggcatgcccgctggttgggtgacagcaactttcctgtaacatccccaagatcgcctccgcaccagtggcccctcagttctccttgggagtcacggctctctctcctcatcccatctcctgtctcgcttccacctgagcgatcagagaaa

SEQ ID NO: 396346 - DNA, 339 bp, Homo sapiens
catagttctttcagaataaaagtgcaagccaaattttggattaataaaaatacattttagacagagtcagaattttttaaatgactttttaaaagcaatatttttgtatttgcaaatctgtttatttgtgagttactaatatgtactccttaactaaatatatgtcataatgtgtaagaaaatttgctgttgaatttactctagttgtttagatttcatttggaaaagttcctaagtcctttatgtttctccgaaagcaccttacactttgttgtaagattctcattagagaatttagatttaaatgtgatgtcaataaagtcattaaaattgttcatt

SEQ ID NO: 396347 - DNA, 974 bp, Homo sapiens
atcccagcacttttggaggccggggcgggcggatcacctcaggtcaggagttcgagaccagcctggtccaacgtggtgaaaccctgactctaccaaaaatacaaaaattagccaggcgtggtggtgggcgccggtaatcccagctgctcgggaggctgaggcaggagaatcacttgaactcaggaggcaaaggctgcagtgagctgagatggcgccgctgcactccagcctgggtgacagagagtgagactccatctcaaaaaaagtaaataaataaataaaaatgaaaataaaataaaatgtatccatgagcaggaatcaacctgtgcccagccagggtggtgcctagaggcacttctgtctcttcccactcgactctaaggagtactgctctctgtgacgtcagcacccagcacagggccctggcacgtggcaggaactcagtgcgtggtgaatgaacgactacatgaatgatcagattatacacagcccagggaagtgccacatagaaggtgtctccaggaatcagccggcatgctccttttagaactgcagtcacatcatagcccttcttggcttagaccctcctccagctcccaacccatccagagtacagaccaaagtcttccccacggccctcagggctctgcacatccagcccctcagttctcagccctctcccctcacttattccccttccctcatttcccacactgggctccctctgtccctcccacgtgccaagcaaattcttgtctcagggtcttggcacttgctgtttttctcactcaggatagacttcccacacatcttcacaaagctttataaatctttgctcaaatgtcatctcctcagagaggccttcccaaaccacactgtctaaatcggcacccgcccttctccatctcctactctgtatgggggatctcgagatgaccccatacagagtatcgcagagagatttggggatcctg

SEQ ID NO: 396348 - DNA, 628 bp, Homo sapiens
ctctctccccatattgttcgtatctaagagactttcaagattttctgacattttggaatcttgcttcatcttcaaggtgaaagatatatttgagtttagcaatgccttaaaatggtgtgtgtgtgtgtgtgtacatatgcactgaagtttgaaagtcgtaatataaattgagaaaacaaatattctttaaacattctatattaagccccttttctgtgcttttttcagaatctcattgtggtgctaaaatttctgaaggattcaatgaaagcagatgacaacacaactactttcagcacacttaatgtctgcttggaaaaagcaaatcaaaacatgaaagagatgatatataaaatacagtcctgaatgcattcacatgtaatttacagagagttgagatcatgaaggaaggaagtagacactgtcggaaatatctaagtttacagaggatacttgtacagccagggttttgtgaaagaattaataacagaagaattatatctataatctattggccgggagcagtagctcatgcctgtaatcccgacactttgggaggccaaggagggcagatcatgaggtcaagagatcgagaccatcctggccaacaaggtgaaaccccatctct

SEQ ID NO: 396349 - DNA, 315 bp, Homo sapiens
ttaagttaatggtttagagtcagccttgaattgtgcctcttcttagctcccagcatttatcatgaataataactcaaagatggagccagtatcttcacatgcaatcatcatttcactgtgaaatttcaagagtgaagctaagtttcaccaaggaaatgtacttcagatttcatcaattgatggtgaagatttcctcatataatgaatataaatctattatacactccaaacaagggcaggcacatattataggccaagcacgtgcctagaaaaaagtccctctctatagtactttacacttgacaaagcaatttg

SEQ ID NO: 396350 - DNA, 464 bp, Homo sapiens
ttccctttaattgtgcctgtttgtaaccaaagcacaagtaacttcttactaatgtggtaagagctttatacagggctgatctgcaaagcagaactggtttgtctggaactttctgaggtggttactttctaaagagtttataggtggaatctttttcttggcatcattgaaccatgaagtctggtccttttgaggtctatggcttggttgttgatttaaccctgctctgatgttgtttccatttctaaatcacactcatgtactgaaaattatatcggttccttgaaattgggcagagttgttagtttggcttttttcaaaactagggtgggactttgccttgcgtatatttactggccactaacaaagaagggtcaggagcaggtctgtcacatccttactaggtaaaaaaagtccgttctttcacagctggtatccaagagagggtcttaattcacttccaa

SEQ ID NO: 396351 - DNA, 227 bp, Homo sapiens
gggggtacagggtctctccttttgaggtgataaaaacgtcttggaactagatagaaacgacagctgcacaacatattgaattcactaaatgtgactgaattatatactttaaactggtgaatattatggtatgtgaattacatctcaatacagtttttggttttggttttgtttttttgagacggagtttttgctctgttgcccaggctggagtgcagtggcacgat

SEQ ID NO: 396352 - DNA, 205 bp, Homo sapiens
tacttcacagagtcattgtgaagatggagataattctgtgtagtacttacagtgcctgctactctgtaagtactaaaaatacaatcagctgttatttttattaccatgtaatctaaagacatgaaagtcacacaggacaatgatgataatcggttgtccccatcctgtgtagacattttatagtcactttagcctgggttgtaaa

SEQ ID NO: 396353 - DNA, 469 bp, Homo sapiens
ggtggagtgcagtggtgcaattataactcactgcagcctcaacctcctgagttcaagtgatcctcccacctcagcctcctgagtagctgggactacagtgagattcctgttttcagtaaaggacatcatctatgaggaaccccaaaggaaggttcaggcccagccaacctctcccgacagagctccagccaccttcccttcccgaggaaataacccgaacttcagctgatcatatgcttgagtgaccagacatctcagttgaatgtcgccgacataatgtaaatcagcttctcagctctgtgctaaaggcccagcttttagaaattttccaactgcctgtggactgatacttctgtgaaacacaaagatgaaccactacaaaaataagatgtaaaatgcaagcataaatttttggatttaaacaaaattcctctgtcagattgatataaaaatttttaaacactctcaa

SEQ ID NO: 396354 - DNA, 1059 bp, Homo sapiens
agctcggttcagttccatttacctgcaacattaaattgatccatctaccaacctgcttctctgatacagcctcaggatacacattctgtctacaaggtgtctcaagctagatattcctatgccagcacaaattagacaatgcaaaaaggagctgttcccccatcactaggctggaagccttgaagtagctgccaaccttcactgtacttcaacccacaataagttggctgccaaatcctcccgtgttccccagcactgaagtctcaatctgccctttcctcctcctgcctctattcagagtcctgtgcctgtcctggtcatctcctcactgaaaccccacacctcttccagctgcccttagtttcctcctattgctataacaagtatccttccagaagtctcacaaaagtttctgtctatatccatgtacaggtgccagggagtcagcctccattcccctcccacttaatcctcctattgtcttccactgtccacatgtggctattgcaattaattaaaaatccagttcttcagctgcactaagcacattttaagtgctcaagggccacatgtggctggtggccaccctactgaacagtgcagctgtagggcattccacttttatgcatttatcccccatacatttatcaactcaacattttatacaacccaacacttttatcaacagcgcagctgtagggctcaggaagttctactggatagtacagaacctatcccctctggcaaacctattcaattcccacaacaaaatctatgagagtaaattccatacccaatcagccctttgaacctgattttttactaagacctcatgtttcaattttaaggaggtcctaaaatattcctccctgagatccaccctaattttaaggaaaaggtatattacacacccgtctccctatcccacataaacatgacttccctttcataaaacttctcttctacgcagagtaaatatttattctgctcagctgttatgcatgagcatatagtcaatgtacttaacatgttgactattttagattgaatggttttagg

SEQ ID NO: 396355 - DNA, 138 bp, Homo sapiens
cccactatccaacaggtgaaggtaactacaagaaaaggggatggtagggtagggattttattgaattagtaaatcctttaaaatcaagtcaatccccaaatatggaaaagataattctctttccatgagagaagttga

SEQ ID NO: 396356 - DNA, 108 bp, Homo sapiens
gttaatgtctaacaactttgtaaatcaaggtttcatgcatttttaaaaccaaagtgctaccacctgtattttgaagagtattgtcaacaaataaaaggtttccaaacc

SEQ ID NO: 396357 - DNA, 445 bp, Homo sapiens
gacagtatagtggatatggctgcaagatgtttctaggaaacatgccaatatcttcagaaatccccagccctttcccctaaccctcctggctaaggaaagcactagcttatgagaaaaaccctaggaagaacaacacagttaagacaatgtagcagcagctgtgggtgctgtgtcctccattggattcgccaactcctaggagaaactctcacagaggaaatgggtcagcagtgatctcatggctctaaacagctatgaaatctgtaaggatatttctatccatgctacctgcatcagtgagtttaaactttaattgtagaaaaaagacaaaacattaatgcagtaattgatacagtatagtttggtgcaaagaaccctaaatccaaatccaggactcagtactttgaagctagtattttaaactttataagtgggtaaagtaact

SEQ ID NO: 396358 - DNA, 326 bp, Homo sapiens
tatgtctttatggaaatcttaataatgaattcagggctgtgcaagctgtgttttgcagattagctcttatgtcttaccatagtacttatcttttttgatttgaggctggtttactgagtcagattacctcttcagaagcctataatttgtaactgcatagttttgcaccagtcctacccttagctccccaaaattcccctgggcacatatacgtatattatgagcatggatgagttgatataataatgcactcaactctttggaaaacacaacagctgataccagagtacctgtgcatatataaaacacattttaaaaatagaaaa

SEQ ID NO: 396359 - DNA, 612 bp, Homo sapiens
  misc_feature (427)..(427): n is a, c, g, or t
  misc_feature (458)..(458): n is a, c, g, or t
ctagagccacatctaaagggcagggaatctccagtgtggttttttgtttttttgttttttgttttggagtcttgctctgtcacccaggctgtctgacaagtagaagacatatccactgtagcaaggaacactatggagtatatgagttagggaaaagagactgtgaagggaagagaacaaacattttgtagacgtttggtgttgaatatatgctatggaggcagtttctatagtttcatttacttcatgaggtttcattttttcttttctgagatggagtcttgctctgttgcccaggctggagtgcagtggtgtgatctcagctcactgcaacctccacctcccgggttcaagcgattctcctgcctcagcctccctagtagttgggactacaggcgtcccccccccccaacccccctttttttanaacaaggtgttaccttggtggccgggaaaanatttttggctggtcttttggtaatttttaaaaaactttaacaattaaaattgggaaacagggggacacgaagaccacacaaaacaaacaaagaaacaaaaagaacagaaacatcactcgcagaacgaccacagagctcagacaatccaacgcca

SEQ ID NO: 396360 - DNA, 346 bp, Homo sapiens
gaaaggttgttcaataattttatttatttttagatcttgatttgcacattaattttggtaaatccttaggtatgagtcttagttctaccctcattagctctattaccttcctcaagtgatttaaactttccacatgagtgtgtcatcatctgtaagatggggatttaactatcttacatggctgttaggaatagaagagatgagacccgtagaccacttagcatactgtccacttcagttcatgctcagtaaatgcaataacaatttatttgtctccttcctcagcctcatcgtccatcactgctctcctcccactttatgctctaggtttcatgggaagaaaggg

SEQ ID NO: 396361 - DNA, 451 bp, Homo sapiens
tatatttattttcatggaaagaggctagaccttaagtgataaagaacttttggttattactctttttttttttctaaaacaccacaacaatattattaccattatttaacactaaatactaagactgaataaattgttccagttattcctaaagaagccagtatatgagcccacttagaagagaatttagtccatttatagactggcattttaatatttaaaatagcattacataactggtatgctgctactccacaattactagagaatagaaaatttaagacgcttaaccacacagtactacaatctcctccaagtctttgtttttatgcattcagaagatgtattaagaaaaaataggaaatagtttacttatgagatctcatgcattgtgggcctgtacttgtgttgtaagcttccagctgggtttaattcttgagtgtagctagaa

SEQ ID NO: 396362 - DNA, 1361 bp, Homo sapiens
gggacggtgttccggcccattccggcccatttccacccccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtatggagttgtggatttagaactgctttggtggttggaggaattgctactgtgtatgaatagaaaataatg

SEQ ID NO: 396363 - DNA, 1469 bp, Homo sapiens
atccagtatcaccttcttcccaccccttaagtccgccccttttccccgcccttcctcgccattgtgggcagagacatgaccgtccacgtgatgccgtgctcccgccctcctcccgactgaggaggaagagcagagaggggagggggcgcgagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtatggagttgtggatttagaactgctttggtggttggaggaattgctactgtgtatgaatagaaaataatg

SEQ ID NO: 396364 - DNA, 385 bp, Homo sapiens
ccaaacatgagccatagattttttttcaatcaattactttcttttgcatctgttgaaattgttttttataaaactctgatttatatggtgaattcatttgattcagtttcaaatgttaaactaacatatttgaggtaaacctaatttagtcattatgtattatcctttagatatattgttagattcaatttactgaaatttggtaaggagtgtttcacatctatattcatgaggggtattgatgaatagttttttaataatgtctttttctggttttggtattgggataatgctggccttggggaatgaggtggaggtgttcgctcttcaattttctgcaaaaatttgtgaagaattaattatttttttcttcaattttgatgga

SEQ ID NO: 396365 - DNA, 351 bp, Homo sapiens
cctaacattagaaaggtatcacgtgtcgaagagcaggtgagatccctgtgtgatgtgagaacatggcaagagtctttcaaggtagcccgactctggaacaggacagtcacaccaaggagaaatgttggggtccttcaccttcacgtcaatcaggcatacttattgacatttggtggctgatttgcaaatcctttttgaagccaagcaatgacttagatgaccctttggaaatttcttacagactcctgagttcaatttatgtcatcatatcgtgattgaatttttgaaattcattttttcaaatgtttggacaggtatttttatctcaccaaaaatgaatacaggaatgtg

SEQ ID NO: 396366 - DNA, 583 bp, Homo sapiens
cttcccgaagtgctgggattacaggtgtgagccactgtgccctcctaaacaagttcttgagtaggaactagcagctagacaagatgcagtgactcaacagaggcaataataggaagttttgggtttgcagctgctggctgatgttttctaccctgtttcccagcaaggaaatcctggggattgtgagcgtgtgcgcagtgactcacatgaccacagcctccctggtttacagtcccagccctgcatacctgttctctcaccgacacacctatccgctcagtgaccacacctcacaatctcaactctgccccagccaccaagccatggctgccactcacacagcctctttttcactctgttgacagccacctccctcctcaaagcccatgtttcctgggagctgtgacttctctgccatcagctgtcaaatcctccgcaggctcttgcataaagcatttttcctgtctgcatctcagatttctgacctgtaaaatgaacctcaggctcactgctcacgcctctttgctgtgtggagcagtgaattaatgtctttaaggaacttgttgcttgttggatgaaagat

SEQ ID NO: 396367 - DNA, 343 bp, Homo sapiens
gggatttctgtctcagggaccagctctacctgacagtggaacctctgaggacagaggaaagctgcccacagcctaagcccttcttttccccagtatgcccgggcctctgaccctcctccccttttgtgtgtttcatcccacctgcttccagcaccagatgggcagcctgggtgttggtggggagaaggaagaggcattaagcatctcccaaacctggttttctagaagacgacaaatagccttctagtcctgagactctgccccacggacatgcctgtgcccttaaggcagagagccaccgtgtcctctgctgggtggcaggtatccagcctgaacccctctg

SEQ ID NO: 396368 - DNA, 175 bp, Homo sapiens
agtgtatatggatgagtcaacgtgaatgtgagtgtgtgtggggtgtacattggacaagcactgacatcacacttgctattttaattataaggcaccctccaaatttggatgcttcttaagaacctgctacttgtcttcaacttctacatgtggtcctttcacaagtcccatcacc

SEQ ID NO: 396369 - DNA, 257 bp, Homo sapiens
ctcctccaaagatgcccccacaacgtgggcaacttcaacccccatgagagctcagaattccacattcagcgacaaagttgacaagagcctctggagatctcaaagacttattaaaagtggaaatggctactgttttactgaggcagggtgaaaacacaactcacttcctaggatcgaacccagcaaattcactcagcccccaggtaactgaggactcagttgaaggaaaataattttgagcccctgaaaatagatgc

SEQ ID NO: 396370 - DNA, 171 bp, Homo sapiens
aacttttctttaaagacatctctgctatacacagacatggtaaaatttttgaattccaatggtaaagacaaaatcatacaaactttcaggaaaaatcagattgacaacaaaggaaagaaaatcagacttgacattattagacttctcatctgaatctctaaatgccaaaag

SEQ ID NO: 396371 - DNA, 432 bp, Homo sapiens
aataaggattctgtttttgttgagtactccatccttagcacctaaaacaatgttaaaacaactagatgatactaaaagcatattttttgaatgcatgaatgatcataatgaagaaaagcttactattttatccccttgcaactaaggaataaggaaggggaaaaaaagtccattttcaccttttgacctcttcttgcccttcaccaaaaactgagttccctggtgttttttctctcatatgctgatgtggtgcaaatagcctaggcttgagggtgagggtgaaggtcgagttcccaccctatgattgtatgctccattgcagctcttgacagtctattagaaatccataaccatagatacttctgcttctagggctttctttgtgagcctaagatttaactaccaacacctatgttgtcatgtggcaaaagt

SEQ ID NO: 396372 - DNA, 285 bp, Homo sapiens
gtgctaaacccagggggaagcagataatgaggaatgaacataataaggaaataaaccatacacgtatgttcaaaggtgatatgcgcaaaggagaaactggagcaggataagggggatcaggagtagggagggggctgtacttttagagaggctgtccagggcagggctaatgcaggacgtgacagttgaacttggaggaggtgaggggtgagccatttagaggtttgggagaaaaatgctctggtccatgcttgggggctttgagtaacagcaagggggccagtg

SEQ ID NO: 396373 - DNA, 177 bp, Homo sapiens
attaattaataaaaaacaaaaacaaaccagaaattttttttttttttgccaagtattgctgctgtacattctagtttggggactgctgacttaataggtaatagttagtggtatgctggtaaactgactcttttttttttttggaatttcccccgggggtccccgcccccaattccg

SEQ ID NO: 396374 - DNA, 268 bp, Homo sapiens
tgaggtcttgaagatgggggcttcatgatgagattaggaccattataaaaagaccagagaactggcttcctctctctctgccatgtgaagacagcaagaaggtagcctccttcaagccaggaagaaagccttcaccggaacccgaccatgggggcaccgtgatctcggccttcaggccaccaaatctgtggtattttgttatggtagccccagccgaagaagacagacattcatccaactggggtgtgttggaggaagagcagctaaa

SEQ ID NO: 396375 - DNA, 862 bp, Homo sapiens
ttaatgaggcacagcacaccaagcagctggaatgagagtctgcccagggtttttctcatctttatttatgaaaggatgcaattagccacttaaaaaagaaagcgcttcattcccagccgtgtgttaccgctgtgctggcatgtgagccagcaggagtgtgggctggggcacttggctcccaaggtcttgggcctttccagcagagggtgttaatggtctgggagaagtagaggcccaaggtcatggggttctgggagagaaagcagacctccatggatcattctaacaaccagttttagttttaaggcaaattctgctaggtgccgcaaggctatagcagctctcatcctgagccctgggcacgcgaaaatgtcaccattctgcccactatttggatgtgacgaggtcaggtcattctcctgagcgtttatagtaggtctttgtctcctcagctcattaatttattctccattgcatcagccaacaacgtggagtcctaacttggggaaatttgccccctcttggagctccctgagtcagttgatacagaatacagccatgtaacaagagtctacttctcatatccctgccaccaaactgcaggacacagtacagctgcaaggcttataccactgatggctaatatcagccagagacatgatctccataagccagctctgccttgtctttttgctagaatgcaaagaaaatgatgctttaaacaaagcaagagccaggcatgaatggcaccaagtgaggacaactccgggggtggcattcaggccttctgtgatttaatgaggagaaatggcaggtctggctaggtctcttgggcttgatgagaacttgctctttcttatgc

SEQ ID NO: 396376 - DNA, 413 bp, Homo sapiens
ccagcctgggcaacagggtgaaaccctgtcactaccaaaaacaatacaaaaattagccaggtgtgatggcatgcacctgtagtcccagctgcttgagaggctgaaacgggagaatcacttgaacccggaggtggagattgtattgagctgagattgagccactggactccagcctggcagacagagtgagactccatctcaaaaaaacaaacaaacaaacaaaaaacaaacaaacaaacaaaaaaacacaccaaaactgatcctcttcagttaatgcttttccattcattcagtcttgtgcttttaacaaaggacacaatgttcggctccaacctcatgtggtcattgacagcctaatcttttattgaggggaggctcaggcttcttaacattaacattaacagagttaacat

SEQ ID NO: 396377 - DNA, 327 bp, Homo sapiens
tagataggtagaatagcaggggaaatgtacctaagtataaacatgcatgatatgtgtagggaacaatgaataaagctactggtacatggagtacacggggaggcactgcagaggtaggttgatactgataacatacttttctgtacataaactaacaaaaagtatgtcatgaacaactgttttataaaagccatcacacttgtaatcatttagtaatttctttccttacaaacagaaatgagcttggtctattttgttaccatggtatcctcagtacctgagcctggttcataattgatgctcaaaaaataaatgaatgtaacaatt

SEQ ID NO: 396378 - DNA, 368 bp, Homo sapiens
aacccagccgctggtgcagagtcccttgaaagctctggatccggctgggtctgttagctgttggaacttctcgcttgtcaaggggacataacacatccctagggcttgtccctagagctgtgtgacaacacagaaaacttctgtttgtcccggcttggttttaaatctgggaaaaataaaaagcattgtctttgcagtctgagtgacccatcgaacaaacaggatgaattatggcatgttgcggtattttcaagtgggtctataatttttggattccagcagccttcatttgttctccagtgtccagccctgggaagcttcagtgaggaaagatcttaagaattcctctcccaacccctcccctctcc

SEQ ID NO: 396379 - DNA, 308 bp, Homo sapiens
ataaggcccactggaagattggaacagctgttggctgactcgcaccctacatccaccaggttccatactatcctgtagataaggcagtcatgcaccaaaacagggcagctgacgacctgcactcagcgtcgtcataatttcctagaatctgtactcacaaggagggtctgcttgtcctgccacatatttctcagaattgcttcaacacaattttgggctcaactccacgttggttgatttgctttactatgagcacatcagaagttaagtcctgccaggcgcagtggctcacacttataatcccagca

SEQ ID NO: 396380 - DNA, 310 bp, Homo sapiens
  misc_feature (36)..(36): n is a, c, g, or t
ctcgtacccaccactcctatagatagttcagcctgngaatttgaggatgcagtgagccatgatctcaccactgcacttcagccactccatcctgggcaacagagcaagaccctgtctaataaattaattaaaaatagaaataaaaatatttcaccattaagtaatgatattgcttgtagggtttttaaatggttattatctattagctcaaggaagttcccttctatttctagtttgctaaggttttttttttttttgactgtgtcttgctcccaggtgggagtacagtggcacaatctcagctcactga

SEQ ID NO: 396381 - DNA, 211 bp, Homo sapiens
ccttaattgttcgaatctttcagggttctgtcagaggcccttaatgtaactgttcttttacttaacaaacttgtcctaccagactgaacccattcccatggttttaaagcactttctttcttttttttttttttttttttggaagggaattctcgtttggcacccagggttggggggatgggaatggtcccgggtccatggacccttcggc

SEQ ID NO: 396382 - DNA, 332 bp, Homo sapiens
agctgagtgataaaaagactgcagtgtgttgaaaggtctaacgcaacttactaggtggacaaagaccacatctgcttaacatactgattgggagagttgtggaatgtacttggctacattagctgaggagagatactaaggatactttttcctctctaagaccctgtgcttagaacctgttgtagaaactacccacaaatatttggaagcatgtatgaaaaacagtttagcacaatatctgatgttattcagcatgaacctaccattacaaatcaccagaattgagcagaagtttagaaagaaataataattaaaaatgcctttaatctaat

SEQ ID NO: 396383 - DNA, 681 bp, Homo sapiens
ccagtagggagctgagcttctggtctgttttatgtcttgacactattcagaagtcaaaaacctgaacagaagagtccagtggcctagttgggggccatacttctggcccttggcaccttagttggcggtcccaccaagactacagataacataggagagataaatctctaataggaaattagagattatccataattttaggagggcaaatgttcttcacatcaagcttgaattaccatttaggttgtatttgtactacttactcttttataaaccatctaattataaggtaatgccccttggattttgtccctcaactgatggaagaacactacaacagagccacaagtatacaaacactacacaccacacaatacacatagcacgcacacacacacactatacacatcacatacacatcacaccacacacacgcacacacacacacacacacacaccccatctgctgaaacctcctggagggtggccagtggcctgtggggttgccagggggccgtgtgtgggaccgggccaggaagggatttcctcaggtgtggagactcggccccggacctgcatgcccctccagtgggaccagggaggaggaggcgggagtgggaagggacccagcacctcgcggggacacagagccagactggaggaggtgggtcagaacataag

SEQ ID NO: 396384 - DNA, 501 bp, Homo sapiens
ggcggcgacctagaggatccccttatgtctgacccaccacatcaagcttgaattaccatttaggttgtatttgtactacttactcttttataaaccatctaattataaggtaatgccccttggattttgtccctcaactgatggaagaacactacaacagagccacaagtatacaaacactacacaccacacaatacacatagcacgcacacacacacactatacacatcacatacacatcacaccacacacacgcacacacacacacacacacacaccccatctgctgaaacctcctggagggtggccagtggcctgtggggttgccagggggccgtgtgtgggaccgggccaggaagggatttcctcaggtgtggagactcggccccggacctgcatgcccctccagtgggaccagggaggaggaggcgggagtgggaagggacccagcacctcgcggggacacagagccagactggaggaggtgggtcagaacataag

SEQ ID NO: 396385 - DNA, 410 bp, Homo sapiens
cttgaattgtaatctccagaatccccagaatccccacgtgttaagggggagaccaggtggaggtaattgaatcatggagacggtttctcccatgtggttctcctgatagtgagtgagttctcacgagatctgatggttttataagtggctcttccctcccaacccccgccctcgactccccgcccattcgctcggcacgtctccttcttgctgccttgtgaagaatgtgtcttgcttacccttcgccttccaccattattgtgagtttcctgaggcctccccagccatgctgaactgtgagtcaattaaacctctttcctttagaaattacccaatcccaggtagttctttataacagtatgaaaacagactcatacagggtgatttaaaagagagttatctgactaaat

SEQ ID NO: 396386 - DNA, 558 bp, Homo sapiens
ttggtagcaagactgagatgaggtggatgcagaaagggagtgggtgtttggttttgatgtggagcactcctcagagtgctcagagagaatggggtctgagtatagggattttggtggagattagctggtaagaggtttaaggaacatagtacgaagacctaacatggattttttgccaggaattaagccagcattaaaaaaaggctaattttttatgtcaagtaaacaactcatgggctatagcaaagccatcagattgcagaatgataataaatgtaactaaagaatgttaagggggagggaccagcagggaatagtatagacaaaactctaccaaaatgaagtttattcaagatttattttgtttaccacatcaattttcagaaagattttacaagaattttgatcagatgttactgtgttatgctctcaaccacaaaaaattaataataaaattcatctgaatagtaaaatccttgagggctgaaacactcttgacatctcagacctactaccaccatgcctagcacctggtagatatccaatgaatgtcaattg

SEQ ID NO: 396387 - DNA, 216 bp, Homo sapiens
agggttttatatttttatagcaaagtattaaaagccattctcatcttaatgtactctcattcagtgtaattacctgaaatttaaaaagccagcagtaattattgtttctctatcccaaagaccagtggttttcaatctgtaccagaaggagcccaggtctacagaggtatctcagaggctgcagaacaggtaccagagcacaaagctcaaggcttt

SEQ ID NO: 396388 - DNA, 657 bp, Homo sapiens
  misc_feature (107)..(107): n is a, c, g, or t
  misc_feature (150)..(150): n is a, c, g, or t
caagcagtaatacagactcagtcaggccagacaactcgagaaagcttttcttgacgcctccagttctactgcccagctgagttaggaactctctacccaagcctgtnatcatgtctatttggttacatttaccacattgatgggtaattnatctatatatgagtttttctccattactagagtcttctatttaaggcaaaaaccatgccttactcatcttggtatccccataacctagcacagttcatggcatgttgcaaaggctcaataaataaaatgaacgagctgagcatggtggctcagctaagccataggcccagcactttgggaagctgaggtgggcagatcacttgagtctgggagtctgagaccagcctgtgcaacatggaaaaacctcgtccctactgaaaatacaaaaattagccaggtgtggtggcatggccctgtagtcccagctactcagaaggctgaggtgggaggatccttcgagcccaggaggcggaggttgcagtgagctgagatggtgccactgtactccagcctgagtgacaaagtgagactctgtctcaaaaaaattaattagttaaataaaatgaatgaagaaatgaagacaagaatgtgactctgcagttcatgctttttgcatataccacatgt

SEQ ID NO: 396389 - DNA, 338 bp, Homo sapiens
aaactcgactctcttctcagagccccttcccctccttgcggcagaaagctaccggggcaaacgggattctccttaacctgagagagagagagagagcgcagctgaaggtcaggagcaagtgaagaagcaggcagaggtcttggtgcctcccactcttcagcaccctccccagctctgtgctagaagacaggcaggtccttagggagcgaggcaacccctggggagagggaggctgcttttcctggtagagctgaatgaattcgtgtctaatgaaggtaattaaagtggttgcatgaaaagcaggagaggagagggggagaggacaggagaggcagaaa

SEQ ID NO: 396390 - DNA, 404 bp, Homo sapiens
ggggaagtgaaacaccaggataagattttttcacatcgttattcttcgttgaggaagtaggggcataaggccgggtgcggtggctcacacctgtaatcccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacttaggaggctgaggtggcaggatggcttgaacctgggaggtggaggttgcagtgagccaagatcatgctgctgcactccagcctgggtgacagagtgagaccctgtctaaaaataaataaataaataaaaaatgggggcagcaaaccagagactagaaaccat

SEQ ID NO: 396391 - DNA, 931 bp, Homo sapiens
tggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgatttttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacaaggtactaggacccaaagcaaatgtcagtaattcgcagatgataatgtaatgtataaatatatgatatgtaggtaaataatacaaatcacattctttggccagagtgcaattgaggaggaaatcagtaacaaaaagacaattaaatccatttgattcttttgttttcg

SEQ ID NO: 396392 - DNA, 629 bp, Homo sapiens
catcatgtgttcctcaagacaacattctattaaaacaacacataacactaacaggtttttgaaatacatctttttatcttcctgctttagcccaggttgattctagagataaaattgttgcgggaagtcagggaccccaaacggagggaccggctgaagccatgacagaagaacgtggattgtgaagattttatggacatttattagttccccaaattaatacttttgtaatttcttatgcctgtctttactgcaatctctaaacataaattgcgaagagttcatggacacttctcacttccccaatcaatacccttgtgatttcctatgcctgtctttactttagtctcttagtcctgtcagccgagaaggatgtatgtcacctcaggaccctgtaataattgcattaactgcacaaattgtacagcatgtgtgtttgagcaatatgaaatgtgggcaccttgaaaaaagaacaggataacagcaattgttcagggaatatgagagataaccttaaactctggccgccggtgagccgggcagaacagagccatatttctcttctttcaaaagcaaatgggagaaatatcactgaattctttttctcagcatggaacgtccctgagaaa

SEQ ID NO: 396393 - DNA, 459 bp, Homo sapiens
cgcccacacccagcattgctgaggcccatcatcctcctgcagaaaaggaggcatgcagttaaatggagctggtgcttgcttgatagcgcctccttttgtcagaaagacgctgatgtttcaggctggcacacccagaaaaatcccttccttgtggtccttggctgatgatgagccctggatcagagtgtctccaggaccactgagaagctgcagccgtctgggttttcctctgctatgggggatgagttacgtttattccaccatggacaccaagaatgtatgtagatgtattctaaatctgctcattggttttattacaacttttcctggagtcactaagaggtaaaatggtgtaaattagaggttttatcaaagtgtagtaccagaatgccagatgcattactgaagccactcctaatcttaagcaaatgtaaactaggcctcattaaattgtttgtg

SEQ ID NO: 396394 - DNA, 310 bp, Homo sapiens
agcaaagtgcatttccagtctagttcagtgactattaaaattaaagccaacttcaggcaaaacatttccaaaaacataagacaaaaaacaaacacaaagaaaaaggagaaaaaatattccagacttttgaagacatttattaaaatcataaattgatggtatcctctttctcatcttttgatgagtaaaataaagtaccccaaaaattatctacaaatttggtatttgagggttcttttgttgtaaactcagtggttcttgatgagaggaagtttaaagtttatttatggaaattagccaaggtgtcgaa

SEQ ID NO: 396395 - DNA, 327 bp, Homo sapiens
agaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcgttg

SEQ ID NO: 396396 - DNA, 653 bp, Homo sapiens
agagaagaggaaagtcgcaggctctccgatcccagggctcattatataccattataccaagccaactcaattctaggccttcccttctccgcaagctccacctctacatcttcaattgcctactagacagtttgcacttggaccttccattgttacttccaccccaaggtgtcaaaagcaaaactccctgaaccagtttttctacctgtcttgctaatttctgttcatggcgtctgtctttcttcaagtcagctaggcttgaaaactctcaggcaagttcaactcttgcctctccctatttcacaggttctgacatttctttcttcatcttgccaattacaattggccttccttttagtctcagcaccaccattttaatactggcttttgtcaccttatcccttactgtcataggctcctaacgtagtctttccttatctccagtctcttcccatcgaaaggcatcctctacaatgcatattgccagattagtctacccacacactgctttcagagtttcactgtcttactctaaattttttcatggttcactattgtccacaagacaagtcaaaatcctttcgtcagaagttcaagagggtctttgaatcttactttccattattccccagtaaaagtctctcttctctagc

SEQ ID NO: 396397 - DNA, 527 bp, Homo sapiens
cccaaaagcattaaattcaacattactcaggctgaaaaaaaaaaaacttccagcaaacaaggaataggcatgaacttctttaatctgactaaacacatctactatgatcctatgataaacatcatacttaatggtgaactctcggatgcgttcctgttaaagtcaaacaacaaactatggaaggctgctatcatcactgtcatttaacatcttgctgctatgatcctagtcaatgaacacagaagggaaaacgggaaggaaagaaaaaaagtaaggaaggaagaaaggaaaagaaatgagaagcagaggattggaaaggaagaggcaaaacagttgtttgcagatacatgatggtctatgtagaaaatccaaaagaaccattaagatgaacatgaaaatggagaaaggtttctgtgtaagaccagatacaagactcaatagcaataaagactcatgtacccattacacatggccgcttttgcttcctctatcttcccacccttttcccccttcatattatctccttt

SEQ ID NO: 396398 - DNA, 980 bp, Homo sapiens
ttctcagtgaggcgcctgcgtggcgacatcaacaagctgaaaatcgaacacacctgccgcctccacaggagggatgctcaacgatgccacctacgactggaggagcggggtgagctggccgacctcttctgtgactcccctcttgcctcctccttcagcctctccacaccactcaagcttattggcgtgactcatttctgtgtccccagcatcacccagccgatatgtttaagttttaagcaaaaggcttttaaacacatctcagaaccccacttccacctttcaggggttctgaaaggtggaagtggggattgtaagattcgtggaatttggtcagagagtagtttagcctctgcctgcactccaaccagatagctcttctttttttcttttctttctttttttctttttttgagacagagtgagacagtctctaaaaaaaaaaaaaaaacaaccctgagattcacattcactagaagggctgtaattaaaaagagaaataataataagtctgggtgaagatgtacagaaatttacagaaccctcatacatggctggtgggaatgtaaaagggtgtagccacttcagaaaacagacggtcagttcctcaaaagatgaaacagctgctgtctgagttagcacttctaccccatgcccatagccattattgggcactaaaaagaaccgaaggacttatatatactaaacatggataaaccttgaaaacgttaagtgaaagaagccggtcacaaaagatcacttgatgattccattcatacgaaagtgtccagaataggcagaaagattaggggttgcctaggcttgggtgtagatggaatgggttaactgctaatgggtgtagggttccttttcaggggtgatgaaaattatgctaaagttagttgtggggtaagggtggcaaactcttggattatttcaatccttgatgtgcatttaatgtaggttaatgggtttccaag

SEQ ID NO: 396399 - DNA, 959 bp, Homo sapiens
ttctcagtgaggcgcctgcgtggcgacatcaacaagctgaaaatcgaacacacctgccgcctccacaggagggatgctcaacgatgccacctacgactggaggagcggggtgagctggccgacctcttctgtgactcccctcttgcctcctccttcagcctctccacaccactcaagcttattggcgtgactcatttctgtgtccccagcatcacccagccgatatgtttaagttttaagcaaaaggcttttaaacacatctcagaacccctgaaaggtggaagtggggattgtaagattcgtggaatttggtcagagagtagtttagcctctgcctgcactccaaccagatagctcttctttttttcttttctttctttttttctttttttgagacagagtgagacagtctctaaaaaaaaaaaaaaaacaaccctgagattcacattcactagaagggctgtaattaaaaagagaaataataataagtctgggtgaagatgtacagaaatttacagaaccctcatacatggctggtgggaatgtaaaagggtgtagccacttcagaaaacagacggtcagttcctcaaaagatgaaacagctgctgtctgagttagcacttctaccccatgcccatagccattattgggcactaaaaagaaccgaaggacttatatatactaaacatggataaaccttgaaaacgttaagtgaaagaagccggtcacaaaagatcacttgatgattccattcatacgaaagtgtccagaataggcagaaagattaggggttgcctaggcttgggtgtagatggaatgggttaactgctaatgggtgtagggttccttttcaggggtgatgaaaattatgctaaagttagttgtggggtaagggtggcaaactcttggattatttcaatccttgatgtgcatttaatgtaggttaatgggtttccaag

SEQ ID NO: 396400 - DNA, 541 bp, Homo sapiens
ttcggacaatgggacccacttcactgcacacatcattaaggggctaacccaagcactaggaataaaatgggaatatcatactccgtggcatccaccctcaccagggaaggtataaagaatgaatcaaactctaaaaaatcacctaaccaaattaatctttgaaacccggttaccctggactaaatgctttcccattgccttactaagaatccgaactgccccttgaaaatatcttggcctgttcccttatgaaatgctctacaggctgccttatctaaattccattactgaccttcctacatttaaagcaaacaaaaaaatcattttctcaaaaaaaatatgtatttggtctgtcttccaccctttcctccatcaggactcaaggcctcctagcgcaaactccacccctcgaattcccagttcaccaacaccagcgcagagattatgtctttatcaaaagttggaaagagggaaagctcaaaccaacctgggaaggaccttatctagtactcctaaccactgagacagcaatccaatggcc

SEQ ID NO: 396401 - DNA, 465 bp, Homo sapiens
ctggtcttgtctctgctctcccctttcccctcaccaatatacctgtggttttttgcagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtgtgagtgtgggtcttgggtgacaggatgcatctcagcctgaggtcaggagttcgagaccagccttgccaacatggcgaagccccatctctactaaaaataccaaagttagctgggtttggtggcaggggcctgtagtcccggctccttgggaggctgaggcgggagaattgcttgaacccggggacggaggttgcagtgacccgagatcgcactgctgtacccagcctgggccacagtgcaagactccatctca

SEQ ID NO: 396402 - DNA, 953 bp, Homo sapiens
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgacatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaagccg

SEQ ID NO: 396403 - DNA, 514 bp, Homo sapiens
tctgcaagacttgagtgtaatttctaaattatatgcactaattgacattccgttttagccatcatggtaaaactatctaaaatagattgccatagaaacacagaaattcttagctatcatgccagtagtctaatatggtttctgtaccaaatatcaaagcatcatcagttctataggattctaattggaggcctttgcacatgaatgtaggtcttaatggaaatgagattttatgcattttccttctgttgcccttattcaaacacaatttttgttgttgttgttgagtttttttgttttttttttttttgagatgaagtcttgctttgtcgcctaggctggagtgcagtggcatgatctcggctcactgcaacctctgcctcccgggttcaagcgattttcctacctcagcctccagggtagctgggactacaggtttgcgccaccacacctggctaatttttgtatttttagtagagatcagatcttgcgttctagatcgcgagcggccgct

SEQ ID NO: 396404 - DNA, 632 bp, Homo sapiens
acccacaagctggcatgcctggaagcattcgtgttgcaaatagacacacacccgtacttatcacattacattacaatccacagtttacataactttcttcctcgatactctctgagcctcacaagcattaaagacacagatcattcatccttgtgtctcagaatagagcacaggacaggtagtaggtgctcagtcagtggtggcctgtaaatggatgaaataccaagaggaatctcatcacccagtcccccaatactaaaacagtgttactacgaaactccaacattagaaacaaaaatcaacagcatgcttcctgtggaaaccaggattcccagaataacactatggcccagaagaccctggtctcttcaggtactgctggcaagttgctctatttctccactcctggcaaaacagagatgcttttgaacttaataaaatagactttcggccaaaaatagcaagcaaaatcagagaagccaaaaaattaaaaataaaacattattttcctttctgtgtgcaggggacggcagaaggggcagggaagcatgttaattagctattctggtgaccacgtatttaagtaacagccacacttaacatatgcgtccaaccagcttcaattccatgat

SEQ ID NO: 396405 - DNA, 530 bp, Homo sapiens
ttctggattttgcatcttttgaatgtagtctgacgatcttttttgtcaacgaagagttgatctgttggctccagtatgaatggaggttttttccccaggtggattttgggttttttgttttgttttttattttttggggacagggtctcactctgttgcccaggctggagtgcagtggcgtgatcacgctcagtgcaaccttgaactcctgggctgaagcgatcctcctgcctcagcttcctgagtagctggggctacaggcacgtgccaccatgtccagctgatgtttttttattttttgtagagacaggatcccactgtgttgcccaggctggttgaactcctgggcttaagtgaaccttccacctcagcttccaaaagtgctgggattacaggcgtgagccaccacgcccagccgattttgtcttttgaccttgtctgtagtgtcagaactcccaggtactaatcaatttctttatgatttctgagttctgtgttctaattatgataaaaacctttctcactgttga

SEQ ID NO: 396406 - DNA, 489 bp, Homo sapiens
aatattaattggtaaggacatgctgtagtgcaggttccctgtggcttatcaattaatacttcacagtttatgggaagaagcattttttaatatgatccctggtggaggtataggaacaagacagttgtatacacaaatgcatttcactggaggatggagctaattacgagagaatcaaatacaaatgtaattttgtatatttaaatatatatggcctgagggccaagttttttcgtagatcatgtactcatgtttaattatggagaatgtttacagcttgtttttatgaagcccttctaatgagagatctaagctaagggattttaaattgaagaggttaaatccccatctacttaacttttaattagttttttgtttgtttgtttgtttgtttgttttttactattttactaaaatccaggcattcatcttactgtttgcataagtacaagcttcactttaggctcaagattgaataaaaatgcatag

SEQ ID NO: 396407 - DNA, 616 bp, Homo sapiens
tgcatctgtaattgttttttaaactgcaaaaatgaattaattaaatcataatggaaataagagtattgtaattttcctacccattacagtgtacataagcatcactataactagtgctatctacataaaatattcaaatcagtatacatattacagtattacagtggtaccatagaaaatattcaaattgaggctgggcgcagggctcacacctgtaatcccagcactttgtgagtccgaggtgggcagatcaggagttcaggagttagagaccagcctgaccaacatggtgaaaccctgtctctactaaaaatacgaaattagccaggcatcttgtaatcccacctactcaggagcctgaggcaggagaatcgcttgaacctgggaggtggaggttgcagtgaaccaagatcaagccactgcactccagcctgggtgacaagagcaaaactccatgtcaaagaaaagaaaaaagaaagaaagcaaatattccagttaaatcaggtcattgattttgactagatgtctaagtgtcatgtacacctaggaggtaatactagaaacaattgggtatacccaaccctcacaccacaatgcaaaagtaacattaattaac

SEQ ID NO: 396408 - DNA, 831 bp, Homo sapiens
gtggaagtcttaatgctcaaaaagtgtgcctgatgcagtctctaaactggcagcctgacggcctcatacaacacggatggtcagtcaaaaaagtctacattagaataagaaactgtccaacgaggtcaagcatgaaaatagggctaggagtctttcatctactcttacaggaatactggtcacataaaatgtgtgggaggcatatcgaaatccagtatggattctattttcattttggaagacatgcttgcccaccccaaattgatacaaggctgggaaggttgggtttttccttaatattagaaaacaagttaatggcaactgttgctcccttctgagctaccaaggggcaactggtacattctctcagcattatctgtaagaatctgctcacaggtttgtctcccttaagactgtcctactctttctctgatattctaaagcagtctctagcaatgaaaaagaacttaaaaatcttttccaccaatgtgctgtgctgaatgagactgccttgctcattcttgccactctatctctactcttttgaaccagtagtttaggtactgctcccaccaatgaaaatctgaggaattttcacatcaactggaaaactatggtttagacttttttcttcaaaaaagtttcattatttagaaggaaattgctaatgtgaatccaacagagaaaaatggttactggtttgagaaacagtaaaaacatgttaattcactcaaaaaaagtaggtgacgaattactcaaaaaacaacattcctgtttccataaataaattcccacattcgtctgttttagttttcttattctaaaaataaa

SEQ ID NO: 396409 - DNA, 129 bp, Homo sapiens
caggaaagacccctgcaaggtggctggcacactcatcacctctcatcaaccaccacctggggcctgtacactcagcccccgcgagtcagcccctggtgaagtgtctgccacagccaaccgccaggagct

SEQ ID NO: 396410 - DNA, 475 bp, Homo sapiens
tcttgactaagatggaccctaacgctaaggaaacaaaagttacctgcggggcagagggttccagcaacttcctaaattcctaaggctacaagaaaaaaacacactccaactccctaatgagaggagcaatcggaccctaactctgatttacaacccagacccttccacttctgaccggacagaggactggccttacatacaccctttcccgatcagcaactgtggccctcagctggcggcagtagctcctggaggctgcggactgtggcctgtggttcaccttctgacttcaagagccaaattccagctcggcccccactaacagaatggacccctcttggccaaaggaaccccagaggcaacttcaaaactgaattctcggccacgacataagggaggttgaacacgcctggcccctcccatttggattttaggtactgatgtcaaagtagacatcacggaagactaatctcag

SEQ ID NO: 396411 - DNA, 621 bp, Homo sapiens
tttccctaccctgaaatgggagaatggaaccaagttctggagaagctcctgggctgctagaactgggtgctggagaaaccaggtatgctgaaggaggttgatgaaacaaacacactgtaatcagaaagagaatccccttcctcctgcagtattccaccaataacttctactgacaaagcttaacattatgtcagctgacttagaagaaatatttgcagggtccagctgcattatccacagaatagtgaatgaaggatggagttggagctgaaagaaaataagctgacaactggcacagtaaagtatttggctccacagtctctacgtatacccttctatacatatttacacttctgtgcaacaatgaaacaactctatatttcacctaaaaagatacagctgtcttaaaatgtaaagaagtcctcagctttgctttacagtgaggagatgcacagtctcagttgtcattattttcatcattggctatatattaaatatttctaaaatcctgtcacagtctctgttacctaaaaataaatttataaaattaacccacaagaacttatatgtaaaataaaaataagaagaagaaaatgttagcttatatgaggggtcttcaaa

SEQ ID NO: 396412 - DNA, 268 bp, Homo sapiens
actacagtgattttttaaaaccatcatcctatcatcccctcatcacccatcttggatggaagctacgcagaatggtaaatcaatgagtccttatggcagagtgcactccgagacaaccgtcagtgaaatacctaagtcgaaggaactgcattttacaaacacaacaaggatcctgacacttggaaagaatcttacagtgttcaggtgcttttccagccattagctcatttggttgtcagagcaaaactgtcaagtaggcatatgaccc

SEQ ID NO: 396413 - DNA, 207 bp, Homo sapiens
ttggcacgagggcccggactaatattggctgtgtgactgctggaccaagacgtggaagtggccctgtgccaggatctgcatctaggccggcatatgccactttctgtatcataggacactccctcatggaatccagccgccacactgcgaggatcagcagccccatggaggggaatcatggcccctgatgaggcaactgaaactcaa

SEQ ID NO: 396414 - DNA, 497 bp, Homo sapiens
tattttcttaaagcatttgggaaaatgtttggcagttactttttcctaaatcgctatgatgaaagcattgcgttaacaagtgtgtcttaaatgaataacatctcattgtttgtgagagcgttacctatcccttagagatacttgtgaaactaatctcagaaagtgattagaattcatgcatgagaaattcataatttaattgcaaattcatacttaatatgtgccaaagattttggtgtatgctagataatcgagcttatgaaacatgatctcttattcaattttctgctgctattaacagaacaccacatattgagtaatttatttaaaaatgagatgtattggctcatggttctggaggccaagaagtccaagatcaaggggccactcctgatgaggtcaaaacattgtggaaggtctcacatagagaacacacactcaagaaagaaaattgggctgaattcattttttaccaggagcctactcccaagataatg

SEQ ID NO: 396415 - DNA, 494 bp, Homo sapiens
cctcggcctcccaaagtgctggaattataggcgtgagctaccacacctggccatccacagctcggttttatacattttcgggagatatgagacatcaatcaatatgtgtaagatgtacattggttccatctagaaaggtgggacaactcaaagcagggaagggggcttccaggttataaatagataagagacaaatggttgcattattttgagtctttgatcagcctttcacggaatacacaatttacgtgtgagaaggggctagaggaatagtcactcatgccttagtctggctcagtgaatctgcacttctacataagcagtagggcagaggaagcaattgagttctgtcctttgtcctgtacttatgaagataagctatcagtttatattgccagggtgagattcagcagagctgttttagggtaaagatcttgaggcccacaaggagttttctcttaggcaaattgtgggagaggtaggtagctttttat

SEQ ID NO: 396416 - DNA, 467 bp, Homo sapiens
atactagaaaatttttaattagagttggatcttgaaaatttttagctgcatgcattcattatgaaaaaaaaaaaaatcggaaaggaggtactcaaagccctgaagacattatccattatcagagtgtgacttgaaattgtttgccgtgcctgatatgagagcatgttctgtacatgtctacctaggcttcacctggcatttacccgagtgaggactatcagtgttccattttatacaaatatctgaacagagcaggctcacatttagacgtattccccatgcagagctacaggcttccaatcaatgagatgtttactagaatatatacagaaactgaaggtaattctttaaattttttgaaaaatgaggttatttggctgcctggtaattgcagcatggtaaaatttgatattgaatgtatttgattgtgtttactgttttcttttagttttaaaaataaacatctt

SEQ ID NO: 396417 - DNA, 354 bp, Homo sapiens
tgttaatgtgtgtttatgttgtgttgacaaaaagtgtaggaagccaagcgtgctggtgtgtgcctatggtcccagttactcaggaggctgaggcagaaggattgcttgagcccaggagttcaaggctgcaaggagttcaaagctatgatcatgccactgtcctccagtctgggcaacagagcaagaccccacatctaaaaaaaatttaaaaaaaattttttaaagtaggattagcagtaatacaatgttatcttctgcctcgtagatagcttgaaaattctgagattctttgctaatatatctaactcttcatccaattcaagatataaaaaacatttttaaattccatgttaa

SEQ ID NO: 396418 - DNA, 210 bp, Homo sapiens
taatgtgcttggttagtatggtgtttggtgtatagctggcattttgtgaatgctagttactatgattttactttttcgtttttccttccactgcccaaaatacttagtgggatgtaatgtgagagaaatagacatgcagatctaagaggaaatattgacaatataagcctgaacaatgtgtccaaaatgaagctctgggattaaataggt

SEQ ID NO: 396419 - DNA, 372 bp, Homo sapiens
acagaaaaacacaattacaaagggctgtcgtagcatgcgttaaaatagtgaaaatcactgactatttcacttgtggtgtcatagacctagtatgatacatagcagatgcttgatacttggtgacttgaaatcaggttcatggaggatcagtggtgaagctcttaggaagttgttgtgcttgatcagaaagtgaagtgaactcacttgaggagcagtaggtgcccccactccggctttccacccccaccggcctgaggctagcgcaactccggcttactggaaggtggaagaaggtaactacctgctagatgcctgggcttttccttactcctgatcagttctgcagttactacatgcatcactgggtaccga

SEQ ID NO: 396420 - DNA, 330 bp, Homo sapiens
ttttcttttatatgttctttagtgagaagctgcaatattcaacagatcagatggtgattaaaccttcctatggcttttcatcgcatttagactaaaacccaagctccaagctccttccaaggcctcctgggattcacgtgatctggctcctgcctcttccttcagctgtattctcaggcctctcccaatttcacctgctccagccatgctgacttgctgttctggtgacctcaatttcttgccactaaggtccttggcattagctgatgaacggccttgaactatgtcccccaaacgtccccaggcttctgttttcaaattaatgaattg

SEQ ID NO: 396421 - DNA, 144 bp, Homo sapiens
tgaaggtacaagagaactgagttcagatgagagataaagagtgagaaagaggtaagagaaatagatggaaaaccagaagattgtggtacacagaggcaaacaaaagggagacagtgaagaagcaccaagaaaagagctgtcccc

SEQ ID NO: 396422 - DNA, 577 bp, Homo sapiens
acgtgtagtcagaaatcctcctgcctgagcctcctgagtagctgggactacaagcacatgtcaccacgtccagctaccttttttttatttttagtagagatgaggttccaatatgttgtccaggctgatttcaaactcttgagctcaagcgatctgctcacctcaacctcctaaagtgctgggattgcagatgtgagccaccatgtccagcccctgcattttaaaagagagtttttacagaatattagtcttatgtcattgtggggctggctaagtagtctctgttgggctgtcatttcaatgtctgatgctggagcttgaagtctacgggaaaggtgaagttaagaagagaagatcatgagcaggctagaacctgtgggcatgagctggaaccccacaaggatggaataaaattgtctttgactttgatagtgtgggtatcctgcagaatctggggccctgtgtcatggacctaaccaacgtatcctggctcaggggttggataagctgacaaaagctccaggagagggtggagcagttgtggcctagccactgctttatgccaatgaggcaagtt

SEQ ID NO: 396423 - DNA, 373 bp, Homo sapiens
tgttagtctgttgtgtgttgctgtaaaggaatacctgagattgggtaattcataaagaaaaatgatttgtttggctgatggttctaatagctggaagtttgggcatctggcgagggcctcatgctgctttgacttgtggaaggcgaagggaatcctgtgtgtgcagagatcacgtggagagagaggaagcaggagtggtgggatgtcaggctgtttttaacaaccagctttcttgggggacaaatagagtgaaaactcactcactgcctcacgccagggagggcattaatctattcatgagggatctgctcttatgacccaaacacctctccttgggccccacttccaatgctgggatcaaatttcaacacgc

SEQ ID NO: 396424 - DNA, 327 bp, Homo sapiens
tcatcgagctcggccctccgtcgtggcttcattatgaataactggaaaagttaaacaagagatttcatccagaaaagaaattttccacacacacaaaaaaacaggtatttccaacaaagctgccatatcacataataaaattatcttgtagaaaaaagcattaacaaagtgttacaacattaaatatccatcttaaatttacttccttaacctctcaaagcctatatcccaaacaaagttacaaaaaaaaatcccagtagtagagcatatgatctctaggtccatggaagagacaccagagaatcacaactcatctgcaacatacag

SEQ ID NO: 396425 - DNA, 515 bp, Homo sapiens
aggtcccttcctcctctttcctgtttggcatggtcccgaacttcctgcaagaccagcctcaatattcttccttttgagccttttctggcagtggtggccccaaatcctggtcccaacaccagggtggatgggtagctttgacttcagtgctcctaacggagccatggatgcacctctacttacagtcatctcattgccttggaattaagcaccccatctcccctaccctaccaccccctggcctccacctgtaagccagtgtcaaccaaggttggggaggtagagagcagtccacctggtacaggttatatataaaggcatgcattatctgtagcaaactttaaaaaaagaagaaatttaacaaaagtcagtctctttgttcattgtcacatgtgcaggtaattctgaataatgtcagggataaaatattctccctcgcaagggcaaatgtctctttctcacaccacttggtgttttgctcctgtggatacttcccagtttcttctgttcaggaa

SEQ ID NO: 396426 - DNA, 496 bp, Homo sapiens
tgacagcccactacttctcagtaaatctttgtcttttatttttcataagaatttgaatgggcatttttcttttgcaaacacaagtgtcctgatgaaatactaattttcccacccttcccaacctccctcatccttggacttccaggacaatgtaatgagcaccaaggatctgaactctagctcttgttgggagcttaagctcccaacaggacagttttaaaagctttggagactgagtccagctctgtcgccaggctgaagctcccaacaagaaggaagacagacttcaagagttatttgagaagctctgctccaatggagatgatttttgaggaacgtgattgtttattcttgctcttgtacagaggcatcttctgtctaatgctcctaaattctctaaaaagtaaccttactttgaggttatagtgagagccaaagtcctcttcatggcttataagagactttattatctgactgccctttcattgtcttgggg

SEQ ID NO: 396427 - DNA, 115 bp, Homo sapiens
tctacaactcttacaatcatttttgctgattctgaaatgcatgttaaggggattaatgccacactctgacctctcagttactcaactcccttaaatccattgatcacagcctcag

SEQ ID NO: 396428 - DNA, 390 bp, Homo sapiens
tctggatggatcaaccaggtaaagattttttgtcagccacatgaggcccccatctatttagctcctctgattttacatgaccatttcagataacagaccccgttaagaatgtatcaagtactactgtaactcttggccaaattgctatttggcaccaaatcaatctttagttggtggtgagactccagacacataaacagataatcttctacggaatactttcactgtggaaagagaatcaggaaaggctaaagggatgtttaaaaatcagacatcaggctgggcatggtggctcacgcctgtaatcccagcactttgggaggctgaagtgggtggatcacctgaggtcaggagttcaagaccaggctggacaacatggcgaaaccctgt

SEQ ID NO: 396429 - DNA, 434 bp, Homo sapiens
ctatctgtgtctctgagtatgtgggaaaaaaaaaaagttaatccaagcaattcattaaagaccattggctttagtaagaatcacttcttccagcctttcttctcaaaatctgtgaatacttcttgcagggaaactttattgtttttttctactccaaaacattatatatgataaaaatttattttaaggcattcatataaatagactggaaagtacatgcatcaaaatatttcactgtttggaagactggtgttttcttttgtgcttgtctctgttttccaaattttctgcaatgagcttgtgattcttctgaagttagaaattctaaaaaccaggctgagacagaattgcttgaacccggaaggcggaggttgcagtgagccgagatcacgccactgcacttcagcctgggcaacagagcgagactccgtctc

SEQ ID NO: 396430 - DNA, 120 bp, Homo sapiens
agcagatacttattaagtattgtatactaggtcttagggacacaggtaaacaaaacctaatctctagtcctggagctttacattcaaattattcctctaaaatatttaacatctcaccat

SEQ ID NO: 396431 - DNA, 450 bp, Homo sapiens
cagatcatttgtgctgtcagatggaaattctgactcagccattttctctttcccaataagttacccactttactctgtggtcgctgataatgatgtagatggtctatgatattaaagtagtacttctgatgtgaggacttatatcatctcagcattttcaaaacccgcttgcctgcaatctggtgtatctgcggttagccataacatatctacttgccaaacaagtggtttaggttaccggggttttcatttaactttgaatttaggggattagaaaaaaaaataactcaggaacatactttgataaattacgtgagaatgaaatgttgggattcaatcagttttacttttcagaatgattcttcgcagtgtgtttgttgaagtgtgcatgtgttgttggcacacatttaaaacttatgcttattacccttgtaaaactgttgatgatgc

SEQ ID NO: 396432 - DNA, 219 bp, Homo sapiens
catttggccccatatacatatatagtatttatatttttatagacagggtcttgctgttgctcaggctggagtgcagtggtacaatcacagctcacgatagccttgaactccttggctcaggcagtcttcccacctcaaccttcccagtaggtggggctataggagtgacaccatgcctggcttaatatatttgttaaccagaattaaaaacaatactat

SEQ ID NO: 396433 - DNA, 334 bp, Homo sapiens
gtaaatgtaggattcgaatccaagcctgtgacacttcaaagttctctcttcccacacagcttcttgaggtccctccccaccctaagattggcaggaaagaagattctatatctgaatccacaacaaatgctgtttccaagtggcccttgatacggactgatggagtcattttgtgagttaatgtgcttactaagtgttaggaaaactaaagtgatgtgatgtcttaaaacatttaattagacctcaagatgggccacagaaaaacgcaatcttcagctacctagacgccacacttcactgccagatcacactctgtcttgttatttcccttcac

SEQ ID NO: 396434 - DNA, 498 bp, Homo sapiens
ctgtcctccgtctgcagacaagccaaggtgtgaaagcctcctcgctggcccaggagcctgtcattgtcctccagcagctctagcctggatgcggtcccagagataaatcatatctctttaaaaagccacagtggcccattatttctgcttgaaaacacccctggctctctgctggtgagctgggtgacaggccccggctgttgtgctcagcgctgcatacagtcacatcagtctgtcgacttgtgtagtgagcaagctggtagcttcagatggcgtgcacatgaaatcccgtcctggcatccaggacttggccgggggttgcagggagccatgtctcctgaacaggtagtaatattttacagtccccgcctcatgcccatgcgaaatgccctgttcatacctggctacatgggcagtagcaaaaaagacacaatggcaatccccgggctaccttttgcaatattcagcaacactttctcaaagaaattgcaatcttga

SEQ ID NO: 396435 - DNA, 378 bp, Homo sapiens
aaaagttcagaaactgcttaaattagaatttaaaaatcatagccaaaattctagatgtacacaaaagtacttctaatgagtttagcatcatctctggtttagaggaggtataaatagcattggactgcaatgctaaattctctataatgacttttctggatcagcatatcatacctacactgacttgccctaataaataaaaacaatgagtcagattatgtagaattgagatatatggaagataactctttaaaattatttgtggccaggcaggcactgtggctcatgcctgtaatcccagcactttgggaggccgaggtgggcagatcacctgaggtcaggagttagagaccagcctggcaaaaccccatctctact

SEQ ID NO: 396436 - DNA, 484 bp, Homo sapiens
aggctttcagttatgggctgagttttttttttttctcttgcatcattttgaagctatgcaggcatatttccagattgcaacaaaattttattgtgaattaaaataaaatcaccttttctatgttcctttggaaaggaaggaaaccttgacttaaattctgagtgccattttcaatgctatttacacagaaatgtagatgaccaaaataaatgtcctcttggttttattcagaaccaggacttaatgctggttaaatacagtcctcacttgatatgcatggaggattggttccaggatccctaaggattccaaaaccctcagatgctcaagttccttatataaaatagtatagtacttgcatataactggtgtacttcctcccgtatactttacatcatctctagatgtacttacaatacaatgtaagcactatgtaaatagttgttatactgtatattaaaaatttgtatttttaaaaattgtg

SEQ ID NO: 396437 - DNA, 443 bp, Homo sapiens
ctgaaacccagcagggcagacattaagccttaaagctaaatctccctttactccatgtcaagggagagcccccatgactgttctcccaggttagagtctgctgcctgtggcttttccaggctgaggatgccagcagctggtggatctacctttcttgggtctggtctggagagtagtggtccccttcccacagctgcactaggcagtgccccagtggggcctctatgtgtgggatccaaccccacatttcccctcagcactcccctagtagagtctctctgcaggggctccatctctgctgcaggcttctgcctgggcacctgggctttctgatacatcctgtgacatctaggtggaagctgttaagcctccttcactcttgcattgtgtgcacctgcaggtttaacaccacgtggaagctgccaagtcttacagattgtgcc

SEQ ID NO: 396438 - DNA, 639 bp, Homo sapiens
cagctaggtttacttaggagctgagtttttagtataacttaattagccacacgtgactaccatactggatggcaaggatttagaagtgcaagttttaatacttcagatagtaataacagaatgtttttcctgaccagtcttgatcagagtttcttcccattttattctatcattagaaatttcattttggtccctagataaggtctattttgaattgaaaactactcaaaaacggaaaccatcttttaagatgaggtaatactctgaaaagtatttggctataagcttccactcagtaattgttgtctccattgagactacacttaacagcttctattttgctgtggggttccccccctcattcccctcctttttccttctctgccttctgggatgtatctcatgctatgggtatttaattcagcttgttatatttggtgaaaagtctgttcagactgattttgtggcttcctcatattaatattttttgaccatcatatggtttctaatttcttgtgttcctctatagaattagatccttatcccagttattaatttgtttgccctttgttttatgacaaaatgctttttttgcatcttttcaatgacttcattttgccagtaaggtttccatgttta

SEQ ID NO: 396439 - DNA, 269 bp, Homo sapiens
aaaatttggtgtaccacctggggtctggattatttgagagaaggttaggggcatttgaaaggcaaattgtaaagctcagttaagtattcatgatgaaaatgattaaatatatagtatgaaattctaaggaggcatgttgtgaaggtaaatataaataatagaaacacattaagggctgacttgtttcagtgcttttgagttttattttaattaaatggttgcctcatttaaacttaattacctaaaaacaaattaagtgattattattg

SEQ ID NO: 396440 - DNA, 321 bp, Homo sapiens
gctgcacaagagttattgacagaacggtggggtgctataattggccagacctgggtcaaatgcccacttatatgcccaagagactctactctgtaactgaagacatgttgggaaagcttacctggcagatccaaaggatacttgtcactgtctgatgtagtgacgcatggacaaaaatggcctcagcatcttccagtctgttctttctcctgtatactcagtcttggttagtagcaccaccttccatctgattgctaaagccaaaaatctctgtcattctggactcctttctttccctcaactcacacatttattcaatca

SEQ ID NO: 396441 - DNA, 497 bp, Homo sapiens
caccagggcccgtcgtggggcccagataaggaagggtggggaggttgtcagggaacagcaggtcaggtggtccagctgctgctgctgaggggagagggtgtggtcaggacccctccctcacttctagcccccagagaattctgagaaatttagttagagttttttactttgtgacacaggggaaaaaaaaatttatttctctctgtctggagtgaaggagaggaagattgtgaagtctagggtgatgggcaggttcacctgacggattctcagctccaagggcccccattacagagcaggaagctcctggaggaagccaaggaagagggagctttgaggctgggttttgagggacgcataggagctcgctgtctcctgtcctgtaggaattcccagcttggagagggaggtaaagctggacaccaaccctcacggccccacgtgccacgggcccccatctcacccacactcatgagcagcctaccatgcctgctttt

SEQ ID NO: 396442 - DNA, 250 bp, Homo sapiens
agcaataatacctcaatagcagagggcacttccatgctcagatcttggctgctaaacactagtctccactaaaaagaaccagggtgccttggagatcctagggtcgtggcaagagaagtgcaagatgagcctggaacatcttgttgtgccataaagtaaggaaacactaggagaaggatggagatggatcaaaaggacacagaggccctccagaaggggctcccactggcagtgtttgggacaattggag

SEQ ID NO: 396443 - DNA, 623 bp, Homo sapiens
tacaggaaactatatatcaaagagataatctgcactcgcagactattcacaatagccaagatacggaattgacctaagtatccatccacaaatgaatggacaaagaaactgtgctacatatacacaatggagtattattcagccattacaaaaaaaagaccaaagtataacacccaaaactataaaacttatagaagaaaacagaatttcaggacatgagatttgacaatgatttatcagatacaacactaaaagcacaggccatggaagcaaaaacagacaaacaggactacatgaaatgtaaaaacttttatgcatcaaagaatgtaatcaacagagtaaaaggtcaacctacaggatgggagaaaatatccacaaattatatatgtgataagggattaatatccagaacataaaaagtactccaacccccagtgaaaatggcttttatcaaaaaggcaataatggatgctggtgaggatgtagagaaaggagaatccttgtacactgttgttggtgggaattatcaattagtacagccatcatggagaacatcattgaggtttctcacaaaaactaaaagtagaaccacaatatgatccaacaatcccactgctgggtat

SEQ ID NO: 396444 - DNA, 514 bp, Homo sapiens
ggactcattagataacctcagttatcaggagcttcttttgcatgaaaggctgtctagggatcattcagcattggacaggtcatgtcgagggatgaaaagaggttggttaatgagtacgtacatagaggtagctagaagaaataagttctagtgtttgattgcacagtagaataactattgttaagaataatttatcgtgtatttcaaagtagctaaaagagaaatgagatgctcccaactcagagaactgataaatgtttgaggtaaagaacattcttggccactcattttcagtctttattacaaactttgtttcttcagattgtcccttaaatattggcaagatatacaatttgtccaggtcccaaagctagaggagacagaacctggactccacgcaatttaaccatgctctcaaccccacattaagctccctttccaggatgccatcctcagcctctgctatgggctgaattttgccacctaaccccaaccagaattcagatgttgaaat

SEQ ID NO: 396445 - DNA, 385 bp, Homo sapiens
tgagatggagtctcactctgtcgcccaggctagaatgcagtggtgcgatcttggctcattgcctcactgctacctccacctcctgggttcaagcgattctcctgcctcagcttcccaagcagctgggactacaggcgcccgccaccatgcctggctaatttttgtattagtcggagatggtgatggggtttcaccatattggccaggctggtctcgaactcctgaacttgtgattcacccacctcggcctcccaaagtgctgggattataggcatgagccaccgcatctggcctaatttctaagtgagagaaaatggtctgagttttctgaaggctttcaagacatagaaaggctttctatgccttgagaaagcccagaaattgc

SEQ ID NO: 396446 - DNA, 523 bp, Homo sapiens
gcattttgggaggccgaggcaggtggattacttgagctcaggatttcaagaccaccatgttgcccaggctagtcttgaactcctgacctcaggtgatccacttgcctcagcctgagattacagacatgagccactgcacccagccttatattgtactactaagatgcaaaaagtacctttaagtgagcgttcgtgtatttatattctgcaaaaccaaaggcaagacttaagtcataacataaagatgacatatctacagggaggaaaaaagataataaagttcaggtttttacatttctaaggatcttatttaattcagagatcacctctggaaaccaggtaacaaattacgaagggctttcagactcattgtctcatttgatcttagcaaaagccctgtgagggacagtgaagggaaagactccctttgggatgatcagtttagggtctcaatgcaaccaataaagtatggaggggtggctaaatctcaggtcatctgagtttcatttcattgcaatcattg

SEQ ID NO: 396447 - DNA, 207 bp, Homo sapiens
gggacaaaatgttcaaaaattagattgtggtgatggctgtacaagcctgtgagtatactactcacatggttaggctttgtgtccctacccaaatttcgtcttgaattgtaatccccagatattgagggaggaacctggtgggaggtgactggatcatggggccagttttccccatactgttctcatgatagtgagtgagctctcacg

SEQ ID NO: 396448 - DNA, 164 bp, Homo sapiens
atgtgctgaattcttcctgttattggcaagggttctaataccttacaaaatattccatgcacagactaaacatcaaatattgtctagctaattattcaagtaagacaaagatggaaattattaggcttactaaaagcagcatatatttagcttcagtagattct

SEQ ID NO: 396449 - DNA, 631 bp, Homo sapiens
acaccaaccatcacagccccccaccaaccttctcccaaccccaaaagcattgtccagggatatagattttaccaaaggcttcctgggaagacgagggagcaacactttagattaaatgtgatcagactttcctattagatatggctcttctgtctcttgttatccccctgacagctctgccataaagtcccttctcctcatccttcccaaacaggctgtataagtgctttgaggtaattaaactctttcctccagtttacaaatatcacttaacaaaaaatataggcattcagccagattaaaaaactggtattcagccaaatagtgacaatcagttgttcttcaagtttttccctttgggaccttggttgttattgcacaacttttattagcaacaatttttggcgtctctgcttaatctacaagttttcgaaatggaaaagagtatcttgcagcttcattttcatgagctaataaaaggggtattggaaggaatctaagaagtcaccattttaaaactgatgatatgttaaaataaggagtatgcagaaggtagagacttttaactgatgataaaaatggtgtttcacaaaatctcatccttaacaaccagaagttctcagtttagggt

SEQ ID NO: 396450 - DNA, 486 bp, Homo sapiens
ttgtactattaaacacaatgacccactcctattattaaaacacaggttttgctggaaactcaaaaaagacttggctctgctggctcacagggaatctgggctccgctcttccaaaacctttgttctccagatgtcagtgcaaagttatgaacagctctccccctgagctaacttaccgagcagtaagtgaggcaagaaaggccactcactatatttctcagcctccatgaagtcgtcactgggagaggagccaagagggagggggcaccttaggagacaagatcgtaactcaccgtcatccggggaagtggagaggaagtcagggaactcgtgtcaggagtggagagctaagctcaatatggacaaggacagagaggggcacctgggatgggagaaatgtggcatcaggacaactgggagtgaaagtttaactgccctcaaagatggctgacaaagatctagcattcctagtggacaccaagctga

SEQ ID NO: 396451 - DNA, 248 bp, Homo sapiens
cccagctgcctcttcctttctaacctttctaatgctttttatttcttttgtgcctgatttcactggctgaaaccttctatacaaggttaaatagaagtgagagcagataatgttgcctttgtcctgatatttggcagaagcattcagtctttcaccaatacatatgattttagctgtaggtttttatagatactctagttgaaggaggttctctcctatttctagttttttgagtacttttatcatgg

SEQ ID NO: 396452 - DNA, 390 bp, Homo sapiens
ttgcctaaggactgtccaactcctcatagaacactttagtcctaggaagcatcaggggagtggggttgcaatttatttcactttatttctgctgagttgccttgggagtctgaactttgatctgggtgggaatcagagaatggcacgggtcagttcaagctcttgtcagataaaatgttctcccttggctcaaagaagaggcctgaactcacttcccgttaacctaatatctgtctcggcacccctgttccacggtgatcccttctcccccaccctatttaatcacctttcctggccactgctgtcctggccatgcagcaacagctacaacccagaagacaggcaggtattgcttcccttcagctactatcttgtaactccctcttaatt

SEQ ID NO: 396453 - DNA, 531 bp, Homo sapiens
taagtttatctagggaggtaatagcaggaatgtcggtttttaggtctatgatctcaggtaacagtataaaatgattatcagattcctttggataatatatttatatttggatagtaaatttagcttaaaagtatatgcttaaggtataatttgatcaattattttctgaatgcatatgatcttacagttgcccatactgaaacccattttcaattttctgcctttcaggtagagtcttgaatgattttcctaaagtttgaatgattttcctgttgagtttcgtgaatgattttcctgttcagttggcaattactcatttgaaaacgcttgggcctcatttgctcataaatcatttccaaagagaatttcagaaatggaagggtccttagagattgtctagtccaacagtctatttcataaacaagaaaactgaaatacagagattgagagacttgtccaagttagtcttcgagggctccaccttgactttcttacatgctctcacataaaccctctccctgccactttcct

SEQ ID NO: 396454 - DNA, 207 bp, Homo sapiens
ttactattccattttgatgataggggttggtgtaaactaatggacatgctctgccctaatagcagaacaatcttgggaaagacattgaactatcctttgcatcaattcttttatatgttaagttctgtcattcttctcttacagggctgttgtgtgtgaattgaatgagttgaagtaaaagttcttggtaaagtgtaaagcattata

SEQ ID NO: 396455 - DNA, 492 bp, Homo sapiens
atgtatccaatatgaccccacttgtgtaaaactgtgtatgtgtatttgtactaacattcacatttctctgtatgtatagaaaagtctggaagtgtagccatcaatgtgttcattatgtttacttctgagggatggaatgggagaagggacaagtgtgcaaggcaaagaggggacttttaccagccccagcgtttataaagatcagtacatgactaatctttaacctacactcctcactccatattattttgaagcaaagataaaaattttaatagatctctgttgcttgaatatttttataataggtctttattatttgataatggttgtgtttactgctggaaactgttaatagatgccgtactcctaatagcaatagctgtcatttcctattacagtgtgaggcactgttctttttttaaattcatgtcttacttagattttgtaggtatgtttaataaatttaatacccattaaatttaaatagatgca

SEQ ID NO: 396456 - DNA, 855 bp, Homo sapiens
agatggtggcaagggaacggttgtaatggtgaaccatgggacgtcagtggggcctgagaagcaggctagctcgagagagcccgggctgggtggcattgagctcagcagtagagcagtgggcaactaggctccctgtgatgccatgcagggcatttggtggaactgttgcctgcgatattgggaaggtgggctgtgtattcctccaaacctgtaatctgggtctggggacatgagagacactcatagtaaccccctgagaagtagcatggtgagatggctacacataaggaagctggagtctctgttcaaatccaggctttgccattttctccttggatgacctggcagcttacttagcctttctgggccttgatcccttatcttcctggggccatcacgaagattaaatgagatactgcacatgaagttcttagcccactggtagacacatagactcaactcagtacagatgctgttgctgcctggctgaaaacagactggggattccacacatcctgctgtccggagtctctgcgtgggagaggacaggcctttttcctcccatctcacttcctctcctcctccagccaccagaatacgacagcctgacactccatgtccccaccgtatatgggaaaggaggtttcccattggccgcaggcagagacaagccacagtgagatgagcgctttggctgctgccatggcaaccagcaatgaccagacttcaattaggaaggaggaataaaaggcatccaattaggagaagaaaataggattgagcctcttctcgcttaggaatgcccagggccaagggaatgcttcgctggaggagcccaggcttgccaaccccttc

SEQ ID NO: 396457 - DNA, 538 bp, Homo sapiens
caatgagctggtgaattagtcactacagacagcaggaattggcaaatgttttttttctgaaaagggccaggtaaatgttttgggctttgtaggccaagaggtaaaatagagtaaccagtctcctgaaaggctagagtccttttctaaattaggagttaaaaatgccattcttagctcacaggccatataaaaatgggtatagggctggattcgacctgtgggctgcatgtggtctgctgaccctcagcatacagcactgtgaccagtgaacaaattaggaaaccaaggctcagggaagctatgtgactctacacaaatgacattttccttagcctatgtggctgatacgtgggcttccaacttccatcatgatggctcaacctaatacaggtggttctcagcttaccatggggtttcatcctgataaacccattgaaagtagaaaatacatttaccacttacaatattgtcatctgatgtaaccccaacataagttgaatgtattaaatgtgtactgcttttatacaattgtaaagtc

SEQ ID NO: 396458 - DNA, 494 bp, Homo sapiens
tggacctccctacttttgtaacataatattttactgtagtgccctatggtgataaaccttgagtatctaaagttgtcttaggattattttctagttgtataaatatttttataataaagacatttggtataagcttgatgggttcttaactaatatattaagtaattacaaagattcatttttttacaaacttttaagctattttaataaaatggctatagacctcactatacttctatttatctgtgcattaataaaaacctgttaaaatttctttagtacttctgaaaaagtctagtcaaataagatcactaaaattaccagaaaagctttgaaatactgattgcagattcatttcaaagtagatttaacacctttcaggatctggtgtttaaatcatgaatgtcttcaccaacttcagctctgaaaatataaaaattttagccagtgctggctatagttaaacagtagtggtattatttgaaaaaataaaa

SEQ ID NO: 396459 - DNA, 782 bp, Homo sapiens
  misc_feature (782)..(782): n is a, c, g, or t
aaagtcataaaggagaaaataatgtaattattacataggttattaactaggctaatacatactgaaagattgccgtgttaataatggagattcaacaaactgcacaaagtaacttttttttctgtcttctcagtgttttaagtggtagatagcagcaaaaaggtcaagttacagttaagtcttgagactttgataagccacagactgaactctacctacatgttaagtagttaagttggcagtattgatgttgacttaattgctattaaaactatatcttttgccctttgaaaaacccagggcatttggatttgccctaaatttaagcacatctggtttttagtttaaatcctttttatatttagatgatttacttgtgagaagacttaactgtttttaagtataagtgagcatttctaatgcactaaaataggattgctttacaaatcagttttgaattcctctttagaaacccttgtggagtaaagtgaggtactatttacaattagatttgttttgacttcagtccatttagcaacttacatttgagctttatttcaatcttgacctattcttatcggagccttctggaccaaaatgcttctgcacggtcctacatccatatccggccaaaaacacaacgagacgacacgcgcgggacaccgtggcaaacaacgcgggaaaccaccacaggatcgaaacacagcgcacacaagcgtgaagaagagccaacaataacagcgcagcacaaaaggcagcttgttatctcagcaggcgacgcn

SEQ ID NO: 396460 - DNA, 134 bp, Homo sapiens
tatgacatttgggaaaatgcaaatctatgggggatagaagttggtgggtttccagtcacccaaactcttgtagagagcatggagggccagggaaaataaaatgatagtgaagctgtggtcagagttttctgatg

SEQ ID NO: 396461 - DNA, 472 bp, Homo sapiens
cttaagctctttgtaccattcttaatgtctatatgattagagaaaaaaatatgaagataagcaggaagacaaaaaatctgcttcagagcagaaactaattgtagtagctactataatgtgtctgcttcatgtaaacacagtgatcctgtttcttgaatggcgactcactctattccttacagcctgcctcctttcctcctgaaaccagtgtgagccatcactagtgatatttaaggtgccaaatgcaatatccattctttttctttaccttccataatttctgactctactgatgctctcttctctattggtatctaggactcagtattttcctggttttctttcttttttggatgctctctctttctctgatcacttctctgattcctcttcttcattctataccataaacccaggtgcactctaagatctatccttggccctgttctcttcctgctctggtaatcttaca

SEQ ID NO: 396462 - DNA, 740 bp, Homo sapiens
ttccgcggtccagggatgtggcttttgtgactcagccaacattcctattaattcaggtggcaacagccttcattgcttgccaaaatttgctgcccctgaggcaaggttgcctctctcagggcatgaggagagagagagatggtgaagtccatatcaggttgccaccctgattaaaaaaaaaggaacatctaggctcttaattttgagccactttttaaagctttttgaaggtctaatttgtataactgacatgcaacaaagtacacgtatccaaagtgtacagtttggtaaagccatgaaaccatcattacaaccataaaaatgaatttgtgtgtcacccatatatttaccttgtatctttttataatctttctcccttccccagctcttcaggttcaactgatttcctttacagtaaattagtttgcattttctggagtttttactgagatacatacacacacacacacacacacacacacacacgtatacgcatatacgtatacgtatatatatacatatgtgtttatatatgtgtgtgtgtatatatatatacttactggttttcttcatgctgtataattattttgagattcaaaaatgatgaatctttgtattgctgagtatcatgctgttctatggataagtcagtgtttatccatgtgtttagggacatttatattatttatagatttttgtatattacaaataaagctgctgtaaatacttgaattcatttc

SEQ ID NO: 396463 - DNA, 231 bp, Homo sapiens
gggtttcggcaaaggtgggcacaacgttgacaaagcgccggtgtactgcatccgccgcttagcccgacctgtcttcttcttcttcttctcctgttcggccaaaggctgagcctcccactttaaccagccaaggcagatgccagagggtctggatgaggagagcctgcctctcgggactgtctgccaccagctcactacctctctgtccctgagacttttctctttggccaa

SEQ ID NO: 396464 - DNA, 702 bp, Homo sapiens
gccattcaccttaggcacgcgtagagaagaagcggggtcctgcacagggttctttgctgctcaccaccctgtgtttcttggaatttgggaacaggcacatgggaggctgaatcgtggtcttcaaagatatccgggtcctaatcaaaatttgtaacttctagcctatatggaaaaagtgcctttttggacatgattaagttaagaatcttgagatggggagattacgttggatcatccaggtgggcccaatttgatgagtagtagccttataagagggaagcagaaaggtcaaaggaggaagcaggagatggaatcgtggaagcaggaggatgtgaggagagagtcacaagtccagggatgcaggtgcctccaggagctggaaaaggcaagaagacgcatgctctcctagagcctctggaggaaccagccctgcccacattgtgatgttaacccatgaaactgaggctggacttctggcctccagaacacatttattgcaagacaataaatgtgtgttgttttcagccatgaagtttggggtaatttgttatggcagacccaggcaactcctgcaggtggcattcccgttcacacctgtgtatggtgcctgccagcacagactgtttacctactcaatggctgatttgattaggcacagtttctcaatcctgataaaaccaatcgcttggtgaattatgcgcc

SEQ ID NO: 396465 - DNA, 525 bp, Homo sapiens
cgttgtgtttgtcgggaagatagacgagggacagagaatactcaggaaggcttcacagagggagatgacagttttgatgagtagtagccttataagagggaagcagaaaggtcaaaggaggaagcaggagatggaatcgtggaagcaggaggatgtgaggagagagtcacaagtccagggatgcaggtgcctccaggagctggaaaaggcaagaagacgcatgctctcctagagcctctggaggaaccagccctgcccacattgtgatgttaacccatgaaactgaggctggacttctggcctccagaacacatttattgcaagacaataaatgtgtgttgttttcagccatgaagtttggggtaatttgttatggcagacccaggcaactcctgcaggtggcattcccgttcacacctgtgtatggtgcctgccagcacagactgtttacctactcaatggctgatttgattaggcacagtttctcaatcctgataaaaccaatcgcttggtgaattatgcgcc

SEQ ID NO: 396466 - DNA, 477 bp, Homo sapiens
gcagctgcttttgattgaccatcactgcaatcttccccaggctttagatattttttttgacaacatccagatcagaaccaatttaattttgaaagatagctaatcaggtaatttgctgtagtacctctcttgtttttgattttgtaaaggaggctgggaggcttgcacgaagaaaccagcactttattgaagattacgaattgacccttcaggtatcataaaatgtttacctataatctccagaaacaagataacttctgtacattcatttcagcaacttgagcacttcagagagctgtgtgaaatggtggtacctatttacatggggaaagcttgaagctccaaacatttttttattatgtgatacttcctgatccccttaatgtttttagtgacttacgtagataaactctcaattttgaaggagaggagttgaacagtctcataatcttgattgcagtgatggtcagcagcatc

SEQ ID NO: 396467 - DNA, 370 bp, Homo sapiens
tttattataaaagtataattattccacaggagatttaagttaaaaaaaaaaactggttcactatagccatgtgatcataatttgtttaattaggaaacggtataaaaaattgccttgcggtaacggaattgattgagatttgaaaccgaaaaattcacgacttttgataatgaaagtgcctttttcctaattgtgattccagagattattgatttccttagaagtagaaaattttgactgtaccagcctaggaattctcacttgacatcatttagaagtattttaacttcaaaggatgtgttatttgctgaagagtggccactgggacgcaatatggctcttgacattttgaacagtgttaaatgatggg

SEQ ID NO: 396468 - DNA, 210 bp, Homo sapiens
cgcacccagccgcaaggcctattccctcctcaccttcttgtttgatgattcaaaagtctgggccttttcctgggtggtttttgtgagaaaggagtccttgctttcctagagggaggagctttatccaaactctgcagacgggctgagcactccctgtgcctgcgggcggtgaggaaatccaagtgccaggtccctcctatgtccctcctt

SEQ ID NO: 396469 - DNA, 230 bp, Homo sapiens
gtagtcccctcagcgctctgttgcattgagatcccaggaagtgccatcttggaaggttgtcattttgggggctgatgaggaaggtgaaacaatatttccctgtgtttactgtgtggggaaacagcctatgcaccaggttctccatgctggtggggcccccacatcactcatgactggaatgactgttttccgagcaaagatttgaatacgtgatctgacaggtacttatg

SEQ ID NO: 396470 - DNA, 185 bp, Homo sapiens
aacattcgctgagtgctgtctgtgtgtgtcacgctctgtgtgctgtggatattaagtgtttcactgcctttaacttgcagaatacagagacgtgtaacagcctggtcctcattccgccgatgaggaagcagagtcatctagcctgtaagtagaaaacgtgtcagacgtagtgtctatcccacgtc

SEQ ID NO: 396471 - DNA, 311 bp, Homo sapiens
gggaaactcaagaatgacactcaagtttctgattagaggatggtgaagctaatgaccaagaaggagacggtttcgaaggaaaaaatggtttcagttttgcacatgtgcctgtggcacatccatagggaagtatgtaggaggtagatggatatgcagcttggaacgcaggagacattccttcacctggagatactagagctaggggtcattagtgaagaaagccattggagctgcgggaaagggtgagcttgcctagagggtacatatagttcaggaacagaaccattaggacaatggcatttaaggaatgg

SEQ ID NO: 396472 - DNA, 268 bp, Homo sapiens
cattttgcaaaactgaaactctgaacccagtaaacagtcactccccattccctctccccgccagcccctggtaactccattgtcctttctatctctatgaatttgactatactagggacctcatataattggaatcatatacttcccctcgtgtgatgggcttatttagcttagcatttgaacatttttaataggcaactaatttctgctcttcttttatgacaagttattgattcatagaaaaatatggactgatcagatgtggctg

SEQ ID NO: 396473 - DNA, 139 bp, Homo sapiens
caaaagcaaagttttgggagcttatgtgtttgaaaagtacttttagtggattgctttctttattcttggttaaaggcagaagcatcttgacatttacattgctatttttctgctttcaaggatgctaacaaaaaaaaaa

SEQ ID NO: 396474 - DNA, 625 bp, Homo sapiens
acagaacatgacccagtccacccaaaggaatgccaaacccagcagagaaaaggtcaagtccagcaaaggaacgcgagagaggaaacgtcaatccaaggaggaaacgtcaatccaaggaggaagcgtcaatccaagagaccaacgccaagccaagcaaagaatgcaaagccaagccaagcggctacatgccagccaagccgttaacgcgcgtgcagcatgcacgtgcaagccgttacagggcagccaagccgttacgcgcgtgcggcgtgcgcctgcaagccgttacaggccagtctgacggttatgcgggggcggcgtgcgcgtgcaagccgttacaagccagccaagccgctgccgcgcgtgcaacgtgcgcgtgcggcgtgcacatctcagggggcgtcagtgtacgtggcacagacactggccgatgcgtgcaacccacgtgcttaagtcttggcgccaggaatgtcactgacagccctgtgttcccggcaaactttgtgggagtcagctgagctttcaggccattgagaagccgctggtgaaaaaaaaaagcctcttgaaggaggactggtatgttattgggggagtcctctagagtgacctcataatcaggtgcactgct

SEQ ID NO: 396475 - DNA, 177 bp, Homo sapiens
tctgtgtaaatattttaataggatggaaaagtaggactttattgaagtggctaatacactgtgacatcccagcagcagttaaatgggacagttttctccctgacatctctccctgtgggtaaattatccccttggaatgcagtcaccacagcatcctgacacatagtggctattttt

SEQ ID NO: 396476 - DNA, 373 bp, Homo sapiens
caggctggtctcaaactcctgacctcaggtgatctgcccgcctctgcctcccaaagtgctgggattacaggtgtgagccactgcgcttggccttaatttatttgcatataaagatttcagtattgggagatttggtgaaatttgtcattctaatccttatggcaattgattacttgaaaagctgacagctatattaccttgttattgatcttaaatataaaaaggcagaagttgtctaaattgagagattttgaatgtcttagaaagtatctgttaaggtggtagtttacaagcagttacattgtaacctaattgttgaaaaatgttatctgtgaaatacttgcatttccactatgaaaagcatgaaaccagg

SEQ ID NO: 396477 - DNA, 541 bp, Homo sapiens
cctatctttgcaaaataacttcattgaaagaaagatttaggacagtttttcacatagaggacaaaacatctgtgttgccaagaatctcttcttggcttgttaatgcccttatctaattaggaaatttaaggctaggtttgcaaagttacttttcatgagatttgggtgatttcatattaggattacacaatccagtttttgtgagaaagaaacaactattcactctatattctgcaaaatgtaattattttaggaaattagtctctaggttaataatgtttacagttctaacatctgtgttttagattttgtgagaaattggtgagaagagaacatgtggagataacaagtgatcccattttaaaagtttcaagttattatatgattaaattttgcatacaagctttttaatgaatatttttatgtcagcctaacaatttttatcaatgtgttttttatacttctgaagataagtatatcttccataaagtttaaaatgtttttgcctgggcgaaagagcgagactccgtctcaaaaaaaa

SEQ ID NO: 396478 - DNA, 209 bp, Homo sapiens
ccccccatcatatggaaaaattgtctcccaagaaaccagtccctggtcccagaaagttaggggaccattgtgttagagaactaaggaaaccgtcctctacctgccacataagaataaaggaaacaatggaacagtttccctactttccctaattaacacgtattcccattttgaggcagtgagttgctggtacctgctttctccttctt

SEQ ID NO: 396479 - DNA, 569 bp, Homo sapiens
gcttaatgacctacatacactagcttgcttaaacgcttcaactacctgtgacatattatattaagacccaaagtactttgttaacctgggccctagatggcaacctgctcacttcaacacgtctggagtattcaaacaatttattcccggttgtccagtttaaaagtaccaaggagttaagtaaaattttggcaataaataaactcccaatcttttacacgtaaaacatgtactgaatactggtaaatgtccattttttactactcaactaaaaattcagtacatttggctgagtgcagtggctcatgcctgtaatcccagtactttgggaggcagaagcgggcagatcacaaggtcaggagatcgagaccatcctggctaacatggtgaaaccccatctctactaaaaatgcaaaaaaattaaccgggcgtgctggcatacgcctgtagtcccagctactagggaggctgaggcaggagaatcgcatgaacccgggaggcggagattgcaatgagctgagatcacgccactgcactccagcctgggcaacagagcaagactccatctc

SEQ ID NO: 396480 - DNA, 599 bp, Homo sapiens
caaagtgctgggattacaggcaagggccaccaccccggtcccactgagaatcttgaatcctcagattcctctgactcctagagctgtaaaagtgacctatccatccctccctgttaagagctaaccctcctcccttgcttggaaaccctatagaggcatccacaagacgtttgtccctgtgcccacctcctctcctgcccacaagggttgtaactaggcttaaattccagcataaacaagccagggatgtgacgggcctcataggggaggaaagggcctatatcccaaagtagctggagggccaagccagcatgaccagcagaagtcgggtgagtttgtgcaggagtcaaccttgagggtgctcgatcagggggctgcagtgtgaggtcagataggaaagggtttattgattcggaagtcctttgggagttcagggctgcacacccaggcaaggactccaggagaaggtgtaaacttgctgccaggagggctcctagaagacgggaaaaagtaggaggccatgctaagtgagatccaaatgccagaattgccaggggagacggtggcagatgcgatgaaaggtcagggaagtggcaatg

SEQ ID NO: 396481 - DNA, 251 bp, Homo sapiens
tccccaacaactgcttacttggttaggtagggtgcctggttctctgctggccctctgcttgtgagagcttaggtaatagagatgagtcctattctgttttttatttttggtaccccagagcctggtatacaataggaggaactcttacttaaaattaatttatgattatttaagtttcttagtttttataaaaaggtttttttttgtttttgtttttgtttaattgatctttctcatttgaaaaatcaaaa

SEQ ID NO: 396482 - DNA, 461 bp, Homo sapiens
  misc_feature (17)..(17): n is a, c, g, or t
  misc_feature (33)..(33): n is a, c, g, or t
tcggtcgatctagaggnccccacgcgcaccgcngttcaaaacgaggcagctgtaacactgtaggtaagagatgataaaggcctgaactggggttgtgatggtgggatggagtttcgggaggtaaattcagtaggacatagtaactggctggctgctggaggagagaaaaggttcaaatatattcctgaggatctccctggcgcactcagattcttaacactaatatgagaatacagaatgtaaaccagaaagtaccttgagacgggtctcaatcaatttaggagttaattttgccacggttaagaatcatgaccagtgacgcagcctcaggaggtcctgagaacaggcccaaggcagttggattacagcttggttttatgttttagggagacatgagacatcaatcaatataagtggggtaatcactggtttgaaccggcggtgcgggcgagatggggcag

SEQ ID NO: 396483 - DNA, 491 bp, Homo sapiens
tcccaatacttgggaatcagattgagtcatcaaaagtcagtttggtgaggattagaagtgagtaagagttctcatccaagatttaataataaaaatctgatgacctacttgtgttttaattagtaatgaccttttaatgaccagtgtattgttgtccagttggtgtcatttaccctttagcagtaataatttcttaaccagctttccttttttcctattcctgttccatcatctaactttaactaaattattaaagtctctctctcataatgttctacaactaatttgctcttttgattttctttttgggtctttgtaagtaacaaattagaaacatttcagtcgagattctctcatgtactgtatacacatgaagtagatagaatgcagcatatcttctttgagtgccattcacgctcttgattattcttaatttagtccaaccttttaaaactttcaatttgtagaatacatttatgggcagcaaatag

SEQ ID NO: 396484 - DNA, 230 bp, Homo sapiens
cagatatggtgaatgatttcactctttgttgaaatttaactgggtgtggggtgggatatggcagattcacagggtgatgcttgtgaaattgaattcaaaatcttttaaatttctttcaacttttaaaaagtaattctgtctggaaattaatgtataaagagtgctatagtgttattttggaaaaaaatttcaaagagaattctgtttccttgacggttaatagtttggct

SEQ ID NO: 396485 - DNA, 141 bp, Homo sapiens
ctccagcctggggaacagagtgagaccccacctcaaaaaaatcaaaaaagcgaagatttaaaaattaaaataagattgttagccagttttttgtttaatgaaggaaaagttttccaaattaacagaatgggacattcagat

SEQ ID NO: 396486 - DNA, 394 bp, Homo sapiens
gtaaaagcaagtgatgtaatcttaactgatgaaaattatttttgccaatataatcttaggcaacagacaagcccaaatgataaatgatactgtaagaatgttagagaaggtcaggcatgatggctcacgccggtaatcccagcactttgggaggctgaggcgggcggatcacgaggtcaggagtttgagaccagcctggccaacatagtgaaaccctgtctctactaaaaatacaaaaaattagccaggcgtggtggtgggcacctataatcccagttactcgggaggctgaggcaggagaatcgcttgaaccctggaggcggaggttgcagtgagccaagatcatgccattgcactccagcccgggtgacagtgtgagactccgtctcaaaaa

SEQ ID NO: 396487 - DNA, 168 bp, Homo sapiens
taatagaagaatttttaaagatcctgtaatagaagaatactcaagaagcagtgcatcctcactggaatggcaaccaaagctaggaggaggttttggaagatccgatacaagagtgaaagaaagaaaggaaggaaggaagaaacccacaaagaacaccagctctgccaa

SEQ ID NO: 396488 - DNA, 824 bp, Homo sapiens
agcggggggagagggaaggcgaaggcgggctgagcccggcgccgggaggagtggtctaaactccaccgcggctttcgcatcggagacgtgtctttaggaagcagagagggttcgattctggactccgcccatgactcacttctcttgtaaagaaagagttgtccttcctggtactccaggtttatgggatgcaggataatggagcatgctctatctgggacattgctagtcttatgacagagggagaagacagcgatggtaactttgctgggactatgatagaatcatgaaatcatccaggcctttaaaaatgttcatcacaacatttaatctggacatcatttgtagcaattaccaccatttcagttttatacaacaccatgaaagggctcagctggcagtagttttcgaagaactccaggaagtggctgcagagcaaagtaggatcctgatactgatcacacttttgtcaagaagccaaagaacaaagttgattaaagcattatgcctggaaataaaggggaacaggacatcagcaaaattctttttatccattcacacattgaagacatgtaagatcaatgacacacaaaatggaagagaaatcttaatcacgcgtgtgaagactagcaggtatttttttcctgtgcacatcaacgggctgtattgtggcatatacatgaaagggtgaagtgcttgatgtctttagtttatgttttcctaaaactccatgctactaggagagaggatcccatcagtttcatcacaacaatgatcaataaaaaacaccctgccataacccaataccaaacgcccctcttcgt

SEQ ID NO: 396489 - DNA, 1118 bp, Homo sapiens
agcggggggagagggaaggcgaaggcgggctgagcccggcgccgggaggagtggtctaaactccaccgcggctttcgcatcggagacgtgtctttaggaagcagagagggttcgattctggactccgcccatgactcacttctcttgtaaagaaagagttgtccttcctggtactccaggtttatgggatgcaggataatggagcatgctctatctgggacattgctagtcttatgacagagggagaagacagcgatggtaactttgctgggactatgatagaatcatgaaatcatccaggcctttaaaaatgttcatcacaacatttaatctggacatcatttgtagcaattaccaccatttcagttttatacaacaccatgaaagggctcagctggcagtagttttcgaagaactccaggaagtggctgcagagcaaagtaggatcctgatactgatcacacttttgtcaagaagccaaagaacaaagttgattaaagcattatgcctggaaataaaggggaacaggacatcagcaaaattctttttatccattcacacattgaagacatgtaagatcaatgacacacaaaatggaagagaaatcttaatcacgcgtgtgaagactagcaggtatttttttcctgtgcacatcaacgggctgtattgtggcatatacatgaaagggtgaagtgcttgatgtctttagtttatgttttcctaaaactccatgctactaggagagaggattttgtttaattaacaattatttcaagagtcatactgtgagatgcaatgttaggatggatactgggggagcactagcagtgggttcagcaaggaactaggagatccttctgcctggaatactctctccccagattttatcatgaccatctccttcttgccgctaaggtaccagttccctaatcaatcagagtcagaactctctgactcatttctctgttttgttttttctcagaccttattgccctgaaattattttgtttacttttttgctttcttgtcttaccatctgtctcctatctccatgaatataagttccatgtgaacatgagacttctttgtccctataatctgtagagagtgcctggctc

SEQ ID NO: 396490 - DNA, 484 bp, Homo sapiens
tctccaagtcttcagtgctactaaatgtaatattcaacagtaaaagcactttaacaatgttagctgctattattataaggcatagtaattttattactccctccttggatttttatagaatgttataacctctgagtcacataaaataaaagcttaccattcttaaggaaaaagtaacttcaaatgagtatctgccacatacccatggtttcaaagagttctgaaatgaatccagcagattatgcctgtttatatgtgatgcattgtataaacatccttgaccagtgtatatttctggaggtggatttccagaattgataagtgccagccttgctatctgtattgtcttcattcctttttctgcctttttttgcttgataaaaaatcacttaagcaaatgtatgtggctaattgactcaagtagcacgttggaaactttttgtcttgttcgttaaacaaaaaataaaataccacaaaacattag

SEQ ID NO: 396491 - DNA, 577 bp, Homo sapiens
ggtattcccttttgagtggccatgtgatctcattgttcaattcccacctatgagtgagaataatatggtgtttggttttttgttcttgcgatagtttactgagaatgatgatttccaatttcatccatgtccctacaaaggatatgaactcatcattttttatggctgcatagtattccaagcctgttaatctttaatcaaattccagatattgtgaattttatatttttgggtgctggattatttttattcctataaatcttgagggttgatttgccattcagttattgtatttgtcaactttgctttttttttttttttttataatttgttaggccagtacttaaactaagcagtacttagtttagggctaaaaattccctagtgctaaggtaggactttcctgtgcactctacccgataccccataaattgagtttttctaatctggctactaagaacaggcactattcctggccccatgtgagttctgggtagtgcttgctccattcctttcatatgtttttttttcccccagtcttggatagtttcctcagtcacatgccactcatcagcac

SEQ ID NO: 396492 - DNA, 610 bp, Homo sapiens
tgtacctactgccaatgagatttgtagtttatatgggagatagatatacacgtgaactaaatatacaaagccttacaaaagatttacagctgtgacagtataagtctaaggaggactcaaaggaggtggaagtaatttctccaagacctgctgtcctgggtaatagaaacataaggctaatctgtgtgtaatttgaaactgtctagtagccacacaggttaaattgattttaataatttattttgttgtatttaatatatccaaaacattataatttctacatgcagccaatataaaaaattttaaggtatgaaatgttttacattctttttttcatatcatgtattcgaaacccaatgagttattttatacttacagcatatctcaaactcaggccctgaatgtttgtcagaaatacatggtttgtatttagatttcattaaattcacagttaaaaaggtagattctcataaccaagttccaaagatacttaaacgttttccagtaactgaactgaacatgagttctaaaatttaaattgattgacactgaatgagatttgatattgacttcctcggttgtactagccaacttcaagtgctcaatagcc

SEQ ID NO: 396493 - DNA, 351 bp, Homo sapiens
  misc_feature (10)..(10): n is a, c, g, or t
  misc_feature (25)..(26): n is a, c, g, or t
gaaaccgttncaaaaccagctcggnnccctgtattggtggtgctctcacagcacgctgtctccacttcgctcttctctgtccttcacctctccttcatccatttatattttcttggtaacttcagttacacgttaaggtatgtactggccatagtgttttaacactgagaattcaaagacaaataatactccgattttgccttctcatagtgtataggcttcataggtgcacagagtgctgtgggagaacacaatagagaatgattaaacttgtggagggtgtgggggcagtttacggaaaataacactgaataggaatttgccaaactggggagagggagtcatgtcaaa

SEQ ID NO: 396494 - DNA, 589 bp, Homo sapiens
gacctgcaatgaatttatagttcatgggtgagtgttacagtgagcatgatttattcttcaaggtattaaaacctgaagaattgtatttagtatttaactctcccactattcatccacaaagccctttgatgaaatcgtggcattttatcttctagataatcttgtgttcactcttggctgctactacctaagggtcaaggagggaaatctcaagtcttgctacccgccttaccttccctggcagggctcccttctccagccccgactgtcgccgtccagcgtacagaggtgttcagatacacagtttaaccttataactgtgcagtgaatgcagaggcaccagctgtgtactgttgatgcacatgagaagcatacctttatcttgcctagttccctttgctcgattaaaggctctagaaaaatcttccagcacctcctgttcccaattcctgttactttctagatttctctattaggagcctcaaagctgtggatgtttgtttggtccacctcttcccacccttccccacagactcccccattcccttcagcatccctttcttaccctcatctcctaggaacccaggac

SEQ ID NO: 396495 - DNA, 248 bp, Homo sapiens
tatttccaaccaccaccacctattgtaaccaatctcattattttcttatttattcttcttatgttttactttgcagaaatgaacagatgcaggtatatttttctcttatttcttacctaaaaggtacatagtatagatactatttttcttttcccgcttaacaaaagatactggaaatcaccccatatcagttcagagaaagagtctttgttctttatcatagctgcatagtactccattatatggag

SEQ ID NO: 396496 - DNA, 195 bp, Homo sapiens
gggggtcactgggagagtttgtggggcatggcgaccactcccatgttaaggccctcagaatccaacagccttcttagcaaaagcgccttagctagggacaatagaggctaatttgcatctcatttacatgctcttcatttccaggcaaaatgatctgatagcaagcaccctcaaccctttccttcctccctgaga

SEQ ID NO: 396497 - DNA, 564 bp, Homo sapiens
gatatattacgtagaaatagacatgtcgtgtagaaacgcggctttatgccaatactggaagtttgaagacatagtgtttctagttctaataatcatcatgagtatttaatacatgcctatggtgtactagggagccagataatgttttaagtttgttttcatgtactaactaatttaacatctaactaattttagctgaattttgaacgagttctgataaaatagctagtcagcccgcgcgtggcagagatgaaactcgggcggtctggcccccgtgctttgggtctcagcagctccacgctccacatagatgttttgtaggatccttaaaacagaagtgcagtaatctcgtataaccactagatggcactgcaacttttgtaacaggggacttagccgggggcaggaggggttcttgagacaaacccattttttatatttgtcattggtcacttgcaagtagagtcatactttaaataataacattattccctttaagaattgtatattttttatctatttaaagaaaacagttgtccttatgaataaaatgacttcaaatta

SEQ ID NO: 396498 - DNA, 355 bp, Homo sapiens
ttgctattttaaaagagattaaccacaagtatgctgatgcttttgaacatcacttccttaataatttttttaacggaagtacaggagcttcacagtctcacaatgaattttaaaagacaattatatggagataaaagacagcataaagggtaagagaaagtattttggagccttatgaatctggatctgagtcctgactatgccacttactgctattgcactggaggcacatagaaagatttttttgtttgtttgttttgctcagccaatagtcacccccctttctttttggggaaggtacaatgtaccacttctcttcttttggggtttgagttgcattgagctgatcttcctg

SEQ ID NO: 396499 - DNA, 431 bp, Homo sapiens
agaggtgccaccttcagagagcagcctcctcagggggtcttgttctggtgagcagcaggcacctcttgcagcccactgaccctgtccttctaagggcacctgtgccaccatttcccaggcctggcaggaaatgcccccagaacacctgaagcttccttgcccatctctgagctaggccagggattcctctgatatttccccaggccaggctctgtaagcacagctgatcccaccctgaggggtcagggaggcagatggccactgatcaccagagcccaaggagtgggaggagcccttgtctcagggatctgagccacctttatgccacctaccatcatctggagtttctgacttcatggttgggacaacccttgggacctgtcccatccatgctcatgtggggctcattctatggtgggttgcaggcagga

SEQ ID NO: 396500 - DNA, 383 bp, Homo sapiens
gtgcacctcctcacgagagagaaacagagactgtccctggtggggaatgtaatcctggatgagcccccacattgttatatgtaaagtttcggtgccacaaaagaaatagcactcagatataaaattttctttttaattctcagcaaggcaagttacttctgtatagaagggtgcacccttacagatggaacaatggtgagcgcacacttggacaagggaggggaaggggttcttatccctgatgcacgtgaccctttgctgccgtgttgttcccctgtcggctagggttagacgcacaggctaaactaattccgattggatgcacaggctaaactaattccgattggctaattaaaagagaatgacagggtgagtgctttggc

SEQ ID NO: 396501 - DNA, 485 bp, Homo sapiens
acattatgtatagatatagatgtgggatcataaaatgtgtttaaaagttattgatgcaggacaactttgcatatcaatacacaagcatttatttgatttgttttaatagctgtgaaatatcccactgtatgaagagactaaaatctgtccttgtgttgtggatatttggattgatgaaccattggaacaaaacagagagggcaatcaaagcatttgacagcctggcagatcaaagtgagaggtttattacagaagacagtaatgctaaaaggggaggagagctaagtgaatccacctgctgcaatcagagccgagaatcccaccaccctaaaagccaggagacaacgcggccaaaagggcagaggcccccagggctcccagccatgccagatgcaaacttgtcatcccaccctgtgtgtgggcttcctatgccctggacagtctttcctgaggcagagctgttttaagagcttagagcacacatt

SEQ ID NO: 396502 - DNA, 536 bp, Homo sapiens
tgagacggagtcttgctctgtctcccaggctagagttcagtggcgcgatctcagctcactgctacctctgcctcccaggtcaagcgattctcctgcctcaacctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtg

SEQ ID NO: 396503 - DNA, 283 bp, Homo sapiens
ctcacacagtttcctctagccggaatgctcttctttccttccctcctgatggaatcccattcatccttctaggcacagttcaaatacccctcttttgtgaatccttccctgacctctttaagccccaatttagttgcctatctaacccttatccaattctctcttataactttttcttatataatcataagtttgatattttctaagtgttttgcattttctctttgataggtattatatgctttacctgtctgccaggacatggactgtttctgagtgctga

SEQ ID NO: 396504 - DNA, 412 bp, Homo sapiens
aagccctattattattgtatgtattttaaagcattgtacttagaaagtttctttaggctttaccagagtgaaagatgagtccatggcacagaaacaaaaatatgaagaaccttgcctctggattggtagtcacagatgaaggagtgtgggttcttgaatgatcacaagatgagagctgccatttgaaaagtagacccttgcttgaactattaagggtaggagcaatacatgtctattgtttttggtctattatatgttatggagtacatttgttaacccagactgccctaccaaaactcatataatactacaatattttcttcatttgtcattccctatgcaaaaaaataccataagcaagaaagaatcaggaaataaaaaggatgatctaagtaattacatggaataaaga

SEQ ID NO: 396505 - DNA, 539 bp, Homo sapiens
agatttatggtgccattcacagctggggttgtttaattaaaaggacaaaatataaaccaaggtgcttttatcacagagaagggggctggctcagcaatcaagtgcttagtgaggacagctgcagcagtggtagcaggaaggaggcctcactagctaagaggtctagagttctgcagcaaaaacaaggccacctggagtgggtgagatccacaaagaaggctgtgagaaaggaatagagttcatccaggggcagccagacagacaggtgggaatgcagacctcattccccaggctggaagccagccagcagggctgcactgagagaaagtggcaactacccgggatgtgtacatcctgggcaaaggtgacactgtgccagcaatggaagtacttccttataaccacaatcttctcaaatactttaaaacagaaagatcttctgaaaggagtctccaggtgggaaggcacacagatcagcaatccccacattctcagctttctagtctccctcaatttcagcagcacaggcactattatgg

SEQ ID NO: 396506 - DNA, 496 bp, Homo sapiens
tcgtgaagaaaacaagaaactgaattttcttcaagtattttaaaagaaataaagttttattatttctatacattacacactgcaggctaaccaaaggtaattgagtagacttctttggcttgtttaagagaatgttaatttgtgttgatgtatgcactgtatcaaacaactactactaaagttttttaaaaatacttatccagtgaatttattccagttaaatgttacttcattcagtattcaataaatacttactgtggacattacagccagccaatgtgctaagcacacaatatatacatcagtgaataaaaagcataaacctaaggtaccaactaaacatcaacatcacaatcagtgtcattctatggggcactggacactttgtaagtctgaccttttaatctaaaaacaatctacttggcaaggtaggtactttatatcccaacttcacaggtaactaaagaaagttaagaggcttaagtgtatttcctaa

SEQ ID NO: 396507 - DNA, 553 bp, Homo sapiens
ccaagtttcttgtcccttatgtctgttcctagagcactttgtgtgcatttctgtcagagaacttatcacagtacattacagtcgttggtttgcttgtctgggttttgttagtttgttttttgagacaggttcttgctctgtagcccaggctggaatgcagtgatataatcatggttcatgcagccttgacctcttaggctcaagcgatcctcccaccttagccttctgagtagctgggactacaggtgcatgccaccatgcccagataatttttttatttttgtagagacagagcttcactgtgttgcccaaggtggtcttgaaatcctgacctcaagtaatcctcctgcctcgaccttccaaagtgctaagattacagacaagagccactgtgcccagccctgttttctccagtaagctgaaatttcttctatatcggattcctctgtatatatcaagaatctagcacagtgcctggtatatattagatactcagtacatgcttattaactagacaggtgaatgcccaggtttctaaagttttttttttttt

SEQ ID NO: 396508 - DNA, 300 bp, Homo sapiens
cccactagaatgcaatggtgcaatcatagctcactgcagcttctaactccagggctcaagcagtccccccctcctcagtgtagctgggattacaggcacacaccaccaagtccagcctgggtgacaaagcgagactctatctcaagaaaaggcagttctcctcagattttatctatagattcaacccaatccttatcaaaattccagcaagctttttttgcagaaatttacaaagtaatcataatatttatggaacataacgtggaaatgcaaaggacccagaatagccgaaatgtctgg

SEQ ID NO: 396509 - DNA, 407 bp, Homo sapiens
tccagtacaacaagaaaatcctttcctaattccacattctgcatatcgatgagttctaaacatcctggactgctgacccaaaagggttccctgagaaaactcctctagatgatgcccctgattctaaaaattcttgtctatgttctcagaagtgtcctcagtactatggagacctggggaaaaaatagttcagagtcccagtgatgaacaagtttaaaatctaattgggaacatgagacctatacacatgaatctgtgaaaacaacatgagaaaggatgtaatgagatgttaaattttgtgttgttaactctgctttaggactttatgcaagagaggtaccaaggaattagtgcacttgggtagatgggatttgtgctgaatcatcaaggttgaatgagactcaggt

SEQ ID NO: 396510 - DNA, 344 bp, Homo sapiens
cacaaatatttcaacaaaatggatacaatgaaattcattgagttctgtttcaattcgtagagtaacaaattctatggaaagggaacatagtatttcttttgacaaataatactattatcatattatctgttattctttttggcaattgtcacaaacattcataactcttgacttatggtaatggtaattacagaagtaatggtcttctgggagtacatccttaagagatacttaaaatttgcaaaaagatttttgcaagagttaggcttatgtttaggacataaaaagatgtgaaagatcttccttcactcccactgaaacaatgttacccaataaaccaaaca

SEQ ID NO: 396511 - DNA, 471 bp, Homo sapiens
gattgtttgccttttacctgatggatgtcaagagtactttgtatgttttaggtgtatgttttaggtgtgtgtttaggtgtatgttttaggtcttttgttgcgtatgtagttcggaaatacgttctcccagtctttagcttaccttttcaaccacttaaaagtctttctcaaaataaaagtttttaattttgctgaagtccagtttttcaatttttccttttatacattttgctttttgtataagatctccttgcctagtcctagaccgtgaagattttgtcttatgtttatatttttttaaagtttcatagttttatattttacattttcattcatgattcattaatttttttaatgaagtatgagttttaggtcaattttttttttttggcttatagttgtccagttgctctagcactgtttgttgaaaaggctattcttcctttgttgaattgcttttgtacctttgta

SEQ ID NO: 396512 - DNA, 386 bp, Homo sapiens
agatagtacttttttgttttctcctgtgaatgaggtgctatttatggatattctggattctgtcaaaaatagtaaacaacttattggtttctatttgatggtattaacatgctaaaaaaatggtgtattagggctaaaagggatttacaggatatctccttcaaatctcacattttatttttattttttaattttttagaccgagtctcactctgttgcccaggttagagtggagtgacgcaatcttggctcactgcaacctccgcctcccaggttcaagagattctcatgcctcagccacctgagtagctgggattacaggcgtacaccaccactcccagataattttttttatttttttttatttttagtagacatggtgtttc

SEQ ID NO: 396513 - DNA, 514 bp, Homo sapiens
  misc_feature (11)..(11): n is a, c, g, or t
  misc_feature (106)..(106): n is a, c, g, or t
  misc_feature (209)..(209): n is a, c, g, or t
tagctcgtcanactaaaaatacaaaaagtagctgggcatggtggcgcacacctgtagtcccagttactcaggaggcggaggcaggagaatcacttaaacccgggangcagaagttgcagtgagctgagattgaaccactgcactccagcctagcaacagagtgagactctgtctcaagaaaaaaaaaaaaaaaaaaaattagccgggcntggcagcgcatgcctgtagtcccagctacttggaaggctgaagcaggagaactgcttcaacccaggaggcagaggtcgttgcagtaagccaagatcgcaccactgcactccagtctgggagagagcaagtcacagtctcaaaaagaaacaaagtttccatcatctcaaaatgattccctgtggcagccctttggctgttacccccagatcctttctccaaaccctcaacctgaaggaaccgctaatctattttctgtctctgtggacattcatgtaagttgagtcttaaaaaatgtggtcttttg

SEQ ID NO: 396514 - DNA, 273 bp, Homo sapiens
ccacggtgtccataaattaaattagaatatatggaaatgtgattgtatttgttcacatttcaagtaaataatcttaaacagaattatgaaagatgccataaacgatcttatttttcctctaaagatattgaaaagttttctgaatcaaaataatctttaaatacacattaaacacgcacacatacacacacacacacacacacacacacaaatatataaatatccttttcctatctttttgaagggcaataagatcgtttatggacaccgtgg

SEQ ID NO: 396515 - DNA, 552 bp, Homo sapiens
ggaaattaagttgggatatgttagaaatgggctatagtgaggagaagcaaacacacagaatgtaggaattcacattcacatatatgaaagtaggcttttggacaagaacattggtgtgtacttttgagaagagtattcctccttttataccaatgagtgcacacagattcacacagatacagacacaaagagacacacactttttgttttttagtgataacttccaaagtaaatgtacaaatatttgactcaaaataacttgacattttcagcctgagtctcctctcctctgttcttgactcaattgaacacacacacacacacatacacacacaaacacacacacatacataccctagtcctaaagctggtatcttatttaatggggaaacactaaaggtactttcagtaagatcagtaatagataccctgctggtattcacctctgctagtattcaccgctagaggtattagcaaatgtgattaaatgagagaagtcaattagaagcattagaacggggtaagaagaagtaaactcttcctgcagatagt

SEQ ID NO: 396516 - DNA, 265 bp, Homo sapiens
taggtttggtagctattctcattctcattttacttcttattcattctaactctcattctactattttttacttagacgtagttttcttggtaagaaaggccatggtaagcagacgtagtgtgcacagaaatatgcagcccttctgggtgcctggaccccagtagcaccatagtcacccgtaatagccacataatagccacgcctagttctaagagtgagtagagttggaccaagttgtgaaacttcaagtttgcttttgttttta

SEQ ID NO: 396517 - DNA, 288 bp, Homo sapiens
taggtcaggatagaaccttcatggactctagtgttctattgcacattaagcctcaaattaacttttcattctggtttccaaccactctgtccttacaggtcatgaaaggaacaccaatgttttgcaaactatgggcagcagtgtttttgagggtcatgatcagtttagtgtagcaattctctatcttttcttaagatcttaggacccctttattcttgtaaagagtgagagccccaaagaccttttgtgtatgtagatatatttaaaaattaaaatagaaaattttta

SEQ ID NO: 396518 - DNA, 354 bp, Homo sapiens
tgatataaaatataacaaattattcctcaaatcattccaataattctcaaatcatttcttaattttttagatgctgttggaaagggcttttgacttcccttgtctgagccatgatttgatatgcaaagtatcatcaaactcttcctatgacctcctccattaaaatgacagttatcaggcaactgggttcctgccaatgtaggggattcacacaggcttgcccccattgtcagcttccaattcccccaaccattcctttagtctctgttcctctctcatcatactctctcctccaaccaataggggacgaaaggagtagaagaggaaaaggaaggaaggaagaagaaaagaaag

SEQ ID NO: 396519 - DNA, 222 bp, Homo sapiens
aagctcccaacaagataacattagcaggctagagtaatttattttgcatattgtatatcacaaagcctgataaatattaatatttagtaattaaatattgatctcaacaaatataaaataagttttaaagataactttgagaactgtcatttccatttattcaaatgtgcatttcattgtcctttttttttggagaccgagtttggctctggtggggagctg

SEQ ID NO: 396520 - DNA, 577 bp, Homo sapiens
aggtcacccctcagcagcgcctcccggatgcaaggagcaaacacgggttcacgtcctgatagctgagaaaatgactggcagtgactgaaacaacagcatcccacacacaacacacacatcaggatgtttaaagtatatttatggtgactgagctgtcacctgaacacgtgacgtacacgcgatgctctgaggaaggaaaccgtctaggaaccaagagtcacggagctgcctcccgcgaccgccttcctcaatcactacaatgaaaacacgcagtgagctgagctgcagtgaagacaaatgactctcagtgcttcgttttagcatattctaaaaatgcaatttacaattcagcaatatcctttctttttatgtagtcactacaacacaaacatgcctctttgttatctcgaactacatctgcatgcaaaacacgctctggctgggaaaatgtaagttctggggaatcgaaacccatttttcaaatctgaaagagatggagaaatgaaaagaaacgaaaaggagaggagaaaggtacattttattcacatgcaaaaaaatgtaaatgaaagctggtttc

SEQ ID NO: 396521 - DNA, 196 bp, Homo sapiens
ccaggtgatgtgtccgttttctggaagtagagcgcaaactcagagagaggccggggctggaattccagctctgcggccccatctgcatgagtgtccctctccttgcgggtaaattgagggcaaggatggaaccttccgcaccttgtagggtgagaacgaagtgagaagtgagcagatatgccccaggcctctcgca

SEQ ID NO: 396522 - DNA, 281 bp, Homo sapiens
tcacttcatgtgttggatcactgcttttcaatatagctgaaaagactctgttgactgggctcagctcattgcacaaagcctgaaaggcccaatgattactaatgggagcatatggtcagagctaaaatccataatcccaatccctagaaaggtatcttcactttttccacccagcatctttattctcttcacatgcttaacatcctaacatgtttttctctcttgctccctcttcaactaaccaatcccatgctactttcttctacctatttttgcactgt

SEQ ID NO: 396523 - DNA, 229 bp, Homo sapiens
ctcatcactgttttcagcgtaatctaaagagactgtcccagctgagaatttttggtagtttctcatatgttttgtgtgataactagatcatttggggaattttttatcctcaaactattcaaaatctggaaattgtcttaagtcaccctgagtgaaagtttgcaacattcttgacaaaataaagaatttagaaaggacagtcctttctattctgttcaggatggttgcg

SEQ ID NO: 396524 - DNA, 559 bp, Homo sapiens
tttcaggtatcattcgaagtctcgcagctcacacattaaaccctgatcaggatgttagtcagtggacaactgcagacaatgatgaaggccatggtcattagagcttttttctataccagttgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaaataaccattatgatggtggtagaagcactatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggagcacctgtgtgccatgacaggtgttgattgctgcatctccagctttgacaaattggtgctcaccttagccaatgctgggtgtaacagtgccagcccgaaacattgtctgaatggtg

SEQ ID NO: 396525 - DNA, 686 bp, Homo sapiens
atggcagggccaggcgcagtggctcacgcctgtaatcccagcactttgggaggctgaggcgggcagatcacttgagataaggagtttgacaccagcttggccaacatggtgaaaccccatctctcctaaaaatacaaaaattagccatgcgtggtgctgcatgcctgtagtcccagctactcaggaggctgagggaggagaatcgcttgaacctgggaggtggaggttgcagtgagccaagatagcgctactgcattccagcatgggcgacagggcgagactctatctcaaaaaaaaaaagaaaaagcaaatagagtaaatggcaggagacaaaaggatgtaatcaaatttgcattttaggaagactgttttggaggttgaagaaaggtgcattagtagttgtggaagagacaaaacccagaaagatgagttataatgttactaaaatagtcaaggtgagagatactgaagacctgaactaaatcattagcagaggaagtagagaaaatttaattatgagatatttaagaatcaaaatctggccgggagcagtggctcacgcctgtaatcccagcactttgggaggccaaggcaggtggatcacgaggtcaggagattgagaccatcctggctaacccagtgaaaccccgtctctactaaaaatacaaaaaattagccgggcgtgg

SEQ ID NO: 396526 - DNA, 421 bp, Homo sapiens
caccttgccaggctaatttctttattttttttgtagagatggggtctcactatgttgcccaggctggcctcaaactcatggcttcagacaatcctctttctttggccttccagtgttaggattacaggtgcgagccaccctgcctggcctgtttatgttattttagaacccgtgctcactttgtgcagagcaggatgttgagaacacatccttgaccttatggactttagaatttaagaaagagataattcagatttttgcagtattcaggggttaacagtacaaagaagaacatatgtagtattaccgaaaagagtagtacttcatgacaaaagcctgatatggccgtatgtggctctatcttgagtcagaatgctttgtgtgcagtcaggaattgttgggtgattggtagagtagagat

SEQ ID NO: 396527 - DNA, 1529 bp, Homo sapiens
gcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcagaaaaggttgaggaaaagaactttggcagctcgcacgtcatgcaggtcatctacacggacgacgccggcaggccccagactgcctacctgcagtgcaagtgtgtgaatgagcttaaccagtggctgtctgtgctgcggaaggtgagcatcaacaacaccggactgctgggctcctaccaccctggcatcttctgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggtgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctcccttgctgagtcccctgccaagcgctcggagcccctccaggacactctgcaccccctcaccccggtcctcctcattagggtgcagggcctaggtctcttccaagtgggggaggggggagagtcaggaataaggggatccccagaagtgcagagctgagcaggcttgggcctgtcatggctggcctgaagtgtccccagctccctacagccgctgtagccatcactgcctctccagggaccctcctctcctgcctaggacagacccagccagaaccactgctaggatgggccacacccaggggtctggcctccagggacctagagaatgggagggagaacggggccccaggagacccggccgccaccccacccgctacccttgggtgccacagggctgtgctgttgccaacagtaaacctgctgttactgtcaaaggctctggg

SEQ ID NO: 396528 - DNA, 3235 bp, Homo sapiens
  misc_feature (963)..(963): n is a, c, g, or t
  misc_feature (1064)..(1064): n is a, c, g, or t
  misc_feature (1102)..(1102): n is a, c, g, or t
  misc_feature (1107)..(1107): n is a, c, g, or t
  misc_feature (1112)..(1112): n is a, c, g, or t
  misc_feature (1119)..(1119): n is a, c, g, or t
  misc_feature (1172)..(1172): n is a, c, g, or t
  misc_feature (1264)..(1264): n is a, c, g, or t
  misc_feature (1406)..(1406): n is a, c, g, or t
  misc_feature (1460)..(1460): n is a, c, g, or t
  misc_feature (1471)..(1471): n is a, c, g, or t
  misc_feature (1638)..(1638): n is a, c, g, or t
  misc_feature (1892)..(1892): n is a, c, g, or t
  misc_feature (1931)..(1932): n is a, c, g, or t
  misc_feature (1936)..(1936): n is a, c, g, or t
  misc_feature (1938)..(1938): n is a, c, g, or t
  misc_feature (1954)..(1955): n is a, c, g, or t
  misc_feature (1970)..(1970): n is a, c, g, or t
  misc_feature (1973)..(1973): n is a, c, g, or t
  misc_feature (1976)..(1977): n is a, c, g, or t
  misc_feature (1981)..(1982): n is a, c, g, or t
  misc_feature (1997)..(1997): n is a, c, g, or t
  misc_feature (2009)..(2009): n is a, c, g, or t
  misc_feature (2013)..(2013): n is a, c, g, or t
  misc_feature (2021)..(2022): n is a, c, g, or t
  misc_feature (2026)..(2027): n is a, c, g, or t
  misc_feature (2035)..(2035): n is a, c, g, or t
  misc_feature (2040)..(2041): n is a, c, g, or t
  misc_feature (2045)..(2045): n is a, c, g, or t
  misc_feature (2047)..(2047): n is a, c, g, or t
  misc_feature (2065)..(2065): n is a, c, g, or t
  misc_feature (2071)..(2071): n is a, c, g, or t
  misc_feature (2081)..(2081): n is a, c, g, or t
  misc_feature (2084)..(2084): n is a, c, g, or t
  misc_feature (2091)..(2092): n is a, c, g, or t
  misc_feature (2098)..(2098): n is a, c, g, or t
  misc_feature (2102)..(2103): n is a, c, g, or t
  misc_feature (2105)..(2105): n is a, c, g, or t
  misc_feature (2108)..(2108): n is a, c, g, or t
  misc_feature (2115)..(2117): n is a, c, g, or t
  misc_feature (2121)..(2121): n is a, c, g, or t
  misc_feature (2123)..(2123): n is a, c, g, or t
  misc_feature (2135)..(2135): n is a, c, g, or t
  misc_feature (2143)..(2144): n is a, c, g, or t
  misc_feature (2146)..(2147): n is a, c, g, or t
  misc_feature (2152)..(2152): n is a, c, g, or t
  misc_feature (2154)..(2154): n is a, c, g, or t
  misc_feature (2161)..(2161): n is a, c, g, or t
  misc_feature (2175)..(2175): n is a, c, g, or t
gcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcagaaaaggttgaggaaaagaactttggcagctcgcacgtcatgcaggtcatctacacggacgacgccggcaggccccagactgcctacctgcagtgcaagtgtgtgaatgagcttaaccagtggctgtctgtgctgcggaaggtgagcatcaacaacaccggactgctgggctcctaccaccctggcatcttctgtggggacaagtggagctgctgccaccaaaaagagaagacaggtgggagaggaggcctgggtcccgggctctgcatccgtccactgcgagatcgggcctctggctgaacgatgggaccgtgagccctgctgtgcacctgcagggacataacccaaggaatgctggcccctccaggagctctgggcagaaagggtcccgtggaccaggtggtttgggaaatgccacgtgatgtgtgtgaagcanatgagtgaattcgctgaaggctctaaggaggcccgaaaacacgttagaatcccatttctttttatttcttcttctttttttttttcagacacagattttcnctctgtcccccagactggagtgcaatggcacgatctcngctcnctgcnatctccncctcccagggtcaagcaattctcctgcctcaacctccccagtagctgggattnccggcactcgccaccaagcctagctaattttttgtattttgactagagatggggtttcaccatgttagtcaagctgctcttgtttttttttnttgttgttgttgttgttgtttgataccaagtctcgctctatcatccaggctggagtgcagtggtgcaatctcggctcactgcaatctctgtttcccaggctcaaccatcctcctgcctcagcctcctgcagaactgggactncaggcacatgccaccacactcagctattttctgttttatttttttgtagagtcngggtctcactntgttgcccagactggtcttgaactcctggcctcaagctatcttcctgcctcagcctcccaaagtgctgggattacaggtgtgagccactgtgcctggcctcttggtgactctttgcaagggcattgctggctggctgatatggcctgcagcctctgcctgtaaccancagagcgatactctcattatcggcaaggtgggacccaccctgcccaagagacagggcctgttattccactgtatggaggagaagctgaggcttagggaaggcagatgacttggcaaggtcataaagacagcaagctgcaggaccagctcattctaaggcatgaaccccctgtggcccacctcaccatgatgttaacgtttcagcctgctcccttccaggcagacagttgtccagaaagttacccggctccctgnctgtgcgcggtggctcacgctgtaactcagcactttggnnggcngngacggcaaatcacganntcaggagatcgagancanccnngctnncacagtgaaaccccntctctactaaanatanaaaaattnnctgnngtggtggngggcnnctgnantcccagctactcaggagnctgagncaggagaatngcntgaaccnnggaggngganntngcngtgagcnnngatngngccactgcactncagcctgnncnncagancnagactcngtctcaaaaaaaancaaaagttacccagcaacccgagtcatatcctgatgatatccatgctcctcagtcacgcatcccgtggtgcaggggctgaccccaagaggagctgctgcccccagagggtggggagccgaggcagggcctgggtcagacttaccaggctatgctcccagcccagccctcaccagggacccccgagtgcatctctctcctctccaggcctctgtttctccatctgtgcaaccacagtgttggacatggtagtcccaagtgtctgcttgtaactttgccctctctgtgcccccaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggtgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctcccttgctgagtcccctgccaagcgctcggagcccctccaggacactctgcaccccctcaccccggtcctcctcattagggtgcagggcctaggtctcttccaagtgggggaggggggagagtcaggaataaggggatccccagaagtgcagagctgagcaggcttgggcctgtcatggctggcctgaagtgtccccagctccctacagccgctgtagccatcactgcctctccagggaccctcctctcctgcctaggacagacccagccagaaccactgctaggatgggccacacccaggggtctggcctccagggacctagagaatgggagggagaacggggccccaggagacccggccgccaccccacccgctacccttgggtgccacagggctgtgctgttgccaacagtaaacctgctgttactgtcaaaggctctggg

SEQ ID NO: 396529 - DNA, 1603 bp, Homo sapiens
ctccacccgctgggctaggctgggccgggttggactgggctggggcgaggggcgggcgaagagcggtggggaaccaggagcgctggggaggaccaggaggctgtgtcccggcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcagaaaaggttgaggaaaagaactttggcagctcgcacgtcatgcaggtcatctacacggacgacgccggcaggccccagactgcctacctgcagtgcaagtgtgtgaattgagcttaaccaagtggcttgctgtgctgccggaaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggtgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctcccttgctgagtcccctgccaagcgctcggagcccctccaggacactctgcaccccctcaccccggtcctcctcattagggtgcagggcctaggtctcttccaagtgggggaggggggagagtcaggaataaggggatccccagaagtgcagagctgagcaggcttgggcctgtcatggctggcctgaagtgtccccagctccctacagccgctgtagccatcactgcctctccagggaccctcctctcctgcctaggacagacccagccagaaccactgctaggatgggccacacccaggggtctggcctccagggacctagagaatgggagggagaacggggccccaggagacccggccgccaccccacccgctacccttgggtgccacagggctgtgctgttgccaacagtaaacctgctgttactgtcaaaggctctggg

SEQ ID NO: 396530 - DNA, 860 bp, Homo sapiens
  misc_feature (16)..(16): n is a, c, g, or t
ttttttaccccccgtnagctcatctcggtcgacttagagatccctgctgaaggtccaaacaagaacagtttgtaactcattagataagtatagtagggaacaggagagaaaagaagactagtgggaagtcaggaggatagtgtggagtaagtttctacttcaacattgaggtggagtattcaagtgaaagattaggtatgtgaccttgttagccttcaaggttaaaagcaggaaagcaggttaattgtcatgggacatgcaggaggtagaaaaggaggcggtggtggaacatggtggctcatacttttaatcccagcacttttggaggctgaggtgggaggatcacttgagctcaggagttcgagactagcctgggcaacgtggtaaaaccctatctctatgaaaaaataaaaattatctgggtatggtggcacatgcctgtggtcccagctactctggaagctgaagtgggaggattgcttgagcccaggaggttgaggcagcagtgagctgtgattgtgccactgtactccagcctggttggcacagcaagaccctgtctcagaaaaaaagaaagaaagaaaataaggcagaatcgttagaggaatcctgggaaattcggtgaattcagtgattgtgggcaaggaaattgtgatactaggcttgtgaaataaaaaaatggtgaatattgatcacattgggtaagtttgggaagagagaagctaaatttggcaagatttagaaaagaagataggcagtgagttgactaataaagcagagaggtagaaactaaggaaaaagaaagtgtggggccgggcgcggtgtctcatgcctgtaataccggcactttgggaggctga

SEQ ID NO: 396531 - DNA, 313 bp, Homo sapiens
atggaggtaaattaatttgatggttacttcaggccattgctgtatactctcagacagccatttttatatttttaagcacatcagtcaatttaaattaaaccagttgtttgggattttatatttatacagttttagttagggacggtggcctgaaataatgagctaagatttaaaagacataaggttatgaatcagttgatagactatagtaagcagagcctgggcaggaaggtccaaacaagaacagtttgtaactcattagataagtatagtagggaacaggagagaaaagaagactagtgggaagtcagga

SEQ ID NO: 396532 - DNA, 287 bp, Homo sapiens
tcaaaacgttgggattacaggacgtgagccaccgcacctggtccagaaagtagcttttgagactggcttctttcagttagcatttgcgattcctctgtgttgccgagtgtatcagaagttcgttgctttggatggtccagtggtatttccctgtgtggatgcattcccctttatccaaccgtgaggggcatttggttgcttccagtttgaggtgatcatgaacagagctgctatatacatttgtgtacatatttttttcttttttttcttttcttttcttttttttt

SEQ ID NO: 396533 - DNA, 384 bp, Homo sapiens
ttctatgaggaaaaatataaaatcagaatgagaagccatttgtggatactaaaataaacacgtcacagattcacagtagagaaacctgttattttgcttctttgtgtagcaaatttatcttggtgagctcttcatatcaggacattagagatttcctgcatagaacttaaaagtatggatataacaatttataattagcccctatcaatgtgatgggcattaaagttgtttgcagctttttgtagttaaaatcattgctgcaatatgtgaccacttgcatatatcatttcatatacgtgtgtatttctgtatagaatgtgcatttattataatgttctaggattacaggtgtgcgacaccatgcctggctaatttttgtatttt

SEQ ID NO: 396534 - DNA, 266 bp, Homo sapiens
cggcattacccataatggtcaaaagtggaactactcaactgacccatcaactggatcaatgaatggataaaaatgaatgggtaggccaggtgcggtggctcacacctgtaatcccaacactttgggaggaggagccaggaggattacttcaggtcaggagttcgagaccagtctgtccaacatggcaaaaccccatctctactaaaaaaatttaaaaattagctgggcatggtggctcatgcctgtaatccctgcacttcaggagg

SEQ ID NO: 396535 - DNA, 1073 bp, Homo sapiens
tgcctagctgtgaaagcttaggtggaatcataacattaaaaacaacaaacatggctccgcccaggcagaggtaggagtgactggcattaccctggtgcttaagcctaggagtgagaagcagaagcctccagaatttgaatcctgaacagataccacaaattcaggagatgatcagtaaacgtttgagctttttgtttgtatgtgtttttttttttttttgtagttttgttttttgtttgtctgtttgttttgcgacagagtctcactctgtcgcccaggctggagtgcagtggtgcaattttggctcactgcaacctctccctcctgggttcaagcaattctcctgcctcagcctcccaagtagctgggattacaggcgcgcatcaccatgcccagctaattttttgtatttttggtagagacaaggttttgccgtgttggtcaggctggtctcgaactcctgacctcaggtgatccgcccacttcgtcctcccaaagtgctgggattacaggcatgaaccaccgtgcccggccaacatttggtttttatgggaaagaaaacagcatcctacaacaaaattggttatatgccatcactgttaagggatatttaccttttgcttaaagtgtactacatgaaagccaaggagaagatttatagagctaggtaaaggctcaggaaggcaggtgccctgtggataagaatgtaggcagttcaggtgggaatcaggtctgtctgctcagggagaccagtgagagccagctaatgcctgcctgaaacttttgatttgactgtatgccattctcagagaaattattctttcttctggcattttcaactgaaaattcctttggtcttactttgattttgttactggaaatacagtgtgttttattaagatttgaaacaaaacattttttattttattttatttttgagatgaagtcttgctctgtcgcccaggctggagtgcagtggtgggatcttggctcactgcaacctctgcctcccaggttcaagtgattctcatgcctcagcctcccaagtagctagaattaccggtgtgcgccac

SEQ ID NO: 396536 - DNA, 328 bp, Homo sapiens
tgcgtcctttgttggatggaaactgcattagacacagaaacacagagctgctcttttccccacaggcaggtgcagacctgaaagagcgcctgaagcggctcagaggcaaggggaggacctcatccttaagtcacaggactcaggattagaggacctacagctttcagcctcggctcaccatctcctagccctgatgacccacagcctccccaagccttggtttcacagcctgtaaaatgggttcatgagcctacttttcatagctacactgtgtgtttgtatataacccatggctatcactattactgcggacgcggtgctatgaagt

SEQ ID NO: 396537 - DNA, 589 bp, Homo sapiens
cttgccttcccactagaatagtctagggctgtgtctgcttcatgactttccaattggctgatgacactttctggatggtcatctagggatcatggggtgggggcacagagacctgtaccatccaccccctccagttcctattccctgatatacctgagaatctcagagacttaccaaccacatgccccaatgttggagacctgaggtccagggaaggggcacaggagcttgcatttcagatgctctgacttccagcacctgccactcaacacatgaatgagagtgcactgatctgagagtgaagcagccttcccatgtccccccagagaaagagtaacactgcctttcatctccccatgacccatgcattcattcattcgacaaaggtttctagaaggccaggactgtgctaaacactggggattctgtgaagaacaggacaaacagagctttgccttcattaggtttatgatccagtggatggactgacaagaaacaagcaaacaaagaaatgagtacagaatggcctatttagataatgacatctgccttcttctgaagtgtaatcctcaactggccaacctgatgg

SEQ ID NO: 396538 - DNA, 140 bp, Homo sapiens
catttgtttatgtgtgtctatgtttggttttttaaatttatgtatctacctacctacctacctacctacctatctatctatttatttatttattgacaggttctcattctgtcatccagactggagtgcagtggcacaat

SEQ ID NO: 396539 - DNA, 189 bp, Homo sapiens
aagagccgtttgtgtgaaaagtgttgaaacactgaactaaagctgtgatgtggagatgaagacgagacagatacacattgaaaagataaaattgaagaattgacacagttgaattgataggaatttataaacaaccagaaaaagatcatggcaaagaggttaaggtaagtgggaattttggtttgggta

SEQ ID NO: 396540 - DNA, 517 bp, Homo sapiens
tacttttaaaaattagttctatgctcatatcctcacattgagatttaatgtatttcagtttaataaatgagaacatataaaataatttacctgtaaggacctgtctatgggaacttctatattctgcttgaaattctgacacattaacctggccatttccaaaaactttctggcaagagctcttcatggacctaataattgctttactgtttaatcattccctgagcctttttatactctagtaaactgcatctgtcactagatttcatcaccatctgtattatttatcccttgtaatctgatatctatctctataatgcccaattgtatccccttcaagtgcccacttcattggcttatatacattaggttttcaataaatatttttatataatggtaaatgaagaagttgttctttatattttaaacaactcttacggaaggagattacaacacagctggaaggaattattgtgagagtgaaacatggaaccaaaaaagataaagcaagggaaat

SEQ ID NO: 396541 - DNA, 529 bp, Homo sapiens
taactgggactacaggtgccatgtcaccatgtctggctaatttaaaacaaatttttttttgtagagatagggtctcactaaacagcccatgctggtctttaactcctgggatcaaacagtcctcccacctcagccttacaatgaagctggaaggtgaaagtgagtgtagtctgtctcatagcaaaggtactggtcccttataggactcattgtatccaccaacctcattcttgacatttcatttttgcctgtattctaaattttttcagagattgtgtgctttttttgaagttcaaggcaggctactctaaaagctcatgtgtgtttgcatactgagtatttttcttattggatatgtggatctattaattccataattcatttttgtgtgtaaagtgcacagacattttctttccttaagcttcaactctctagttgtattatactagtcttcccatttccgggtttttgtttttctatttacattactgtatgaagaggaggaagctgatcttgggatatcgtaagt

SEQ ID NO: 396542 - DNA, 177 bp, Homo sapiens
aaaatagatggccatagatctttcacataaacaaaatgagtaatcaaatgattttatgttcaactgaaaactaagagttttcatctggattgtaattacttggatgattctcactcatattctttgattatttatcaataggaatcacacagtgaacacattttaactaatataatt

SEQ ID NO: 396543 - DNA, 194 bp, Homo sapiens
tgtaccctcccagggtaatcttactcacaccatggattaattactgcacatagatttgatgactctttcaaaattttccctattggtgacttcattattgggcttcagacataaaagttcaagctggacatcacgccgtgttccacaggcatctcaggttcaatcagaactcaacccttcgcacccccgccttt

SEQ ID NO: 396544 - DNA, 256 bp, Homo sapiens
gacaggagacccagtggagtctagagaacatttcttgacgcaaccgttagtgtttttcatttaaaaaaaagattaaaataaatgcctgatttcccaagagaattctctgcccctttgaacaatgcaataattcaactccttatgtgttagactttcaaaagtagttggatcttagcaacggtataatagtaaaatagatgagaatacatttgacagtttccacttttctttttttttttttaacctgagaaatcca

SEQ ID NO: 396545 - DNA, 257 bp, Homo sapiens
ctgaaatgagactgaggctgggccttatgtagggttaccatatattttattgaccaaatcagcacacttttgagaaaagaagcagggactaccaatgaatacaactggaccccaggcacaaaccatgcctctcctgggccagcttccctgtgtgattaatatcaaaagccataaattttcggcaaattagtcatcactgggagtttgtattggagccacaatctcagcttattaattacagatgttcaaggagtttg

SEQ ID NO: 396546 - DNA, 621 bp, Homo sapiens
taagactgatcattttcccaagtatttgcttggagtacagtattaaacttcttgaaaattgaggttgaccttttaaagagctgattcttaactgtataaaccaagaaagaataggtgtaattacagtatagccatattgaaattagccaggctgaatgaagtcctctttggacataggtttagttcggcacagctggaatgaaaatttgcagccggtacagagtgccaccaagtggcgggttggaaagcccatgctagactgctttgagccataaggcttggctttttacttgaaaataccagtccaaatccgaaccttgtgttccagtttttttgcataagaaataaggcagctgggcgcggtggctcctgcctgtaatcccgccgaggcgggcggatcacgaggtcaggagttcgagaccagcctggccagcatggtgaaaccccgtctctactaaaaatacaaaaaattaactgggcatggtggcgcgcgcctgtaatcccagctactgaggaagctgaggcaggagaatcgcttgaacccgggaggtggaggttgcagtgagccgagatcgtgccactgcactccagcctgggtgacagcgagattccatctcaaaa

SEQ ID NO: 396547 - DNA, 551 bp, Homo sapiens
agagaaaggagctctccaatgggtatctgttgttttttgtttaataagcattttagtggcagaaatagatagttgtgttggggctcagaaatcaacatccccaaagatggtgttttgacctgttaaactgggatctctctgactcccccacccccactgtctctcccatggaatctggagttcctttatccacctaagacccaaacccaccaaggagaagaattattcttgttccctccctgttgtcattgtttattgcaggaaagaagaccaagatgtaagcacacctgagcagatccttttccaagtatcctgatgtctccaagggctgttcagattccaaagagaactatctacaagttaatctctgttactggagtcattcattctccgtagtaatctgctccacagaattcctcttctcttccctcccataacctgttttaccaggatccaagcctccattctttctgtaacctcattgggaagttggttcttcatttggaaggctcccatgtgtacatgttaaataaatatctatgccttttctt

SEQ ID NO: 396548 - DNA, 364 bp, Homo sapiens
ctacgacttatagtgagcgtgtcagtgagcgtgtcagtgctctcatgtacttgggacaggtctcacactcggacacaggaccggacgcagcagtagctcatgaggtgaagttggcagagactacatgtcttttacagtcctgcacaccctgacaggcgtgtcagtgccttttggaataattccttgacagaagtgacattaactacaaatattacattaccagatcgtcacactaagcagaaaggaataacctgcattggaataaggatttggaattaattcagtgaacactgcagcttgatcatagcttcagatatctctgccttatcattagcagcattctttattccccccgggctctgac

SEQ ID NO: 396549 - DNA, 499 bp, Homo sapiens
atccttgtatcccccgggaccataagcagatagttagtgcgggcccttgacatattgaccccacccgcatgaaccaggcaggatccctgagccatgccccagtggctgcaccactatgtcacctcctagctttagcccagggttcttatcacttgtcctagacactggtgggctaatgctgtgagaaggcagcaggaaggtgaatgtcttacggagaccccagatgtggcctcaagtcagccaggtatataagctggtgactttggggattatgtaccgttttgtaaatctagacactgggtcaacaccagaatctggtaatacatagttaacttgaagaaatgcttgagccaagttaataaacagaagttagtcagaaggactgcccattaggcaccgtggatggccttgaagtgagacatgtgggtctgtgggtactactgagggcttacacctcagtagtactagatgctgcagtgccagagttgctgactgcagg

SEQ ID NO: 396550 - DNA, 633 bp, Homo sapiens
cttaacttaaatagatgcatgctcatctctttgttatggaggataacatttcaaagacactgttctcctttgtaaatcactttcaagacagaaaaagatgttctgactcataaattcataggggactgagcctgtctcactaaatctcctccattaaactctccataaactcctccataaactcttagtattctggggcagaaccccgccacttcccaaggccagcggccattttcctctgtgtagcagtacaatcaattgcatttgaagtcttggatctgggctgagacagttaaaaatgcgagacactcagtatgaatgatcatccatgagccttcagtaggggaagtgggaaggaaggttcaggacaccatgtaagcatcttgaagggtaaaggcagtatttcccaaatcatgagaaaaatcaactacaccagaatcacctggagagactgactttttacaaaagactcctgggcttcaattcaatccttccaaattggattctgagagtgggacccaaaaatctgggctttgttcaaacaagtttttctgggaattctgagacacaaaagtttgaggaccggtgatttagcttatcttctgttccattgctgccaacctcattcagagg

SEQ ID NO: 396551 - DNA, 336 bp, Homo sapiens
ctaacgattatgacaagtttactctgtgccagccaccattttaagcacatcatatacttctccttcaatcattacaactattattattcccattttacaagtgaggaaacaggctcaaattaaatacctttctcaagggcacagctagtatattgtggaaccaggatttgaactcaagaagtctggttccaactgcatgctcttaaccatccagaaagcttccagtccatggaggatggggagtgggagatgctgtggtgatcatctggggataaaagaactactccagttgctgcaggaatatgtgaggtggaggggatctctggcttggctgct

SEQ ID NO: 396552 - DNA, 152 bp, Homo sapiens
aggatgggaagaaatgaacaaagaaccggtggcggcacacaacactccacaggtgctttgctgtaggggagcagaggaaatggggcagtaagtgaaggggtggcccaagggagtgagtgttgctgatgggagatccccagtgctttgcctgt

SEQ ID NO: 396553 - DNA, 432 bp, Homo sapiens
gccccacataaggcccactgacccacattctggaggtagactgtaaaattatagcttgcaaactcctccaggtgataatgatatggactgaagaatgagaaccactagtaatacagtatgcttttcattattacaaatattaactataaaataattggcaggaaatcttggtgagtgcttactgacattcaggaaatagaaggcctatacaagcatttattgttttaagtatgaatttttaaaggaaaagatggacacatctatacataaaatttaaaaggttcgtgttaacaaagacaagataaaaagctagggggaggaatgtaacataagatgcctttttattgactgaacaccatgtttagccatgcattgcctccttccaatatgagtaaaatgtatcagaaataaattcaaaattctcttttagta

SEQ ID NO: 396554 - DNA, 200 bp, Homo sapiens
tacgatcccaaccccagccattcccgcgcctggcctcgctccgcgatgcccatctttcccctccttgcagaccccgctcccgggttcctgtcttcgctctcctcgctctcttcgcctgctcaacccttccctgcccccatcctcccgctacccccatccccttcttctgtcccggcgcccctctccctcgtcggctcctg

SEQ ID NO: 396555 - DNA, 189 bp, Homo sapiens
cacttatccctctactggccagtgaacagcttctgcttcactgttactctctccataattcttggtgatttcaatatccacatagatgaggcttccatcaccttggactctcatttccttgaatgcttctcctccagtgatattgatctctgaccccacctcagtaactcactctcacagtcatatcct

SEQ ID NO: 396556 - DNA, 193 bp, Homo sapiens
tccttatttattatactctttcatatcattctttttaaaatttaaatcaacttgtctttgaattctagttttatttaatctatgattttttatactatgaaggactttcatagagtttttctctggtataagcaaattaatatattgcctagtgagcatattaaaatttttgagaaataataatttaacctgc

SEQ ID NO: 396557 - DNA, 558 bp, Homo sapiens
ctaatttcatagagaacaggtattacaagatctatagctttaaaaaaagaaacctaattctaaaaattagaggaaatgactcaactctcatgaaaaatcttttgcaattctgatttctcagttattagatgaattttcatatcttacatacttctttattagtctcaaacatttgtatttttctattcctcacttctttcctaagagatgtagatacaatcaagagaagttccaaatgcatgagcttgaaccagtggcttacaatgcagctaaagctcttgtcaatgaaggccagggttcttgtcagtttatctcaaatttctacaaggctactaaaattaaccagggagctgtgtctccatttttatattcttattgccccagccaaattctgatatagctaattgcttgtcccccacccaaaattctcttctattttggttaactcatatctctctgcatgatctaagcttcataggtacccatacccactagagctctggccattgggcaaatgtactgcatcctagagatggcagtatatgttaataaagagcc

SEQ ID NO: 396558 - DNA, 417 bp, Homo sapiens
cattttcctcaggttttgaggcatctttttaaagcttgcttttagtttcggattcactctatgtcccatgccatacacccatcagccgtctgcctgggagagtttctggaagctccatgcctcttcataggcacgttgccatgtaccacatggcaggcaggtgtgactggagcttggcattgcagagcccctgacttccaggagctcagagcctggcagaatggatattcaagaaagagccctcgtttctgatgatagggtctgtttgaaaagcattgtggttgacagagccatgccacgctgtctgcagaccagaggccgggcccctcgcagtgttgaaagttcagccctgccgttgtgggtagtgctccctaaggcaagggcagatgccagactattgttaagaagattatacta

SEQ ID NO: 396559 - DNA, 458 bp, Homo sapiens
aactccataagtttaaaataattttgccttatttttaaataaggcaaatatttttttaaaataaccttgcaattatttttttaaattttcatatatttaaatgaggcttgaatggaaatgtccatctataaacactaaagacaagcttaaattttaagaaaatttaaatttaaataataaattaataaaatttaaatttaaattttaagaagtaacttttaattagctaggtgtggtggcgggcacctgtgatctcagttacttgggagtctgaggcagaagaattacttgaactgaggaggtggaggttgcagtgagccaaaatcatgccactgcactccagtctaggcaacagagtgagactctgtctcattattcatatcttgttactcaatatttataattaaaaatataaaatgttggattaagcccactcttttcatttttcttaatcttca

SEQ ID NO: 396560 - DNA, 310 bp, Homo sapiens
cagttttactggcttctgctttgggtataaaagaatccctagtgggcaagagccttctctgtgacaggcacctgtcgaaactgatacactgtgctgtgcaattaggccttgtggctgtttgactgcctttcagtttgcattctcctaaattatggagagtttagaaaaactgtactactgacagcactactttctggacatacaaaattactttttgcacaatttacaccaaattcataagtcttactcagcatctgggtgttcttgctcatttaacatgcaggtgtataaaaaaaaagatgtataagac

SEQ ID NO: 396561 - DNA, 1082 bp, Homo sapiens
gtcatgcttttggtaactttttttaattactgggataaaactgcacattaagacatattcctaaaaataccagcaaatgcagaaatatacaaattgtgcttaattagcgtacagagtaatgcaacaagtcaatgcaataaatagctcagaacacctaaaaacataaacatttaaaacaatttaatgtaatcaagacaaaatccaaaatttcaatgtattttttatagttaacaactgttttgccttttcagaggtctatgaaagtgacctttcttggaagtcatgaaattggatattttccctcatgcatagtcacccaaaaaaatctgcctggaatcaagagaaatcatgccagaaactcagttaacttaaaggtaatctgatatgtggccttgtctatttcttctaggctataatttctctggggaaagagtgtgacttttagtgtccttaccagggaaaacagtaagcattttcttccctctagtgatacagcaaagatgagtgaaagtggaagatgtcggaaggtgaataggcaagtaatgcttgcaatacattttgatgttcctacagaggtctaaaaacttttggtacctctgtacttctggctgtaacctctaagcttattccattataaacttcaggccccagcttcattctgaggtgattgcgccattgagatcactggtttgttttcttcaactcactcgaaactttactggtatttgttacttcactggtattcactccagtttaaacattctcttctacagtcaaggtattgtttttaaaggactgttttatacaaagatttccctgaggctaagtaacctttacatactaaattcttcaaagaaagaaaagaaaacttttccctaaatatgaactctgatgttctgaagttacggtgattttagatcattttttccgatcattatgacatcagagcaaccttatgcaggcttttctgtaaagactcaaagcatggactttagcaataaataatacttcacattgtacactgcaccatcatttaaaaagcattttcaggtgctagctactcaggaggctgaggtgggagg

SEQ ID NO: 396562 - DNA, 367 bp, Homo sapiens
taccgtagaggctaggctgctgtaaaaaagaatggacaggctctccgtgtactgatgtgggatcctgaatcctgtccaaggtttatcaaaggaaaagaagcaaagtgcagaacagcgtggagagtatgttaactaggaagagtaatatatccagaatccagccacccctcactactgctattgctataaacctggtccgagaccaccaacatgtctggcctatattgtgccattacctcctaataggtcactcgtattctacctttgctcccctgaaatctattctcaacacagcagccagcttgagccttttaaattaaaaaactcatttcacactcaatattcggcaatagttcctcatttcact

SEQ ID NO: 396563 - DNA, 334 bp, Homo sapiens
acagactcttgacacgtttcacttgcccttgagtcagtctttccatgtcactgaatattcttccacaacacgattttaatggatatagtcgtccattgtttaaatgtaccattattgacctatgtaaaaatgttcttttacctcaaatttttatatgtaaaacaaaaacatgtttgaggaataaacccacactgtagtataaattaaactggatgtaggccaggcatggtgagtcacacctatagtcccagcactttgggaaaccaagacaggaggatggcttgaagccaggagctcaagagcagcctgggcaatacagcaagacctcatctct

SEQ ID NO: 396564 - DNA, 405 bp, Homo sapiens
cactgcacttgacatgtttcatttctcttattagcttcattttataaatgggaaatggggagctcaaagaggtcatgtaacctgtcctaagctgtaccacaccactttagggactcaatccctagcctgactgcagagtcaatgggctgtgactataagcactgcctcccagaggctggccctggcagctgaacaggatcagtgtagtcagacagccagcatggtgaactgagtcaaacaggtatagacagcaacccctcagaagtgtctgcacatagtagatgctcaataaatatttgttgaataaaagaattgaggcactttaggaggctgaggcgggtggatcacgaggtcaggagatcgagaccattctggctaacacggtgaaactccgtctctactaaa

SEQ ID NO: 396565 - DNA, 398 bp, Homo sapiens
aaataaaacacatctatggttaggtgggcctgtgggccaccagtttgcaaacttagtttcatctggggaacatccagaaccatcttctgcccagtgtggcatactataggcatgaaggagaggtaagattagtattttaagtttttgtttgttagcatctctataacaaggtttagtgagggaagtggtggacagagatgttaaaattgtttttagactatctgtggatttccaatattccatccatggccccagactgaaagtcaagagcagttgtatgtgtataccttccttaagccaccattcaatctttgtgctgcacaaagaatcagcctggtgagcactgacacacgacttcagctttcttcaaactgattgttagtgtgcagcactctgtt

SEQ ID NO: 396566 - DNA, 716 bp, Homo sapiens
ataaaagatgccaattgtttcctgcctctgggtcacttccacagctgaataagtggccctgcctccccagctccaagcctctggtgagtgcactgtaattggacacttgacctaagggttccctcagtagactcaccagtggccaggctggcatgacagtgagagagaaccaaatgggtttccctcttgagtacttgggacgttgagtctgtccatggtgagcgctggagctgagagctgaagccagagagatggggctgcaggtggggcgggcaggtgcaagatgaaggagcagatatgcaagaagccctgtggtttctgagaggtggaagatgctcagggggttcctgaagtctctggagttcctcaagtttccagtgattttcagatgcacactttgtccttggattctgtgagagcccccaggattctttccatcacatgccctcctcttgatttttcttccttatttaaagtagttgaagtaggtttctgattatgcaaccaaaaagccttcatggaacattcatgcaccttcctatccaccccactgggtaaagtgcatggttatgtgctaccaaaatgccaggaggtcactggcttcctactgaaaaacaaaagagttaaactcagcattgtatgatcctgaagtttctccctcaaccctctagttctacgagtctttggaattaatggagtttttgttgggacatttt

SEQ ID NO: 396567 - DNA, 275 bp, Homo sapiens
ccgagattgcgccactgcactccagcttgggtgacagagcaagactctgtcttggaaaaagaaaaaagaaaaaagaaagtcagatgtgattctcattgatggtggtgatggtgtgtttccaatcaggttggtgagatgagtacttggaaataggaaactcttcgaacactgactatttcaatatgtggtaatgcccctgagtgccttgagagctgggatggatcagagcagttaagaaagcttcctggaggaggaggatttgagctggaccttaa

SEQ ID NO: 396568 - DNA, 335 bp, Homo sapiens
tcttctagattaaataagactttgaagccataaaaaccaaatgcagtggttaaaagtcatttgtgaggcaaatgtgataatcactaccctgcagaaccaagtcagtaagctcatttgtatcttcattcaaatcagctatgaaaagacactgttgaaacaattagggatatttaaatactaatggagagagaaagtagggaataattgtaaattttattggatgtgatactagcattgtagctatgttagcagatgcccatatattttaggaatgcatattaaacatgtagaagtaaaatgggtagcatgtcttaattgaaaatattctgacaaaa

SEQ ID NO: 396569 - DNA, 204 bp, Homo sapiens
aatttagagcactaaatgcttccagtagaaaagtgaaaaagtctcaaaccaatatgcttccaccttaacaaattaggaaaaaagaagagcaaagtaaatttaaagcaagcagaaggaagaaaataataaagagcagaaatcaatgaaattgaaaacagaaaaacaataacaaaaactaaatgaaacaaaaacccagttatttga

SEQ ID NO: 396570 - DNA, 508 bp, Homo sapiens
atttttttgtagagatggggtatcactatgatgcctaggcttgtctcaaactcctggcctcaagcgatcctcctgccttggtctcacaaagtgtcaggactacaggtatgagccactgcacgcagcctaatgtgattttgttttgatacatgtatacattgtgtaatgatcaaatgatcagagtaattagcatatccaacacctcaaacatgtattatttctttgtgataggaacatataaatcctctcttctagctattttgagatctacaacaccttgttgtttactatagtcaccctactgtgccatagaacaccagaactataaaaactcttgaacaatgagatttgatgagcttccagattgctgaacacacagaggtgcctggaaggttatacacctagagagagtatagaagctctgcaccctcctcctgatagcttgccctatgcatcttttccattttgctgttattctgtatcctttataataaactagtaaatgtaa

SEQ ID NO: 396571 - DNA, 706 bp, Homo sapiens
tctgagatagggtctcactctgacacccagctggggtgcagtggcaccatcatagctcactgcagctcagcctcctccggtgcttaagtgatcctccagcctcagcctctggagtagctggaaccacaggcatgtgccatctcacccggctaatttttttatttttatttttttgtagagacggggtttccctatgttgcccagactggtctcgaactcctgggctcaagtgatcctcccaccttggcctcccaaagtgctgggattacggcgtgaactaacgcatttagccaagaccatcattgctaagagcagtaatgttaacaaatataatgaagaataaaaccagaagtgttctagttgtagcttctgggtagaaacagccttaattatcatgtccctaaggattcagcataacagcaagaatttcctttcaaataaggcaccctctgccacaccccatgagcagtttatttttgctgtttgcattggttatcacaacttgactgtgttgttaatcctgaccttttatttagaatttctgatttattccttctgtttaaaaattgggactatatgctaagataattatttttttaaaaaaagaccaaattattgttttaagattttttaagctgctcccttgtaaaatagggccttagatacttcctattaaatgcccattgtttccaaaattcattcacgc

SEQ ID NO: 396572 - DNA, 395 bp, Homo sapiens
ggttctctgacaccatatgtcgacagactagtaagacgttctgaattgtttaaaggacttgcatttatctgtctgtaaaggcttgtataccaattgattgaaaatggaaaatagggccctgttcatttcttcagtattatctctaggatatgtttgaactttcagatggttcagctaatagttgtgagaattcaggattactgaattaaaaaaaaaatgactagagtgtgtagctagtaagttcctggtagtatcagtatgcattaatacacctgaagtcttccagtgatcctgtccagtaaacagtattatacctgttcaggacctcatgtctttcctcttcctgattctggtactttactttattattgctacctagctgaccctggtcaact

SEQ ID NO: 396573 - DNA, 502 bp, Homo sapiens
gggatggaatgtctctggtcagaagggaggctgtctccgggttggcatgtttctggtcagagaagggtttatcttagggttggaatgtttctggttatgctgacattagctattaggctgatattttcgggctggatttaggcggcttttaattaagggggaacttagaatggtggtgtttgttcaagatggcaatgctcctgctccgtcactggccaggtaaggcaaccctttgttatggtaacaacctgagattggcaggggctcacctccaggggcagctcatgtgcttgctggcgaggctgcaccttgtcattcaggttcacagggcacaggtcaaccaggccctggctcttcagtcttctgcctggagtgacttatgtaattctgctcagctttcatagggcacagggagtcggggctaactctgctgcctggggctggaaacagactcctcccttgaggagcagcagtccaccatagggaagtcacagtggtccag

SEQ ID NO: 396574 - DNA, 168 bp, Homo sapiens
tcatctccgacccggcattcattaaagtgtggcaggccatggcttgcaagcagagtaaaatctaagatccttcacaattcttgacatagatctttagggaaaacagaccccctcgaataactgataaaatggtatgaagatgctgtttcagtagattattggatttcc

SEQ ID NO: 396575 - DNA, 258 bp, Homo sapiens
tacaacatgatgttatagaataatgggacagatatagatagcacagtggttactatggtgaagccgatgagcatgtctgttatctcacatagtcaccgtttttagtgtgtgtgaggagcagctgaaacctgcttcacagaaatcccttatgttgtgcgtgagccctctagacttactcatcctgtatatctgctacttggtgtcctttggcctacatctccctatttccttcagctcctgcccatggtaattaccatt

SEQ ID NO: 396576 - DNA, 83 bp, Homo sapiens
tctttccaatgttgaagaaagtcataaatttacatatctaaaaagttcagtaaacttcaaggagggtaaagacaaaaagattc

SEQ ID NO: 396577 - DNA, 421 bp, Homo sapiens
atgtgtgtattcctcacagaggactggaagggtatgttttccataattcctaattgctactatgcataccttacttgctcaaaaatattaacaaaagacataaacagccctgaaactagtcttcctactccaatccaaatgacagctgctataaatacaagatatcttgacaacagactggctaattgtctgatctgacaaatgaaatagtacaattgtaggagacaagagaggattccctaaatccactcctctctgtaaaatggggagaaggacatcaatatggcaattatatatctcttaccctctcattcattcagcctacctgaggctagtaaacctctctaaaataacacaatctgtcttaacacattcctattcaaaccactttctttttttttttttttttttttgagatgga

SEQ ID NO: 396578 - DNA, 182 bp, Homo sapiens
cttagtcagacagagtataagctacttagaagaaatacaaatacatttcctcatctgaagtccctaggtgaccatgtgctataaaatttagagtttttggattttttaagcaatacatgtatacctgtaccgtataatttataacaccagagtctagttaacacccagtaatcaaccacatt

SEQ ID NO: 396579 - DNA, 582 bp, Homo sapiens
agcctcagaaccaaggtctctctctgcccctgctctgatcccttctttcctgaagcacagacaggggctttctctgaagtccctttatgccattaagggaagttcttccagaagaaatgcaattgtcttaaaactttctcctttagaattctcatcaaataatcagaaaagattaatgaccagagcaggtaaaaagactaaaagtcatcaccacacccagatagagttttcatctacttttctgagggcagctcccagagattgcctgggagacttcatctgcataataaggccacctttgttcacagtgaaattctatctctcacttcccacaaattgccaccacctcccccagagctcagaggaacttcgtcctagccaagttgtttgctctttgggcccatgcatttcccctgaaaagcatttactacccatcaggattacctacatcccccatgtttcttctccactataaagagggtatttaagtctcaaatctctggcccttctttgggtctcatatttgccgaactcctgtgtccatgtgcccgtaaataaatttgtatgtttcttatcctgata

SEQ ID NO: 396580 - DNA, 331 bp, Homo sapiens
aggggatgatgaagggcagtgttccagatagccctgttgttggactgctaatctgactctcttgttttggtttacgcattttacgaggtgcctactatgtgctaggggacgtcccagcacctcgtgggctgctgacaaccggtgtgagtcctcttaattggcttctaacataactgcactcttcctgagctgtttaatggccttgagtaacgagctctccccatctcagtatttgtttaatgccgtattcatggtcataaatagtggcaccattactttcaggagaactgtaatgatgtatgtgtttggtgaagtttccagctcctgaccc

SEQ ID NO: 396581 - DNA, 874 bp, Homo sapiens
  misc_feature (71)..(71): n is a, c, g, or t
  misc_feature (137)..(137): n is a, c, g, or t
  misc_feature (697)..(697): n is a, c, g, or t
gagccgtcaccccgggcggggacccagcgtaggcaactccgcgcggcggcccggccgagggagggagcgangcgggcgggcgggcaagccagacagctgggccggagcagccgcgggcgcccgaggggccgagcganattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaanctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagc

SEQ ID NO: 396582 - DNA, 361 bp, Homo sapiens
ttgaatattaatactaatattagtatttgaatactaatgagattgagtcttttttgttatgtggttggccaattttatttctttgttgagttgcctagttatattctttccttatttttatttgcactatctcctattgacatagaagagctcttcatatattaagggtctttttgtcaaatgttttaagttttttttttttttttacttttaaaattttataggtttttgctgacaagttttttttaacctttttattttgaaataattactgacttacaggaagttataaaaattgtacagagaggtccttttagccatcatccagctttccccgtggtaacatcttgcataagtatag

SEQ ID NO: 396583 - DNA, 632 bp, Homo sapiens
cttatatgtctggtctttacaggcagtggtttcatgtcgtaaatgaacacagtgagaaaccatgtagtttgatgatagggaaaaaataaactcatcataaatctccattatcctcttccatacgtgatatggttttgatctgtgtcaccaccaaatcttatgtcaagttgcagtccccaaagttggagatgggacctggtgggaggtggttggattatgggggtggatttctcatgatggtttaacaccatcccgtagtgctgttctcatgaaagtgagttctgccaagagctggttggttaaaagtgtgtggtacctccccctctcttcctcctgctccagccatgtgaaatgccagcttcccctttgccttccgccatcatggtaagtttcctggggcctcccagaagctgagcagatgccatcatgctgtctgtacagcctgcaaaaccgtgagccaatgaaacctcttttctctataaattacccagcctcaggtatttctttatagaaatgcaagaatggactaatataatgtgatggctccatttctcactgtggattaataaattattattcttagcctcatgtattcttagcaatgagaagtcaatatatggaggctgatgatc

SEQ ID NO: 396584 - DNA, 555 bp, Homo sapiens
agaggacctcagtctgctgctctcaatcctctatcaagcacttagcttctacagctcactaaaagagaagtttgccatttttcccacttgcaactccagagctttggcttagagattttgcctgatgtgagaagcaagctgtaaaacaggaaactcttaatcctttcacaaaggagctgacttcatctccaacagatagtggagacattcaaccttaagggtgctctcaagaacattggagattgtgacagaagtcaactgggaggacagtccaactgggatttggaatgcaggacaaactgaaggctgcctagtttccaggaaaaccatggaataaaacagcttagaggagccctctggggattagaacaaatatcaaacactaacgtcagaaactattccttcaaaagagccagaatttgattgaattacagtgtagagctatttataaaccagataactgttgaaaacaatagagcaatcagcaagaattagtgaagtttaattcctgggagtggtcaaggaagaagaggaagagaaccttaccaaaaccag

SEQ ID NO: 396585 - DNA, 331 bp, Homo sapiens
aaaaaatttggagattgtaaaaagaaaaattggtaactaaagtaaaataattaagatgtaacacaactgaatctataaataaataatgataatgtcattacaaacttcttaaatttatcattatgcaaaacaaatgaagaaatgcatgtggtctttctcagcatatgtctttccaggtttatataacatttattaaacattttgatcttttaatggcagttaatccattgggaaacagaatacttagggaatgcaaacaaccattaaattatatgccaaccaggcttgttacattggcagagtatgatgaatatgcctatgatgcctatta

SEQ ID NO: 396586 - DNA, 665 bp, Homo sapiens
atgtaaacagtcatgttatctggaaactgggacagttttctttctttctgatctgtatgtcttttatttcttttttatgccttactgcactggctagaacttggtattatattgaataaaaatggcaagagtggacattcttgtcctgttcctgatcttaggaagaaaattattcagtttttcaccattaagaataatcttagctataggatttttgtagatgctctttctcaagttttacagatacaagtttatcaagttctcccactacaatttttctgagagtttttaaaatcatgaatggatgattatgtttgataatcatcaatggattattgtgtttgatggattgttatggattattatgtttgatgtttgaacttgaccttctcaaaatttgcaaaggaaattaatgaattattgctttgaaatagttttcaagtaggttcatttttgttaagtatggaacttgtgaatacagaaaaattgctcactacatcaaatctgaattaaaacacattcctccttattatgcaacatatgccttacatcaacagcttcaagccctatttttttcaggaagcaatccaaaacattaccatttaggcaacctgtcaaacaatctcatactttttgttaaatcaattaatcaaaactaagtactc

SEQ ID NO: 396587 - DNA, 595 bp, Homo sapiens
ccctgagaagcttattccctaaatgatgatactatttcaccactccctttcagcacccctactaaggggcctttgaggaaaccaaggccccaaatctggttagttctgaggtagaagaccgagggttctttaggtctagctctaggcattactctaagcccaggagggtctgaggtttgggagccccggctgaggccctaatggtgagggctttcacacttgctctcagccctcggcagggaaccccaacctagatgtgtggaggggggctccactctcctagatccttctcaagacctgggtcctctcctttggagcaggctgtagttgccctggggagctgacaccttttggatttaattagaaaaatatcagacacacacagctctcctaaccataacttcccgcctacaccacacaccctgtgtctctatgacacattccctagggaggctgtacattggcccagagcctgctttggaaaagacagatgcccaactgtggcccccatatcagcatctccccaactctgccccatcttactcttcctttgctccagcttaggaatcctgtgagataaagtctatgaaggatg

SEQ ID NO: 396588 - DNA, 142 bp, Homo sapiens
catacatggatacatataacctataatgtgttttttaatacattttcatatgtgtgcttatttttactccctctcaggcttatagcaatagctagttgacttgcaaatgtataatggaagcattaaaagacagggaaggagg

SEQ ID NO: 396589 - DNA, 1211 bp, Homo sapiens
gctccatcaggacaccatggcagctttgcatgaccctgcctcccagggtcttcctgcgtttttccttaagtgccttattctttggttgtttccctacttgtttttgttgcgcccggcctcagagaattaaagaaaactgttcaaggaattaaaagaaaatatgatttaaatgactcgacaaatagggaatctaaatagagaaatacaaactgtaaaaagaattaaatggaaattctggagttggaaggtacaatttcgaattcactagatgggctcaatagcagattttgagatagtggaagaaccagtgaacatgaaaatagaccaatagaaatgatccaattcgaaaaacagaaagaaaaatgaagacaaatgaacagaccttcagacacacatgggatgatgctcaatgtccccacatacgtgtaatggaagccgcagaaagggagagagaaaaaaataaagaagtaatagctgaaagcttcccaggtttgatgaaaaatattgaattgcagattttttttaaaactcaaccaacactgaatttaaaaaacacaaagagaaccacacaggaaggacaaagccagaagcatcacacttcctgtgttcaaattatattataaagctatagcaatcaaaacaatatagtactggcataaaaacacacatagagcaatggaacagaattgaaagcacagaaataaacccactcatataaggttaactaatcttctacaaggtgtcaagaacaagaatgaggaaagaatagtatcttcaataaatggtgctggaaaaactggatatccacatgcaaaaaaaaataaggaaattggatctttatcttccaccatatacaaaaatcaactaaaggtggatgaaagatttaaatgtaagacctaaaatggtaaaactcctagaagaaaatatgcagggaaagatacatgacattggtgctagcgttgatttcttttttgatatgacaacaaaagcacaggcaacaaaagcaaaagtaaaggagtaggattgcatcaaagtaaaaagcttttgcatagcaaagaaaaccatgaagagagtaaagatacccatagaatgggagaaaatatttgcaaaccatatatgcaataaggagctaaatccataatatacaagaaactcttactactcaatagtaaaaaacaaataaccctattaaaaagtaggcaacaggctga

SEQ ID NO: 396590 - DNA, 1336 bp, Homo sapiens
gctccatcaggacaccatggcagctttgcatgaccctgcctcccagggtcttcctgcgtttttccttaagtgccttattctttggttgtttccctacttgtttttgttgcgcccggcctcagagaattaaagaaaactgttcaaggaattaaaagaaaatatgatttaaatgactcgacaaatagggaatctaaatagagaaatacaaactgtaaaaagaattaaatggaaattctggagttggaaggtacaatttcgaattcactagatgggctcaatagcagattttgagatagtggaagaaccagtgaacatgaaaatagaccaatagaaatgatccaattcgaaaaacagaaagaaaaatgaagacaaatgaacagaccttcagacacacatgggatgatgctcaatgtccccacatacgtgtaatggaagccgcagaaagggagagagaaaaaaataaagaagtaatagctgaaagcttcccaggtttgatgaaaaatattgaattgcagattttttttaaaactcaaccaacactgaatttaaaaaacacaaagagaaccacacaggaaggacaaagccagaagcatcacacttcctgtgttcaaattatattataaagctatagcaatcaaaacaatatagtactggcataaaaacacacatagagcaatggaacagaattgaaagcacagaaataaacccactcatataaggttaactaatcttctacaaggtgtcaagaacaagaatgaggaaagaatagtatcttcaataaatggtgctggaaaaactggatatccacatgcaaaaaaaaataaggaaattggatctttatcttccaccatatacaaaaatcaactaaaggtggatgaaagatttaaatgtaagacctaaaatggtaaaactcctagaagaaaatatgcagggaaagatacatgacattggtgctagcgttgatttcttttttgatatgacaacaaaagcacaggcaacaaaagcaaaagtaaaggagcggtggccaccgctccaccccgatttggagagaagtttgggatggagtgggcgagagattgagagagcgagcaggaaaagaggtcttggagcctgggactgatggtggataaggcctggaaagaagatgacgaggaggaggagagagggaagtggggtggatgaggagcaggctgacacctgggctgccctcaatccccaaggccagggagggcggggctggcccctgggaagaactgggtctctgggctccctaggcactgcccaaactggctgagccaggagtggggcaggaagtgagagtcaaggcccagcaaaa

SEQ ID NO: 396591 - DNA, 121 bp, Homo sapiens
agaaggaaaaaatcattagtgacaggtaagagcagaattattatggaagcatgtgtgttttccttagttgtatcatatgcctttcatattgaacaagtctgaagagatgttttatattaaa

SEQ ID NO: 396592 - DNA, 595 bp, Homo sapiens
aaccctggcttcatctctcctaaggaggcatcttttccttggctgacttctcactccatggcccactccatatggccaccacttatactggctgaggggcatggagtggataggacatggtttccttgacaaggatagctcagaggcaggcaggcccatctccacaccccactccttcattttctcttcctgctttaggaattctgtacatacaagagggttttattgtgccacagggtatttggaaaaggtgatgctgaactgctgctgatagtcttcatgatgctcaagttgaccaccaccctgtttcgggctatgacatgccagccactgttctaggcactttaccttacaatgagggcattcttctagcctccttttatacatacagactacagaggcacagaaaggctcagtcagcacccaaagcctaatagctggggaaagaagctctggattccaatacagttctcaatcctgggcctttcaccacctgtctgtactgcttccctgcaggactctctgtctttaatgctaaaatcatccagacgcttacattactcgagtcttgaaagcactgaaaatccaggggcgt

SEQ ID NO: 396593 - DNA, 496 bp, Homo sapiens
cctaccttctcactcacatatacaatctgtcctcaagttctgtacattcttccccctaaatataagatttaccactttttctccacccccattttacttgatcagctcatagtatacgctcaacaataccaactttgcctctaaaatgtattactgcaatagcttcatgactagttttcccactagccatgtggctctatccaatctgttctttttactacagtcagagtgatcttactaaaaagttaaatctgaacatgcaaatcctttacccccaattatgtaatgacttttgtttcaggatatctgatctctttaaaataacttatgaaattatctttccttgcttaactctctatccatatctttcttatgtatatgtgccaggagagttattaaccaaacaccaactttgtttttcagccatgaccatagacctcatcttcaccccattttctctccaagatcttagtttattgcggttcctctgcctgaa

SEQ ID NO: 396594 - DNA, 406 bp, Homo sapiens
cctgctgtcgctagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacatggtgaaaccccatctctgtgttgtctgctgataatacagagttggcactggcaactctgcactaaaaatacacaaattagctgggtgtggtggtacaggcctataacccccacttctcaagaggctgaggtaggaggatcacccgagcccagggaggtcaaggctgcaatgagctgtgattgaaccacagcacttcagcttgggcgtcagagtgagaccctctctcaaaaaaatgtagtgagcag

SEQ ID NO: 396595 - DNA, 685 bp, Homo sapiens
tttgagacagagtttcattttgttgcccaggctggagtgcaatgatgcaatcttggctcactgcaacctccacctcctgggttcaagccattctcctgcctcagccgcctgattagctgggattacaggcatgtgccaccatgcctggctaacttttgtatttttagtagagatggggttttgccatgttggccaggctggtcttgaactcctgacctgaggtgatccacccgcctcagcctcccaaactgctaggattccaagcatgaaccaccactcccggcctataattcttgggtgtctaaactattaccaatgaatacaactttaggtttcttctccctttagttatctcgtctcttctctctagatttaaacttaagcaagcagaagcctctgggattctgtactgactagaataattcactgcttccttcttattgcgagtccccgtccatcataatcctccctggatcatgctgaataaacagctggtgacttgagatggggagaaattctacagagtttccttgcctgagcctttcaagggctaagactcaaaatgttcaactgcctaaagcaataaacaccaaaagaggttaaatttcgaatttgcttttcgcttatctagcagtggacaactaatgaacccaacaatcaggcaaaatctgagttagaaacattt

SEQ ID NO: 396596 - DNA, 467 bp, Homo sapiens
ctaccagataagcagaatgttcacaaagaatcagttatccttgtttcccaaatggcttaagtcaactgtacttgttattgtaatagtgcaatgtaattagatgctgcttaaatttgtgagatctgagtgaaaaaagtatgtcattttcaaagaaactaagtcaaatgctttgaaaaactcaatgaggacaaaatagatcattaaagaatagacagcaattagattaggtgtaggtgaaacactacaagggtttgagggattataaagatctaggtagattgctcattcagattgattgtcctaatgactttaagttcctgttctgcttaaaacaaacagttagaaatcctagctagttcatctggatgtttaaatgagagaacatagaactcgatcagcagaaatatcctcaaagaaatgactgtcaaaaggtgaatgaatattttaaaataaaatttgtgaagtat

SEQ ID NO: 396597 - DNA, 274 bp, Homo sapiens
ctgagttgatcagtgtcctgcattttaggggtcaggaaagtatttatgataagttggaaatggacagggcaggaaattctgggcctggaaggatggcttcctcaccagggaccgcaccaccatattttctaatttgtgtcttgagggaaagtttatattttttgctgaaaatattatctccttgtgacaaaaccacaagtctgggaagagaacacaaaaggaataaagaacaaatgagatctgtgatgcctcctggataaaactttaaaaaccc

SEQ ID NO: 396598 - DNA, 332 bp, Homo sapiens
ggcaagtcagcgccttcatgatcttattgcctgagaaatccactgtcaagtccatctctctccagccctccctgtgctctctcacctctaggtccaggatttccctccccactcatccacccttctggatctgagttcaaggatcacagcctctgtgaagcctgcttggactttctcaagaagcttcacataatgtttctttacattctcactgaattgtttttgcataatcgctgcagcatttaccccaaatgctggtttccaggtccgtcttcccaacagactggatgcatctgcaggcaagaactagctttttccttcctctgtcttta

SEQ ID NO: 396599 - DNA, 656 bp, Homo sapiens
acctgtgttagatacattagtacaaatctgtggaatctgatttttactcctctggagctaatgcttgatctaacagttgctattaagtactggtgaaaaaatgcttcaaaaagtacataaaatactctaggatacagagtagatctcggccacagggctctttcctggttttcatctttctgagtcttctttaacacgcctcgtgtgtgttcctagaacagtcctatcctggctatcgtgccctctaggatgtgttcttggtcatcttatccacattctacagataagggaggaaatcctgaggatgctggagtcagataaaggccattgtcccagctctacctctctacagcctgggtgaccttagccaggttagtgttgggtatcagtggctcatgtctgtaatcccagcacttttgggaggccgaggtgggaagactacttgagcccaggagtttgagaccagcctgagcaacatagggagaccaggtctgtacaaaaaatacaaaaaatattaggcatggtggcacatgcctttagttccagctacctgggaggctgaggcgagaggatcacttgagcctgggagttcaaactcacagctatgattgtaccactgcaatccagccggagcaacagagcaagaccctgtctca

SEQ ID NO: 396600 - DNA, 173 bp, Homo sapiens
caagttgccatcttcaatacatggccttcagaggtgcccaggaaaggggcaacagagagtgaaggaccatgcagggaattttatggtcaggttgagaagtggtaaaggctgggaaatgcagtctttctgagtgctcaggatgagaaataggacggcagtagttttcagtgtgt

SEQ ID NO: 396601 - DNA, 249 bp, Homo sapiens
ttctctaagcctcattttgctcatgcgggaaatggggatgatcacagatgccattcagagagctgcggagaggtgcagggacgcataaccacttgaagtggtgctggctctggcgcaggctgtttcactgcccagtggaggcaggctgggtggaagagcagtgagctgactgagactgtgctgtggctggggcctgaggaccagtgggttttgagaggggagcctggtgcatgtgtccgaggaactgaa

SEQ ID NO: 396602 - DNA, 171 bp, Homo sapiens
gactctatgatggatcaccagcaacattggactcgaggcaggtctggaactttcaaccccagcaggatgagggggaatgggggtggatgtcaggtaagtaatttctggtcccactacaaaactttatttttgattagagtaccattctcaatctcttctacaaaaagcaaa

SEQ ID NO: 396603 - DNA, 323 bp, Homo sapiens
ctgtgaggccccttgttaaaaaattattaggaatcaagacaatgaaggcacagcattaaaccaagtgtgaagccttgctaagcacaggccctgggaagctgcatgggttgcacatttatgaagctattgctgcctgtaattcctgaaacaatcccccaaattgatttcccaaagcacagctttttaaaaatgatgtttcagtatctaagaatcttatcaaaagaaacatttctggaatgaggttccagctaggtggagtctttgttactggtcagtaaattacatcctgcaagtcaaagcttaaccccaaagtactatagatt

SEQ ID NO: 396604 - DNA, 377 bp, Homo sapiens
cacaccacctgagtcccataccctgcacggactgcccagataagctgcagtgaccatctctcagtcacagcgtgaccaaggaaatgaagtctgtttgctgtaaacccactgtattagtccgttctcacattgctttaaagaaatacctgagcctgagtaatttataaagaaatggggtttaattggcccacggttctgcaggttgtacaggattgtacaggaaacaatgttggcatctgcttgccttctggggaagcctcaggaaactttcaatcatgacagaaggcagaggggaggcagacacctcttacatgtcagaagtaggagcaagaggggggcaggcgctacacacttttaaaccagatctcaggataact

SEQ ID NO: 396605 - DNA, 147 bp, Homo sapiens
agttttattagtaataaagccaatgttctgatctacatttatctatcacctatcctttttttttctttcccctccctgagacagggtctcgtccattgcccagtgaagtggcgccatcagggttcactgcaccatcaacctcctggt

SEQ ID NO: 396606 - DNA, 349 bp, Homo sapiens
cttcaacggaatcccattgcctattaaagtccaaactccttcatctgacattcaaaaaaacatgacatagctccatctcccatcacacccctccctatccaactattctctatgcacactggactgctcgcaatttctataatatattaaatactttcatctccataacttagaaatactcttgctgctttctctaaagaattctatttatccttcatggttcagcagaaacattaccttctccacaaagctgattctctccagtactcttaagtatgttgtatgcatctctattacgatactttcatattacttgtctgtaagctcactaaaacaaggtttattgatt

SEQ ID NO: 396607 - DNA, 230 bp, Homo sapiens
gaatctaaatcagttattaagtggatgaagtaatctaagaagtaacaaattacaacagtgtttactcttgcttgaaaaggaatcagctaggattgagtaaaactcaattccaaggctccaaagacctgctgaagtagattttctaaggaaaagcccagaaatgggtatttttcctaagaccccgaatgattgcttttaaaatcatccagtattaagtgaaagctgataga

SEQ ID NO: 396608 - DNA, 342 bp, Homo sapiens
tagatgatatactttcagaatatgtatttagcagtttatgctaatcttttacaagacatcatgtaaacaaaaaaattgttatacaggcatacctcagagatattacaggtttagttccaaaccactgcaataaagtgaatattggaataaagcaagtcatacaaatttttagtttcccagttcatataaaagttatgtttccactatgtggtagtctattaaatgcacaatggtattatgtttaaaaaagtacataccttaatttaaaaatatcttattgctaaaaagtacagccatctgagctttcagcaggtatttatcattctgctggtggaaaatctt

SEQ ID NO: 396609 - DNA, 197 bp, Homo sapiens
tgctgggattacaggcatgagccactgcccctggccagtgtcagatgtttagtttgtcattaaaatggagcaagaatacataactcgtgaggttgtaagattatagatatgtttactaatgactgactcatagatatccagctgttaaaactcttcaagaagtaatcagggcaggcggaaatggatgtaattaacca

SEQ ID NO: 396610 - DNA, 328 bp, Homo sapiens
aataataataataataataaagttgttgtacaatcaaacattctggaacctgagcagatgcatggaaagcaactgcctggatctaggcaatggacttgtactctgagtgatatttgggggttgttactgcagcacccatccttcctggatacatttgaatattaacatgtttgccctctatttacttaagagtctgtaggcaatctcagactacctggctgaaacacctttgagccacagagagggacttagcagcaccctgcctgagcagaatggtccttatgtaagtcctgtttgtagggttgaataaagtgtttttaagatgtct

SEQ ID NO: 396611 - DNA, 212 bp, Homo sapiens
tcaaaaaatgcttggcagcagagaatactcaaatgcatgtatattccttggtgaggggtcaggtctcaatgtacccaagatgatctctatccactgggaccatttgtgctaccctgcaaggacaggcttgttttcaagtattaagtacctaccacacatcaggcactgtgctaagcagtctcccttaaatatcacagtaactgatccatgag

SEQ ID NO: 396612 - DNA, 362 bp, Homo sapiens
gcttctatgttgtaccagaactgaatagttcaaattactgttgcgttttgataaacaccgccctgccccgccgccacacacacacatgcacacacacacagttttcttctcctacttctctctcgcttggttgaattaccccactgacagagagaaaaacaacattcactggcctccagggaaagtggtgtcgctgcgaatgaagggtggatagaggtggtgaaccagaagacatgctctgtgttggctgcaaaggctctggctctgtcatttccccagaatgtcccctgcagatgcctggcagtggaagatcagcagtgaagggcaggagagaggcagctatgcaccagctcttctttgga

SEQ ID NO: 396613 - DNA, 260 bp, Homo sapiens
cagaatattccacagactcaatgtataactatttactacttccctgccgatggatatttaacctgtctgtagttacccgttatcaccaagcttcaaggaatagccccataaatgcatctttggacacgggagcataatatgtgactacttttctaggttactgtaaaagtagaattgctgggatttcaggcatgagccactgcgcctggcctggttctgtattcttatccactgatctgtgagtctgtattaactgcttg

SEQ ID NO: 396614 - DNA, 425 bp, Homo sapiens
ccaataatatgtggcccaagaaacactgcaaattggggtacccagggttaggttgcactagtagaccccccaaatgaatgaagtttctcaggtgagcctggatgagcctgcagatgggccactcagccaaaccacagaatcctgtgaaagagtgcatagctttagttttaacccactgtattttggtgtagcttgctaggcagcaatagatatctgatataattctgattagaatgagtatttttgagctcctttgaaatgatgaagttattataatgtttattataatacttaggacggtgacctactgtttctggcgtgatggctggatactgaatgactcttccaatgcataatgtataaataagcctagataaaatattttaaaataccattttataaaagaaacatgtctgtattggcac

SEQ ID NO: 396615 - DNA, 211 bp, Homo sapiens
ccaccccacaatagccctgtctcctttttctttgtttcaaattactgaggactttatttctccatgtgaatggtttaaacagtccactcacttgccctgcaggcccagaccaaaatcacagctgacaccatttccaacaccggctagtgcttccaggctgcggcactcccactttcagggaaggaggctttgccatcttcagggaaggagg

SEQ ID NO: 396616 - DNA, 311 bp, Homo sapiens
atacatgaacttagttttctaaatgaaacttgaatatatgaagtttgaacaatgtaaaagaaatgtttataatatttgagtttatcaatttaatgataaatttatgtttaagattttatgtagacatatatcatgtactaacttagtttttcccttttcacattttattaaccaaattttatttaaactcttcacatgtatatttaacatttgtatacatatgtaactaacctgcacattgtgcacatgtaccctaaaacttaaagtataataataataaataaataaataaataaaaagaaaaaaaaaac

SEQ ID NO: 396617 - DNA, 347 bp, Homo sapiens
ggtttcagttctccttcctcctcctttccttggtgacatttggttaccacataaccaccccccatatccccactaaaatggaagctggacaaacatggctgtctgttcacaaagtgctttcttggcccttgtgtcctcaactgctcatagagatgctgacatggacaaggtagtgattgtcattatccctactccacctcctgggttcaagcgattcttctgcctcagcctcccaagtagctgggattacaggcatgcgccatcacgcccagctaattttgcatttttagtagagttggggtttctccatgttggtcaggctggcctcaaactcccgacctcaggtg

SEQ ID NO: 396618 - DNA, 148 bp, Homo sapiens
aataggtcctactgaggcctcgggaaaaatgcaagactgcatggagtttaaaaggtcagcgtgaataacaaaaacagactttctggggagtcagaatggatttaaaatacactcagaggagcctggggctcctttgctgctgcgggcg

SEQ ID NO: 396619 - DNA, 166 bp, Homo sapiens
gaacaggtaggcaagttatttcacagcttataccttcatatgacagccaggaatactttagctactttaaatttaaagagaatgcaaagttgtaacaagtagataataatcaactcctcagctttggacagtaaaaaaatttcctccacaatcttactcattccag

SEQ ID NO: 396620 - DNA, 548 bp, Homo sapiens
tcatttttgctgaagaactgctcacttaatatcctgggagtgatcttgttgaaatttgccaccatcatgttgaagcaatgaaccttcacccgtagtataatgaatgtgacactgcttatatctatcctgtaggacagctaaaaggacaagacctcagcatcacatgccaaccagtctgttagagcaatcacacacataactacttttgccaaaatcctccaacttaatttttaaatagctgaaatatagtcaaggccatatgggtactgtacctggaactagaaacatacccttttcacacacattcagtgttacagcaacagcatcctgggacaggttaggacacaatcacattttttaaaatcaagagtaagaagtaaacataaaagaatatttgcacaaggcacagaatcctgtttcttggcaatagacagaaaacaactggctaaagaaataggtttacagatagatacaatctagaatttgattctttgagtattaaacttggagacatagctatatacattccaacatacaatctaatattt

SEQ ID NO: 396621 - DNA, 351 bp, Homo sapiens
tttctttgatatgcagtgcctgtacttcaacagctcctagcacattgttggcactaaataatcaatgactgttagtgatcatgtcacaaaacactagagaacattgaccatgagactgagttaaagttcttagccaattcaatatctgtttcaaagcatccttgacatttcaaatcccctgaatttttcatttactcagtaattgaaaacctaaatctagaactgtggtattatcacaagtgcccactgcaccctctggattcaaaaggttaattttaatgaacttttaaacacttgcattaggcaatttcatttaaatataattgaaatgtgaagctgggtagttgtagt

SEQ ID NO: 396622 - DNA, 152 bp, Homo sapiens
atttcagcagaatcaagtcccatgtaaaatgtaatctggacatgaagggtaatgtcccctaagactaccttagaagtcttcactctggagaatgaagattctcaagggatacctggccctttggtaaaacgcagcattgatgtctttagctt

SEQ ID NO: 396623 - DNA, 481 bp, Homo sapiens
atgagaaaggaaaagagatacataacagaaattgggctggaaaaataccagcatatgtatgctgttagaaaatagataattcatacaggatgcaatattgaaagtattctgttaaaacaacaatgaggtcactttccccttctcagattggcagatgttaaatcaagtaattgggaaaataggaactctagcattgctagtagaagtataaattattagttcagttactttaggcagtttggtagtttctgttaaaaactgcatagctgtgatgtggtagttggatgtttgcatatctacatgaagtcgtggcattcagaaatatttgtaattacacaaataagcatgctttaaaatatatttatatttaaaagtaaaaatgcaagcaaaaatgatttcagctagctttagttagtatggatttatgttttgatagttcagctttatgttttgatagttatggacaatgaagggcaaagaa

SEQ ID NO: 396624 - DNA, 91 bp, Homo sapiens
ccaagatcaagttcccgctgccccaccgggtcctgcgccgtcagcacaagccacgcttcaccaccaagaggcccaacaccttcttctaggt

SEQ ID NO: 396625 - DNA, 519 bp, Homo sapiens
acaatgccactgcatgaacatgtacataactgtactattctttttttaaattctcagcctggaaattacatttcaagtactagaatattcaacaaatcctaagacttttatgaagaccatgagaagaaaataaggtactagaacaaaagtgatgcagccagccaattctcgtttcatgtctcaagacccagttcttattattatagatccctttgtggggttagcttggattttactgcgggatccatcaccaaaggttattaactattccttaacacctggtacacaaacccctctttctgagactgctttgacaaaaataaacaaaaaagtgtgaaataaatcaagatttgactgaccatcctaggtctacccaactgctagctgaatgactttcaaaacgtctttaaattcttaaggactcaatttcttcctccgtaaaatgcagatagtaactgttttgggcattttaacttaacagcaataacaaaaactacaggaaggtaagtaattattgac

SEQ ID NO: 396626 - DNA, 700 bp, Homo sapiens
ggggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaattccatttataataacatcaggaagaaattacttatgaat

SEQ ID NO: 396627 - DNA, 625 bp, Homo sapiens
cagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacggcctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcggttacaacttgtctgtggaatccgtaattgcatctgtgtgccgcctccgaacacagaacattgtttggacggcagccccactgcacataacagaccc

SEQ ID NO: 396628 - DNA, 151 bp, Homo sapiens
caaaactgtgaatgagggtggactaccgtatctgacagggtgggaggatgaaagacatgactgggacacctggaagtgtttgcttaattacaggcactaagaaaaactgagtgaggggagaaaaggaaatttcacaactgcaacaaccaag

SEQ ID NO: 396629 - DNA, 595 bp, Homo sapiens
caacgatggtctcagctgggcatttctttaccaccttccacagcaccaggtattcctgggtctataggcagtctggctttctccacaagataaatctttgacttttttgtgaggttgggtaagaacactcatctgcttgcctaggatgaggcatgtatagaactttccactgactttaaaccatttcctgctttcagcttcacatcttgcttgcaccctcagagatacctggcaccttcaattcctgagtcttcctagagataggtgatatgaactggctagaatcatgcaaggaattggtatccgcctctgtagatattttatattccactttctcagctaattaatctactccaaccaccttccatttccctgaagtttttttataccacttatttactgtctcctgttctttctgctcttgcagatttatgctgttttcattctcttactcactgtgaatggggcttggggacagagcagaaataaacatatttgttcaattcaagcttaaaaagaagacacagtccttgaatgatttttatctgatgctaatacatatcctgggtgcattcagatttcatgaagcctggag

SEQ ID NO: 396630 - DNA, 243 bp, Homo sapiens
ctcccaacaagttttggaaagcaaggctgcagaaagacacgggattctagaggcctgcccaggcactgtcagcggcccaggggcaagactgtctgagctccaggccctctgagcctcagtttccctactgagggaggcgaggcgcggaggccccgcccagcgtgggctgcccgcctgtgactgacggcgcttgcctccaatcagggcctgcgcagctcgggccgcccggccaggagccccgag

SEQ ID NO: 396631 - DNA, 556 bp, Homo sapiens
tttttttaaattgtggtaaaatacatatgaaatttgccatcctaaccgtttttaagtggatagttcagtgacattaagtacattctgattgttgtacaatcattactactgtctatctgcaggatgtttttcttcttgcgaaacagaaactctgtactcattaaacagtaactcctcatttcccctcccctcagtccctgacaaccatgattctactttatttttataaatttgcctactttaggtacctcatataagtggaatcatgcagtatttgtccttttatcactggcttattccacttggtatatcctcaagattcttctattttgtagcgtgtgtcagaatttccttcctttttaaggctgaatagtgttccattgtatttatataccacattgcttatccttgcatccatggaaggacacttgggttgcttctgtttacagacttttaaaaatgggatcaaatgtcattacactttaaaaaattaagagtaattccttaaattcatcaaatatctagttagtcctcaaatttctagttgtctcatgaa

SEQ ID NO: 396632 - DNA, 505 bp, Homo sapiens
acaaaagtgcattatttgtctaaacactttgtaatagagtggtttcctttcaaataactataaattacatcattcgtaatggctagatatggatgtaccctaattaagtatagctttgtaatttacaccactctttccttgttaagtcactggttatattctttttagatattgacatatattttgaaactgcacttagaaatacatgaattcccaccagctgtgtaaaagtgccaacatgttcaaatccttattaaataataactgttttcttgcaactttaattaccatactgttttatttaactattccctgttattgggcatctagctcctttctagtttctcctcattataaatactgcttagatgaatacctttggacatttccaatatttgtaattcatattgacaaatcagtgcatgaaatgctgtgcattgactaggaaataaaaatttgctttaaaaattgcatttgggatttagctcattatctgcaaaatctg

SEQ ID NO: 396633 - DNA, 677 bp, Homo sapiens
aacacttccctcaaatataaagaaacaggctcagtgcctgttacacaataggtgtcaacaaatactgattcccttcctgtacatattacttcctcgtgactgtttacaatagagtatttacatgttcacacatactacttgcatgtatataaaacatctctggaagaatatacaaggaaatattaagtttttatcccttcaaagagatctcagctgagaaaagggtaaagggggaaagacaatttaacctttatgtgccatgggtattatctttttcaaaataaactaaattttacatgtttttaactaaaaagacaatcatattatttatatctcatccagccgcctatccatctgtaaagaaactaggaaatatagcgatggagtcaaaacgtccaatttcatcaaaaacttacacatatgcaaagaaacaagaaggaatgatccattaaaaaaaaaaaaagcaatcacagaaactgttccaggccaggcacggtggctcacgcctgtaatcccagtactttggaaggccaagatgggaaagaaaattgcttgaacccgggaggcggaggttgcagtgagccaagattgcgccactggattccagcctgggctacagagtgagactctgcctcacaaaaatagaaaaaagaaactgtccctaaggatgcccagac

SEQ ID NO: 396634 - DNA, 292 bp, Homo sapiens
tgagggaaaaaaaaagagtaaaaatactaatccgatctcttgatgaatatcaataaacaaaagtttagatgaattcttggtaatatcccgagaatgttaaaaatttcacttgacactcatgttagacacatggaatcatttgacattaaaattttacttcattccactttggaagaaccttttcacaggctatttcttctaatctcccaaccaaaataagaaatttaaaatcctaattaacaaaaataatcttattgctgtcaatcattcttagagtattcttgtaaacgat

SEQ ID NO: 396635 - DNA, 181 bp, Homo sapiens
caagatcccaccattgcactccagtctggatgataagagcaaaactccgtctcaaaaaaaaagagtaatttctgtcctcaatccgtttacaactttttcccagtgataagataaacatgaccaatgtttaaccattttatgtttcaaggccataaagagctgtcctggtgaatacattctt

SEQ ID NO: 396636 - DNA, 639 bp, Homo sapiens
aatacttaactgctaaggccccatctactgatctctccactttaagcaaaattatcagaaccctgctctcggatatcacagaatcttgcttttctctctataaacacagcccatttatgaggtctgctctatgttctagacacgtgggtacacgactgtcctttcctaacaccactcaaaggtaaggttctagagcactactacctaatagatagacctttcttcaatggggccaatgttatataaatatgtgcagcctgttacgaccgcaaccacacgttactactgagcacctgaaatatggttgtgtgaccaaagaactgaatgttaaattgtatttaactaaaatagtcacgtgcagctagtggctactgtgttggacagcacacttctagaaacagtgtggcatgagagaaaagtctctggagtctgacagacctgtgtcagaacctagctctggtcatttaccagctatgcaacctactagctatgttacttaacttctctatgtctcactttataacatctacaaaatgagatgacaccatttaccttacagtatttcaggtctgagtgtttatatccatatatgtatacaggtatgtctacatggagactggtactcaaacttgcgaaagg

SEQ ID NO: 396637 - DNA, 617 bp, Homo sapiens
ccccacccctagtgctcagtaagggtttgtagacacctggctgacttcctggcagtcccttgggctccgctgaggacttcagccacgtagattccggtcgaggccccacatgtcacccgacatttgcaggcacgtcatgcttcacagagctcttctcacacagcagacctgtgaggtagatgatgtttccccaattcacagttcatgaaacagaccgttgtcatgggaggtgtgtcacagtcacacagctaactggcagcagagccagccccactctgcttctctccagtttttctgtgtgcctgcctaatccttgaagaaaggtttggaggccaggcgcagtggctcacgcctgtagtcccaacactttgggaggccacggtgggcagatcacttgaggtcaggagttcgagaccagcctgagtaacacggtgaaaccccgcctttactaaaaatacaaaattagccgagcatggtgccatgcgcctgtaatcccagctgcttgggaggctgaggcaggagaatcacttgaaaccaggaggcagaggttgcagtgagctgagattgcaccactgcactccagcctgggtgacagagagactccatctcaaaaaaaa

SEQ ID NO: 396638 - DNA, 343 bp, Homo sapiens
ttaaaaaaatgcagaggacccactatgtattatatagatgcacatgcagtactcacacatatatacacacacagaatatatatgcatacacaggcaagtgtgtgtattcacatacacacccctacatattctcaagaaggaaatacactaaatgctaaagaaattacctacgggcagtaaaattgtgggtaattgtttctctgcttctttgtatttttaaatgtttcaacagtaaacatctattactttgacaatataaatagtatttaagtaatatttttaaatcccagaactatcaaaacatatttgagtagaaagcacttgggtactacgctttggctaa

SEQ ID NO: 396639 - DNA, 265 bp, Homo sapiens
ccaggctgagcgcattgtgctgcctgggagtctgtgtgccggctacccccagggccacaaggacgcctgccaggtgtgcacccagcctccccagcctccggagtcccctccctgtgcccagcaccctccctccctgaactccaggacccaggacatcccaactcaggctcaggatcctggcctccaacctagaggcaccacgccaggggtctggaaccctgagaactgaagtcctgggagggctgggacttaggctcctctttct

SEQ ID NO: 396640 - DNA, 1627 bp, Homo sapiens
ccaggacttccgtctgagatgggatttctggacagaacaatggagcgcagaagctccagcaacgtgtgctctgcagggagcccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtcctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagcca

SEQ ID NO: 396641 - DNA, 224 bp, Homo sapiens
tgaccattcattgcggtgagcatcacactaggccaaaactatatacttagcacttacttcatgattctcatttctcagcactccttaaactttgaaaaattgtttctatctgcatatcatatggattgcattaaatctattctgctgcatagatcctatttgtgttacttacaaaggactgtattatgtttgatggctcaccctctgcctccctaccacctaca

SEQ ID NO: 396642 - DNA, 260 bp, Homo sapiens
cattccacgagtcagagccggcatatggcatacagattcataaagtgggtggacatttccattatgtcacacacaagaagttggcatttaggggatttgggtgaagggtatgtggaattatttttgctactatttttgcaacttttttgtaaatctgaaattatttcagaattaaaagttttaaaacaaacggaaatataaataatagagttgctgctccgctgtttaccactgtatccttgggcgagtcacttcatctc

SEQ ID NO: 396643 - DNA, 461 bp, Homo sapiens
caaatactgaaaaaaaacatatttgttactgaggctgaaagccagggaatcatgaaatggtaaaatataaacgtgaaacccttaatccatgtgcatatcaacctattgtacaaaataagaagttcaacacagtttataagtatgaaaaatcacaaacacttacttttcttaaagattaaaatttaaacctgcctaaattctctcctacatcatatgttcaacattttgaattttataacttatcttgtgttttatgcttttcataaaacaacagtatttggctgaaaattgtaccctattttattacaataatatagatttaaccaaaacaaaacaaaacaaaaaaacatgcccctcaacagatagatagcagccaattaccttaaatatttagggtcaaaaacgataagaaaaacactgagattttttcaagctcattaaatacgtaatatgggatgcag

SEQ ID NO: 396644 - DNA, 450 bp, Homo sapiens
cagaatctgacactattttctctctcttcgttccacttcttcaggcttatcataatcaccatgttattgaacaactatgattaggacattagacactcgtgttttatatacaacaaatatttaccaagtgtagattgaaatctagggtaggtgtcagagactgatgggtgaaaagcctaaaagatagatgcaggcaggcaggatcaggaagcctcaaatgcaacagtaagcagctggaaatacacacacacacacacacacacacacacacacacacacacacacacgtatagtcatgaacaaggcaagaccatagtgctcaaagaaattataacctagttgggaaaatgatgcattcatgttcagaaaaacagtaaaaggcagcctcccccacataccaaatgaatggcagagacagtaaaaaacaagatgagaaagaccgcactggac

SEQ ID NO: 396645 - DNA, 106 bp, Homo sapiens
tgtgtgggtatctttctctatgtcttctgagctttgaaggttttgtgctgtggttcactagactcacagaattagtcctggatttcatcagaattcaaagcctgag

SEQ ID NO: 396646 - DNA, 356 bp, Homo sapiens
ggactttgcaaagagaggcccctgggtggcctgatggggctgggttggactgtgttgaaggggcttacctgcccgggctgtgctgtgctgtgctgtgttggcccgactgtattggttatgggaggctgtgctgggcagttgggctgggttggctgcactggctcaggcctggcagtcttgtccctggtgtgatcctgggctcagcctggtgtgatcagcgtagtcaccaatccaagacattcattctagaagctggcatggcctccgtggccatgctgacagacttgtccattcacgtagtggagagtgattcatcagagctggtggtggcagcagtaactctgacagagtggaac

SEQ ID NO: 396647 - DNA, 468 bp, Homo sapiens
cttctgggttcccttccaccatatggaagctttactttcgctttcactttactttcacttttgctttaataaatcttgccaccgcacactctttgggtctgcatgtttctctaatggagctgtaacactcaccactgaggtccatggcttctttccttgaagcctgtgaaaccacgaacccttcaatcaagaaaagacctttgatcaggagaagacttctcgtctcatttctggggacacattcaggatttctccaaagcaggtgaaggtacgctcgagcgtggtcattgaggacaagtcgacgagagatcccgagtacatctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctac

SEQ ID NO: 396648 - DNA, 1307 bp, Homo sapiens
  misc_feature (1296)..(1296): n is a, c, g, or t
  misc_feature (1300)..(1300): n is a, c, g, or t
  misc_feature (1304)..(1304): n is a, c, g, or t
  misc_feature (1306)..(1306): n is a, c, g, or t
cttctgggttcccttccaccatatggaagctttactttcgctttcactttactttcacttttgctttaataaatcttgccaccgcacactctttgggtctgcatgtttctctaatggagctgtaacactcaccactgaggtccatggcttctttccttgaagcctgtgaaaccacgaacccttcaatcaagaaaagacctttgatcaggagaagacttctcgtctcatttctggggacacattcaggatttctccaaagcaggtgaaggtacgctcgagcgtggtcattgaggacaagtcgacgagagatcccgagtacatctacagtcagccttacgtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacatgggagactccattttgttatgtgttaagaaaaattcttctgccttgagattctgttaatctatgaccttacccccaaccccgtgctctctgaaacgtgtgctgtgtcaactcagggttgaatggattaagggcggtgcaggatgtgctttgttaaacagatgcttgaaggcagcatgctccttaagagtcatcaccactccctaatctcaagtacccaggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatccaaaagcacagcacttaatcctttacattgtctatgatgccaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccgggtccccttntttntttntnt

SEQ ID NO: 396649 - DNA, 282 bp, Homo sapiens
caggaagcccctgtcctgtcctattagtaatctcttttcttctccccaccccagaaaggtgggcacacccaaaggacaatcgttaaccttctactgcatattttctctcatatggtgacttcattcattttctaatatgtgaatttttcccaaatggataaccccagctataatctcattttagaattttggctctacgattagatgatttttaagatgccttccagctctataaatctatgatcctattatgtctgactgctcactagatatttcttcttg

SEQ ID NO: 396650 - DNA, 555 bp, Homo sapiens
agtttaaataaatacaaatagatttcaggttctagcttgggctagagggatatggaagaccctctccaggcatggtgggtggtcagcaggagttcagggagggtgactggaggcagaaaaagtacagacactcattctcccactaggctgccaggtctgtgggttagaactggatgctctggtattcaagttttctgccaggagaaaaatgagataagttattaccatcacgttttgttatcgcaacttttcccctcactctcagaaaggagctgggagctcctctgcagtctcacatcagatagtaagtgtgagcccagatcagcccaggctgtcctcggctgagctggtgaatctgcgttcaaatgaacaacagcagctggcctgctaggcccggcatctcagtggggctggctgttttcttctcatcaatatttgattcttgtggaataacagatgatgtttatttcattctttgtgcctctgcttagttttcacattgtctaaagggacgaggtatctaattaaagtgctgttaggaaaaccgtaataagc

SEQ ID NO: 396651 - DNA, 840 bp, Homo sapiens
ctggtgagagaattaggaagtgttaggcatgtatttttgttacaataatgggagcacctctagcattttgaggggcagggatgctaaaggccatatgatgtttggaattctcctacacagagaatcatgtcccttgcagaatgccagtggtgtcccattgagaaatatggatagagcaagctctcattttataatcgacaaggcagttctaagaagtaaagaataatagtcctgattgctgagcagtcagatccagattgccctgattactaggccattcaactccatttctttgtttccctaatgcctcagttgtcagtgtagatttgctttcacctacttgggaaaactctaccaccaaactgtttgcaaggttacacaaaagttacccaaaatgtaaagtcatttgtcagttttttgttctagttacattattttccaaagcataaattttcctatagtcatggactagctaaatatgatattcttaaaaaacaagatatgattttgcgtgggactttgcttgtttatttatctgaaggtactttcagactatgctggaaacataatcacagattatttcctatgtaaggcatcacttctactgcagaccgttctctaacttgtccaagtctacatataaactttacccatattttactaggttgtctctgtcatagtacttacagcttcattttgattacccagttaatgatcattctctcccattaaactatgaactccctgtgattaaggactgtgtttttttcaccactgaattctcagtgcttcatgcagcttttagctttcatagtatattgaatgcttgagacacttaaa

SEQ ID NO: 396652 - DNA, 365 bp, Homo sapiens
tggggatgtataaaaaagataaattgggagggagtgtttgatgtgctgaccacgtcctgtcacagagaggcttctagggccccagccctgggtcctctgctgatgtccagcccacgaaggtgcctcccagggtaccttgggaagcctatgagatgctgcgtggggcactggcctctgctctaggggctcacggagccttcactttgcaaacgtgcggaactgccacacacctagcacacctgcctcacagcagcacatgctccagggcctctgggacccacaggatcaggccatgaggcggagaggcttgcagccaaacattgccccttccaacatccctcaaggagcccatcccgcctgcacgc

SEQ ID NO: 396653 - DNA, 270 bp, Homo sapiens
ttcttctaatggttataggaagctatgattaatgccccaaaggtattaacactacacttgttcctttctgcaaaccagtccaatccagatatgtgagacagaagaggactgcctggacaggttaatcaccaaaaagattaccttcacctacataagtcatagagcaaagtgtaatactggcttcatctctcaggcatggccatgttccaataccttactcttggaaatctggcctcaccatttgatatcaaacttggtgtacaggtggtg

SEQ ID NO: 396654 - DNA, 401 bp, Homo sapiens
ctcaggaataggcaccttgctttattatatagccactgcacttgagcttatagtgtctgaaataacacattctatcttttgttaaagttttctaataatttttcctccaaaaacagtagttttatgtgtttcccccatattcaatgcatgagaagctagttatccttgttacaaatctttctatcctcacgttgaaaagaatgtctttctgaaaaatttcccattagttccccaagttttaaaaaagtttgttagaaatccgcttgttctagctctcattggtataagggtctgtaacttattacatatttggtaaatctgctttccccattcttattgcatctggtactgtgtactataatacaaaggcagtcttgagatttcatagtggaagaaagatg

SEQ ID NO: 396655 - DNA, 377 bp, Homo sapiens
gaagtatcttacacccaccgacaaaagcctctggtcatcaggagaaagattaactctcttccgcctctcctgggctctggggccggccccctgtctgagaatcactgggcagaagtgcgtggaaggtgggtagaattggattctatttcaggagcgatccacgcgaaccacagggtgaggcactcccgccaggttagcagctcccacaaatgggagttctaactccagccctgcccctcactagctgtgccacctacagtaattcacctcatctcatctctctcctggcccatttcctcctttgtaaatcgggaatcccagtatctcccccaacctcaggaagcgttaaggattttcaattaagatgtctttaaaat

SEQ ID NO: 396656 - DNA, 142 bp, Homo sapiens
tgggggtagaagtcagaatgaacaagatggggcggtgagagtcaagtatagacaaggttcagataacagtgtggaagttgagaagacaggtctgtgaaagcagaaggtcatagtgtttggaatcactttgtgaaaataacag

SEQ ID NO: 396657 - DNA, 618 bp, Homo sapiens
ggaatttttgaggacatggaccatgtcttattcatctttgcatatcgttgttgtgtgcagtacttggcatgcaacgcattcaacaaatatttgccaaatgggtaagtgaatgaatgaatgaatgagctctgaccagtagttcccatgtcatcgatcaagatctcccactaggacagatgggctcaaccgattggtttgtacattctgctggtatttgttaataaattagtacattgttttatacttccatcaatttgactggcgtttatgtcatttcatgagcatctgtctcaaccatggcaatcacagctctctgtaggcagaggttatgtcttggtagtaatcctggcatcctctcaacactcagcatcaccactcacagagacttacaagtgcatgaagtgctttgtgatttgaagtctctgcctctgaggtttttgcaggtggggttgtgatattcagccccatcatcctgaagcagctttagaaggaactggtggcttctgtgtctctgtcccccagagcactcccaccacgggaggtgcatccctcagagtgaggagattatgatacaaacagaacactttgccccagtagggcgcttatgtctggatggtg

SEQ ID NO: 396658 - DNA, 471 bp, Homo sapiens
attaggagtgcaatggctgcacagcactgaatacactaagaagtactacgttgtttttctggtttttgtgtttgttttcagacaggtcttgctctgtcacgcaggctggagctgcaatcatggctcactgcagcctcaacttcccaggctcaggcaatcccaccacttcagtctcctgagtagatggaggtacagtcacgcaccaccacgtccagctaattttttaatttttgtagagacaggggtttccctatgttgcccaggctggtctcaaactcctgggctcgagcaattctcccgcctcggcctcccaaagtgttaggattccagatgtgagccaccacgcctggccaagagtactaagttatacactttaaaaggatgaattgtatggcctatgaattacatctcaataaagctgttagagaaaataaaaggaaagagtccagttggggcgctagtatagcacat

SEQ ID NO: 396659 - DNA, 632 bp, Homo sapiens
acacagcatagcacatatggccccaagaatgtgctatcctggccctctgacctagagatctgctgaggcttcaaatctaggctttaccaagggggagtttaggggagtggggaaaacagacctcaaggaaggaggaggcagagtacagggaggagcagcttagggctgtgtggacggcaccgtgagtcaggaatgcaggagcaggtggtcctggtatttcagcgggccatctccagctgccaggcactgtgtagtttagtcggctcccggcgggagcagggcaggggctggtggagccactggttgggaggaaccggctgttcaggctggcccagagcctatgggcaggagtcgcactgtgtgtggacgccccactggctgcggtgcccctcgtctatcccccgcctcatgtttccccctttctcccgtcctttcccccctccccccaatgccctacagcgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgggcggag

SEQ ID NO: 396660 - DNA, 297 bp, Homo sapiens
agatatgtgccaggtgtgccttactgggagtgctgccagagacagtgtctggtcacgacatcagatgccccgagaggaggagcttatgctcaggctagggatggtggctgatatgtgagggcccttggacctaatgtctgcatggcctcgaggtcagagttaacatcctgctgattgaaggccttggactatgaatagtagagaagataggggctcaggtctgaaggccgcaaactataactgcatattgcccatgatacgcaaaactcgtgtagagaaacacaatgtgcatgaggc

SEQ ID NO: 396661 - DNA, 227 bp, Homo sapiens
tgctcacttctaagccccctgaacttagaaaatgggtcattccttttactcgaagtgagaaggtcactggtattgtgatggggcaagcaaggaaaccatgtgagaaaaatgccttcccgggcactccatgatggcagggttcagaataagcctgtctttgttgaggaattgaggcaggaggggagcgtggacaaattcagttccagacattgcaaccacagtgtaca

SEQ ID NO: 396662 - DNA, 573 bp, Homo sapiens
  misc_feature (371)..(371): n is a, c, g, or t
gaggtgacaaaaaagttccatgtacaactaattgaaaccataggcctttgtgtactaagacagtctgccctatttaaggtatcaaaagattaaaaaatagtttaaaacaataccaacacactctaaaaaagacagtcatgaggcatcacagtaacttgtttactggaaatgaaaagagaaaactttggcttagagtatggctctgtggtgttggttccacagttcttcaactacctgtttaaatatcactaataccatgaaaaaaaaatctctgacagtagtctatgtacattatcaagaaggcaaaggaaagcatcatttgacagttttgtggtggactcctacatgtctgagagttttatttttttttntttgtttggtcacctcggggtgacatgcggggcgagaatgccctaggcagagtgagctgcagactccgcgggtcaggggtgtcagtcacccagaaccatccgtttgtgagaccccgggtgcgaggccaagcttcacctatgcttctgaccaatgggctgtaaatgggtggtccccacaactccctcctcgggtttgaacatt

SEQ ID NO: 396663 - DNA, 492 bp, Homo sapiens
agcctgggccgtcctcggcgcacttctccacaggcataggtggcgactgagccacctggcactatctccacgtgctccacacggaggggtgccttctcactggcagcagcacccgcggcgtcctcctgcatccaccctcagaggttatcgaatgccgaggagcccaggatgcacttccgaggctcactggtgactttccggagatacttaggcaaatggacataaatagctcttggatcctagcaggaattctcaacctcatttctcggaattcagaagtcacggttaactcaaagaatgctaagcgggccagggatcacgatctcacagatgggtcccgtgtcccagggcagtgaaggtgccggggccgtctcctgagctgtctgctgcccggtcctgctccgcccgcccctgcgcccctgcaccaccaatccaggcagctccctgaggctgcggtttccttggctccttctgctccctgggcagtgccag

SEQ ID NO: 396664 - DNA, 373 bp, Homo sapiens
ctccctcacggatgcctcaagtgtaactttattttatttatttatttattagaaacagggtctctgttgtcccagctggggcaatcatagctcaccacaacctcgaacttctgggctcaaggaatccttctgccttagcctcctgagtagctaggggtacaaatgtgagctactgtgcttggcttcatatactgttgtttcatgtgttcttaaagcttataaaaaacgtatcatattctgcaacatttttttccctctcaaccttaggtttctgagatgtgtccacattggtatctgcagctctatttccttctttaagctgcagtagagcgctccattatgtaattattaccacagtgtttctcttctgctg

SEQ ID NO: 396665 - DNA, 262 bp, Homo sapiens
aagtctttactaaaaatacaaaaaattagccacccgtggtggtgggcgcctgtagtaccagctactcaggaggctgaggcaggagagtcgcttgagtctaggaggcggaggctgtagtgagccgagatcgcgtcattgcaccctagcctgggcaacaggggcaaaactcttgtctcaaaaaaaaaaaagcttttgttcatttaaaaactgtcagttggtttgaggtataagtaagttgggtagactgatagaagtctaattc

SEQ ID NO: 396666 - DNA, 565 bp, Homo sapiens
caaaaaaaaaaaaaaaaaagagagagaaacagatgcgattaaatactttgttcagaattttttttaaatttatttttaaatcgaggtggagtctcactatgttgcccaggctggtcttgaactcctggactcaagtgatcctcctgccttggctccctaaaatgctgggattataggcatgagccaccacacctggcctagtcttaattagtgattggagcaaaaattagctaacagagttactagtttttttttcatctttttttttggttataccattatgcaaggagttagttaaaaaatgtatttgatagactatacatatttgatatatatatgagatagacttttatgtatatagcagtgtgttgggttctttagagggaaatagcagtataaattagggtttctttccttcaggaggtgacaaatcattgaaaattagagttgaactattatctacacattatataatgatacaaagcaatatttcccccgtaaataatacagccaactaatgctttggaaattaagaagggagacggtgtggtctagagtgatttgt

SEQ ID NO: 396667 - DNA, 347 bp, Homo sapiens
tgaagcctaagttgcccacacttatgcaatcaggtcaaaacttttctccagaaagtttgtaagaagggatatttgcacatgataatactcttctcccctccttgtagaattgcttcatagccatggggcctaagtctgttggactgcgagctaattagcgtcaattaactaaataatattatcagctgaacagcacactttcgtgtctctcagaaagattaacttatgaactaacctcattttactttattttctctagagaaaactaatcagtgcccagtttctttcttctagggatgaaggaaggaaggggaaggtaagaggtccctgttctctctgagggtttt

SEQ ID NO: 396668 - DNA, 397 bp, Homo sapiens
gctagggatgtagttagttggtacaaagccataagttatgctgcccttgttaggattcaagcaaatagccttgatcttgttgcactctgacttagctagcagagcaagtgaatcacagttgggagactacatttgtttggagttgtagcgttcattcattcttttatgaattcctacattcaacaaaaacgttttctgcatctcttacgattaaggcatcatactaagtgctaaatacttcttttaataaacactttatagtacttactatgtgccaggcattgactcatttaattctcataattactctatgaggtgtgtttccctcattttacagatgaggaaactaagtcacagaggttgagtaacttgcctaaggttacacggctagtaagtg

SEQ ID NO: 396669 - DNA, 748 bp, Homo sapiens
tgacagccctgctctcctcaggaactcacccctggtaaccccttctctgtcctcgccatctacggacgctctcctgtgagcactgaaatgccgtctgcactcccggggcctccagctccttctcttttgacttcatcgcagacacatttcttcagagttatcctaatgtactgtttccattttgtctcccactgattcttcagctgtgacgctgtggtctgaatgtgtccctcaaaattcacgtcttacaaactattttttttttttttgagaccgggtctcactctatggcccaggctggcatgcagtggtgcaatcttgactcactgcagcctcgacctcctggtctcaggtgatcctcccacctcagcctcccaaatagctgggactacaggtgtgtgctaccacactcagctaatttttgtatttttggtagagacagggtttccccatgttgcccaggctggtctcaaactcctgagctcaagggatccactctctcagcctcccaaagtacgggattacagtgtgccctgcctgacatggtacaaacttaatccctcatgcaacagtgttgggagacggggacttttggtaatttaggctgattaatgctgtttttaagtgagcttgtgggagtgggttcaggctctttcactgtcccgctgtgtgaagacacaatgtttatcctcttaccctctgccttctgccatgtgaggacactgtaataactggcaccttgattggg

SEQ ID NO: 396670 - DNA, 420 bp, Homo sapiens
ccctaaagactcctccagaaagctcctagaactgatgaaagaattcagcaaagtttctggatacaagattaatgtacacaaattggtagctcttctatacaccaggaaagacaaagcggagaatcaaatcaataactcaaccttttttataacagctgtaaaaataaaatcaaatacttaggaatatacctaatcaaggagacgaaagacctctacaaggaaaactatagaacactggtgaaagaaatcatagatgacacaaacaattggaaacacatcccatgttcatggatgggtagaatcaatattgagaaaatgaccatactgccaaaagcagtctacaaattcagtgcaatccccatcaaaataccaccatcattcttcacagaattagaaacagcaattctaaaattcatatgg

SEQ ID NO: 396671 - DNA, 543 bp, Homo sapiens
gccgggcgtggtggcaggtgcctgtaatcccagctacttgggaggttgagacaggagaattgcttgaacccagcaggcagaggttgcagtgagctgagaccaggcaattgcactccagcctggacaataagagtgaaactctgtctcaaaaaaaaaaggaaaaaaagaaagaaagaaaaaaaaaagggaagtgtggacagagccatgaacacagggaaaatgccatgtgaagattttgagttatgctgtcacaagccaaggaactataggagctaggacaccaggggatcacatccttccctagcaccttcacggggagtatggtcctgccaacaccgtgatctagaacttctggcctccagaacggtggaacaatacatttctattgtttatgccactctgtttgtggtactttgctacagcaaccctacaaattaatacctccttcttagggcaaacccaatcagaagccaggcattgaaggagcctgggagagcagtctgcagggaaggcctcccaaggcataaaaagcaggattgagga

SEQ ID NO: 396672 - DNA, 345 bp, Homo sapiens
gtcaaacagaccaaggttggaacccggcaggtaccacggacggtcacactgtggggggggctggagtcagacagaccaaggttggaacccggcaggtaccacggacggtcacactgtgggggggctggagtcagacagaccaaggttggaacccggcaggtaccacggacggtcacactgtgggggggctggagtcagacagaccaaggttggaacccggcaggtaccacggacggtcacactgtgggggggctggagtcagacagaccaaggttggaacccggcaggtaccacggacgacaggttcctgctgcccatccctctgggaggaatgacggccagcag

SEQ ID NO: 396673 - DNA, 373 bp, Homo sapiens
aacacagtctcggaccatagtgcaaaaaaaagagaagactgaaaaacacattgcttaaaatcatgcaattacatgaaaatcaaacaacatgttcctgaatgagttttgggtaaataaagttaaggcagaaatcaagaagttctttgatgctaatgagaacaaagatacaatgcaccagaatctctgggatccagctaagacagtgttaaggggaaattcatagcattaaatgcccacatcaaaaagttagaaagatctcaaattaacaacctaacatcaaaactggaagaattacagaagcaaaacaaaccaaactcaaaggtagcagaagacaagaaatgaccaaaatgagagctgaaccgaaggaaattaa

SEQ ID NO: 396674 - DNA, 822 bp, Homo sapiens
ctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaag

SEQ ID NO: 396675 - DNA, 352 bp, Homo sapiens
cagaactttattacctaccaaaagaaactgttgagatacttcagcctagccatggtctttttgtgaagaaccataagcatttatccaactccccacctcctttgggggtcaactcaggtttcttggctcagtgaagtctttatagcacctctagcttctgttctctgtaagctgtaatttacagccatcatcaaaagagcatagtttagcggttaatactactttacgtattttatttcttttgaatattccttgaccacaagttcgttgaagccaacagcccacctttcatatctccattcaggagatatgaaaggctgtgctgttgcttacatttctggaaccatgtggt

SEQ ID NO: 396676 - DNA, 371 bp, Homo sapiens
gtcagcaggcttgctgctctcaggctcagcatggacagctgcttctgagagccttctctgcctacccaggctgggtggctgcctctctttggtgtgcccatggcagcccagaatgcctggtggacagggagccctcagcaggccgtactgcagcgccctgcccccgtcagcctccaggagcctggagtccagggacatcaagggcggtcctgtctttctcacccttgtctctccagcccctaacacaggggatgcctgaccccaaactagacgagttacttgacctctctgacccaagacaaaatgggaggaaagtgccaaatttccaagattggccaggggattaaataagataaatatgcaagtctctt

SEQ ID NO: 396677 - DNA, 258 bp, Homo sapiens
tttctgatgaggtacaaggcttcctgtcttgctacccttaaggcacaaatgcagctattaaaaaaaactgcttagcagtatcatggaaatgggctcctcagcaacagggaatcctatcattcttgttgtggtcatgtggcttcttttgtttcactgtctccctatacaaaggtaacgaagagctggatcctttagctactcttctttttactctctatgtaagcaataaactgagtctaaaaaggtcttgtttttttg

SEQ ID NO: 396678 - DNA, 310 bp, Homo sapiens
aacatcttacattagtatgataggtttgttacaatccatggactaatattgatacattatcattagccaaagtacatagtttgttcagattcattaggttttacctaatgtcctttttctgttccaagactgcatctagggtcccagatgacatctagctgtcatgtctctctaagctcctctttgctatgacagcttctcagacttttcttagttttgataactctgacagtcttaagaaatagtaggtgtattgtgggatctccatccattggaatttgtctgtttgaacaattggaattcctctgtt

SEQ ID NO: 396679 - DNA, 301 bp, Homo sapiens
tgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagac

SEQ ID NO: 396680 - DNA, 483 bp, Homo sapiens
tcaacaatgatccaacttatcagtaagattacagaatgtatataacaaaagaaaagtatgtttaatagggtaattatatattaaatctatctcaaattaaatgcttctaaactatagtacataaaatgaatgcaacatatgttaatttcaatgcaaatatataacaaccttattttcaactgacaaggaatgtacaaataccttatatatttaatttatcattactatacttacccttaccttaagatacctaaatgaacaggaaaaaggccttctttatcatttaagttataaaccatactaataatattagtttccttaatgtttaaatctaaaaattgttttgggtcagacaaatattttaatgattccataatatgtaaaaaaaataatacttcctcctcactcattaaacaaatatttattatatgcctcctagtactgggctaggtgttagatgataacggcgattacagagggcat

SEQ ID NO: 396681 - DNA, 477 bp, Homo sapiens
gtctctttctcatggaatcatttcctacccccatatgtcttctcacttagatttggatggagtgtatcctctagctgatttcactttatttttttagtatgcctctctcagctaaatggtctctcctgaactgccaccttcaggggtttccaggcaaactaaaataccagctttcctctgtgcaccggcatgcaggcatcaaagaccctgtttccagttatgttttctggtgaactggcatgtatccctccacctttatcctcttttgcaggcaatactcagtgaagaggctcagatctagagtcacaccactcaggttcaaatcctggctgacacttaatccctgcagtctgatgctagataagttctacaacctggctaagtctcagtgttctaagtcacaagacaggaacaagggcatcccacgacgcaaggcctggcacaaggtgatgcgcaataaaaactgcccactcagcc

SEQ ID NO: 396682 - DNA, 538 bp, Homo sapiens
catggttcagaatagtcttaaatgaatataggattgttcagtatatttgtgcttaaaaactgcaatttctttttttaaaaaagctgttcctaattcaaggaatgataaactagataaatttgagttgatatcgtgtatttttctgttgctaaaatggtcgaggtaaaaaatgtgtgtgtttgaaaatttatgtttgttcatgagcccaaggaattgttgaatattagagaaataatttcaattagtagtttaaattactaaaaatcacaatttaaaaatatggtgattatatcataaatgagtaaagccttaaaatttgctgtttaaaaacatttagtcctttttaagtattaaccaaatgccacaaaataaaaatacacagattaaaaggatacttaaaaaaatacatcagggccaggtgcggtggctcgcacctgtaatcctagcactttgggaggccaaggcgggtggattgcctgaggtcaggagtttaagaccagcctggcaacacggtgaaaccccatctctactaaaatac

SEQ ID NO: 396683 - DNA, 239 bp, Homo sapiens
tcttactgaccccttacctctaccatttttgttctccaaagttaactactgctaactgttctaatattaaacattagtattgcatacttttataaatagaatcagtcagaatgtactcttgttgacatgaaaaagctatattattaaaaactgctacatcaaaaattccaagtgagtagtcggtaaatttattaacaagatatccctggattaatgattctatctcaagtcaaaaacat

SEQ ID NO: 396684 - DNA, 577 bp, Homo sapiens
gccaaaactgcttcacatagtgactgaaccagcagagcaatacagtttgggtattataaagaattttttttattcgtctcatacttgactctgaaagccattataaaatataagttccaaatgcatttagagcactatattggactagtggcagcatctcttgaaggaaccactttatctggtactcatatggatgcatagttctaacttgtttttttttttttttcccataaaagaagagaaacagccagattggaatgtgcctccttcttctgttttatagtcatgccctggaatattttagtcacgatagtcaggactcccaggtcatccatactaccaagcctcatcccatgccgttgttgatatgctctaaatctgacttagaccctcatctctctccattttcaaggctttccattcaggctctgtaaatgtcaggccctttctttacggcagtcttctctcaagttccttttgatttccttgtctggagggaaaccaggtgactccttgttagtttccccctgtagccttctccatccccggtggttattggcatggggatcctcagagg

SEQ ID NO: 396685 - DNA, 626 bp, Homo sapiens
gccaaaactgcttcacatagtgactgaaccagcagagcaatacagtttgggtattataaagaattttttttattcgtctcatacttgactctgaaagccattataaaatataagttccaaatgcatttagagcactatattggactagtggcagcatctcttgaaggaaccactttatctggtactcatatggatgcatagttctaacttgtttttttttttttttcccataaaagaagagaaacagccagattggaatgtgcctccttcttctgttttatagtcatgccctggaatattttagtcacgatagtcaggactcccaggtcatccatactaccaagcctcatcccatgccgttgttgatatgctctaaatctgacttagaccctcatctctctccattttcaaggctttccattcaggctctgtaaatgtcaggccctttctttacggcagtcttctctcaagttccttttgatttccttgtctggagggaaaccaggtgactccttgttagtttccccctgtagccttctccatccccggtggttttccctctcactcttgtcttcctctggccaggctgtgctaggtgtcctccttgtttccccacaccaccttca

SEQ ID NO: 396686 - DNA, 260 bp, Homo sapiens
tgtcaatgtccagtcactcagcaccatatcttgaaaagaccatctgtcccacattgagttgcagagtgggctttctggtgcctcacgggccctggcggcgtgtctaccctgcatcaccaccacagcgtctccacgacggcagcactagaagccttgatgtctgcatctgtcagtcctccagctttctccttcctttccaagatcaccttagccatgtgtaggaaccctggcttttatttccaggtttctgatgccctgac

SEQ ID NO: 396687 - DNA, 671 bp, Homo sapiens
cactggcactgggctggcccggggcgccttaactccctccagccctggcaggcacaaccaccccatggtggagaggcccccgccagggcacctcgcctgtactctctctcaggccagagccaccagcttctgggcctgggctgcccactgtgggctgagccagggcaacgttcccaggccctcctcctggtcctgtgattcaggtagttaatcccccttaatccccttgggcagtctgaggctggagcagggctggactgcgcagcgggcaccagtctgctgactcactgtgcaggcagcacctatgctgcagcccagcctccccacccacagcagggctctggggctggggaggacctgggcaggggcctgcccacagcagggaccggggtccgagtttcaccctttctgggaatttgcctctatgggctcctcccaggactcaaaagggctactttgacatcaactctgcagggcccatgagctctgggctgtccccagcactctccaaagtcatacagtcaggccaggtgtggtggcaagcacatgtaatcccagcactgtgggaggcagaggtgggaggatcccttgagcccaggagttcgaggccagcctgggcaacatgtgagacccccatctctacaaaaacaattaaaacaaattaactcgac

SEQ ID NO: 396688 - DNA, 476 bp, Homo sapiens
tttcactgtgtgatatatactgtattttaaatcattttattgttcagcatttaaattttcagtcttttgttgtaaataatgcttcactgaaatcttgatatgtaaatttttataggcctcacattattttcttatgtctcagttcctacaagtagaaatgctagcttaaagtttgaaatacttatcaatggtattgatagctgttggcaagttttttttttttctcccagagaagttgtcccagtttactgtttcaccatcctacatggcctctggtttaaactaattgtgatagcctactgactgttttctctgcctttagtatcaccttatttttaggtcatcctgacactgtatgcacagtaagttctttaagatacaagtcttattttataactttttgccttaaaattctataggttaaagtgtatttactcggtgtcattcaacacccttcatgatctcgctgctgtcta

SEQ ID NO: 396689 - DNA, 583 bp, Homo sapiens
ggtgatattttgacactctcatttactgtgtgaccatgaccaggtcatttaatgtttcctgttctgtcaaatggagaaaataatactgtttgttcatttatttaattgcattgcctatatttctgtttcagagtaaaaacatgattttagcaaagttgcatacaaacatttatgtcctattttaagggcagtttttgtcaatgatattatccagaaataaataattataatttaatttgtatttttaatgctctactttgctgtactattagtcttagagataatttacttaagtcttgccatagaaccaatatttcagacaaaataagaaggcttagcttcctctcctctgaggagcagtgacatcagcaggagcaattagaggggcagatgtgcccccactccaaacttcagttgttttcttttcttctcctagcatgtcatattgtgcaggtaaactgttttgcacatttagaaagatagttcaattaaaaaaaaaattcaactgtagtcaaaatagtagagaacagagaaggccactgtttggccactttctaattttgcagccttgggcaaatcattt

SEQ ID NO: 396690 - DNA, 271 bp, Homo sapiens
acagttggttcagcatataaaaatcagtatgacacaccatgttgatagaataaaggaaagaaacggacatgattacctcaatagatgcagaaaaaaaatctgacaaaatgaaatatcctttcatgataaaactgctcaacaaactagaaatagaagggcatctgtgaaaaatccacatctaacatcatacctaacagtatgcaagactgagagctttccccctaaacttaggaataagatgaagatacctgctcttaccacttctttcaac

SEQ ID NO: 396691 - DNA, 333 bp, Homo sapiens
aagtgattctccttcgcagcctcccaaatagctaggattacaggacgctgccaccacacccggctaatttttgtattttagtagagacgaggatttcaccatgttggtcagactggtctcgatctcctgacctcaggtgatccgcccacctcgaccttccaaagagctgggattacagacgtgagccactgtgcccagcccgagaccctgtctcttaaaaaaaatccatctccacttctggttgactgtgttactcagtctctgtctgcttcagtttaattttcgtacttaataatggtattttcttgcagagtgtttgtaaagaataaatat

SEQ ID NO: 396692 - DNA, 411 bp, Homo sapiens
catatatttgttaagtagggaaaatcctgctttctgctgtttaaaaggctcctataggtatatattcattcaatttagaggttatactatcaatcagggctgtttttctactccatagaagtcttcttaccactatccacccctgatccttttccctggatataatttgaatacctgtggaaacttgcatatgaccatagggttggatggcaaggcatttagtccctggattctcactggactccagtgagattttttctcattttgctgagtcactgggtaatctggattgatgcctttaattttggagtactatgggatggaacactagattattaggaagggagatggttaaacagagaagggcacccttagtttgaacaaaacactactactactcaacttattatt

SEQ ID NO: 396693 - DNA, 372 bp, Homo sapiens
ctcccctccccgggtgagtggcaaccaccagaagtggttgttttagtccttggagatgccaggccaaagagcccagggaggtcaggcttgggagggggcaggaggtcagggcctagtctggagcagggagccccaggagtcacctgccccagtagtcaccctggggtgactgttgagggcaggggctgggctgctgagggaacagcgctggctaacaatattttggtagggggagtgcagaggcaccaggggggcctaacccggtgtgcctcaggagtggcacagactctggcagtagtcctgccgtcagaggaagtctgcaggtgggtcaggggctatgacctggtggtttttacctttttcttggctgca

SEQ ID NO: 396694 - DNA, 538 bp, Homo sapiens
tgaactggttattaaaaacctcccaataaaggaaaacccaagaccagatgacttcactggtgagttacaccaaatatttaaagaatgaacacaatctttctcaactagttcaaaacatagaagagaaagtaacacttcctaattctgtggcaactattaaccttgacaccacaccaaatacactaagaaaattatctcctatgtaattaattatctcttatgacagtgcatgtaaaaatccaacaaaatactagcaaacaatccagcaggatactaaaagttttatacagcatgaccaagtgggaattattccagaaatgcgaaggtggttcaacatatgagaaagaaaatcagtgtaacacaccacatgaacagaatgaagagggaaagcttacataatgatgtagttgatgcagaaaaagcatttaaccagatctaatacccatccatcatttaaaagtgaacacaaacactcaacaaaataggaataaaaagaggattttctcaacattatcaggatgagtatttgtgaaaaacc

SEQ ID NO: 396695 - DNA, 630 bp, Homo sapiens
tcatcactccagcgacatttgccaagaatttcagtcacttcagttaccaatatccagcagcattcagggtcaagaagacccttttgatatatggcatccttataatttcaaagagccttttcccaagccagcatcattgctgtctatcttgcactcactccaagttctttgtagtccacaattgttggtttatattatctgagcagcaacagagagatactattgccaagctgatgcaatatatttacctcctcatcaggctatgtcaagggaagtggttattaaagggtatattagtttcctagggtggctgtaacaaagtaccacaaactgagtggcttaaaacagcagaaatttattgtcttatagttctggaaactaaaagtccaaaatcaaagtgttatcagtgccatggctctctctccctagaggagagaatcctttcttcctcttgttagcatctggtggttttcaataatccttggggctcttaggcttgcccctgctccattttaatctctccctctgtcctcacatggcattttccattacttacagagacactagacatattggattagaccccactctagtgatgccatcttattacagctcaaatgtgcgctggtt

SEQ ID NO: 396696 - DNA, 433 bp, Homo sapiens
agagggtcccatagggagtatgcctgactaggttgtgttaggagcagaggcagcaggaagctccagcaaagacatgagaaggaaccctgctggggcttcggagcgggagattgggcagtgaagggtcctgaatgggtgattgacttcaagagaccagaagataactggagacctttcagaatccccaaacatgtgaatactcaagaacatgcagactcaaggtcagtggaaaacaataaagcccccttgttgatatagcagctgcagttggccaggttcacttaccagctaagtgacattctggagcaccaagcttccagagggaaatatttacaagtcagcctccttcaaaaggacatccatgtcacgagcattctgagtcatgaaggactagttcatgaaggttaaattagcaaataccatgagcctacct

SEQ ID NO: 396697 - DNA, 1087 bp, Homo sapiens
ccttttcagacagtactcatcccacatggcttctctgactttgaaaactaagggcaacattatttcttgaaactttcccctcccttatcttctggaccagattttaactagactgatagaagatggagtttatgggtgagagagaaaagaaaacatgcactgaacacccagtatgtggccagatggtatgctagagaatttgaattattgcatttaacttaaccaaaagcatagaccctaattatcaactatcattttacagatgaggaaggtgagatacagagaagttgtgcagacatctaacacctcacagctagtaagtggctagacgggaatctgaacatagttaagaccaactacaaaaaccaagcttctactaaatcatgccaaattttagacattcccagaagaaaatgcggagaaaatattttataatcttggggtgcagaaaacttattctaagcaaggcaaagaccttttataaggaatgataaacagtattttaaaaatttaatgtctataaggcaaagagcaaagtcataaacaaagtcaaaatacaaacaagaaactggaacgaagtctctgcaatattgataatgagcaataaggtaatgtttctaaaatgtaaacagctattaacaaagtaataagaaaaacagagacacccaatagaaaaatttagggtaaaggtcatgataaggcaaatcacaaaagaatgcagtggccaaaaaaaatgtgaaaaaaaaaattatctccactataattaacaaattccaaaatttaaaatatgtatgactttttgttattaagatgacaaaaattaattatgtgaatatgagtttgagaaaataagcatacatcacacaattgttgggagtaaaattttataaaacatttctaaagggcaatctgacaagatgtatcaaatattaaatgtgtaattactttgatccagcaattcctttcctaaaaatttatactttaaaaaagtgtgcaaaaggtgtttatacaagttttttcactgcattagtgttgataatcatcaaaaatacagaaataaattgtcaatcaacaggggactgaatga

SEQ ID NO: 396698 - DNA, 222 bp, Homo sapiens
ggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcagga

SEQ ID NO: 396699 - DNA, 718 bp, Homo sapiens
caactattttttgtagggacaggttccccctatgttgctcaggctggtctcaaactcctgggctcacgcgatcttccccccttgacctcccaaagtgctgggattatgggcatgagccactgtgcttggcctgttcctatgtaaaatgaaaaagaagaaacaagaaagcttttactgcttctagagaattccctcagttgtaaatgactaacagtgttaatgacgtttcatgaactaggatgaaaatctttgtggagtattgaattgagtcatcaaagggaagcctgcagtgttacaaccctagccactataaataaagtgtattaatgagctagtagtatgctgcagacgacccacctgtggaagtgagattcttgtggaaaagtcaagatcattgaagagatgtgagaccacctaactgtgaggttacaccaggcatagtcaggaggcaaggaaataggtagctactgtggtctgaatgcttatggctctccacagtcatgttgtgaatcttagtgcaattgtgtttcgaggtggggcctttaggaggtgattaggtgattagctgatgagggttctgccttcatgaatggaattagtgcctgtctcaggctgttcttctgttgctataaagcaatttataaaggaaagaggtttagttggcttatggttctgcaggctgtacaggaagcatggtacaggcttctctttggctgct

SEQ ID NO: 396700 - DNA, 443 bp, Homo sapiens
aaaatatattaaattaagaggagttatattttatatcaactcctttctgtttttacccaggtcactccatctctaaaagaaatttactgtcagatctcctttcttatccactgtggttgggtttttctgttttctcctttttccttctggttgcaaaatgctgggccagtttccgtctcgacgctgggaaccattaacagcagagtgtgggctcctatcctgtatctgtgaggacgaggactccttgcctgtgtgtcttcttgtgtggctatttctaggttgccagtttgccataaaatgcataccaggagaccagacgtggtggctcatgcctgtagtcccagttctttgaagagaccaaggtgggaagattgcttgaggccaggaatttgagaccagcctgggcaacatagtgaaactccatccctaccaaaaaaaaaaaa

SEQ ID NO: 396701 - DNA, 554 bp, Homo sapiens
aggaggcttatggggagcaaaggaaattcaagaatctaaatgatgactcttttcaactcctcccacctatgaatacagatcttaggctaataaatacagacaccccacctacgtcttaggcaatcatcaaggcaaggttaaagaaagtttccctgtctctcgccacttctacacttagccttaggctccatacttttagtggtttatttatctacctcaaggtctccatctgtcatcttttaaatcacttttattctagctaaaaatgttggaggataggaaggacactgggtatttattctaactattttgggggacagaaaggtaaagtaacagaatcagataaactggtgaacatcttagttgtaaagaaaagggggcgctattataagaaaacactgttctatctctgaactttaggttttctaagggagactgctctgtagtttggctagtacattgatgggttttagatgggcaaacctgggctcagagaaggatctaggaagagttgaattgagttattcagcataaaagtatgaaaagagttgaaa

SEQ ID NO: 396702 - DNA, 115 bp, Homo sapiens
ttgtcttgcttgcttattctatgcaattatatgtgtttaagtattgaaatgctaacaacaaccaaagatagtttggtttgctcttagcagaatgataaagtacaggaagcaactt

SEQ ID NO: 396703 - DNA, 604 bp, Homo sapiens
atttccttactgcctcttgcattgccaaaatagttatataaaaatgcacacaacttggccaggcgcggtggctcatgcctgtaatcctagcactttgtttgggaggccaaggtgggtggatcacctgaggtcagaagtatgagaccagcctggccaaccagcatggcaaaaacccatctactaaaaatacaaaaattagcctgacatggtggcaggcacctgtaatcccagctactcaggaggctgaggcaggagaattgcttgaacccgggggttcaatcaaagaaaattccctggttctctaaacatggaattactgaaatctggatttaggttcaaacctgcctcttgggctttgcctactgcagtagctcaacagttctctggctaaaaaataaaaatcagtgtgtaattcaagttcaattcatttaataaatactcaagtatctactatgtagaaggcactatacatggggttttaaacaactcggactaccagcttatttattagttgtgtgaccttgggcaaattacttttctacgactcagttttgtgaaacaaggataccacttcttagtttgtaggactgttgtaagaattaaa

SEQ ID NO: 396704 - DNA, 941 bp, Homo sapiens
  misc_feature (65)..(65): n is a, c, g, or t
tttctctagactaataccttgaatagtaatcaactgctagataacagagtatgcacatttcaacntgtatgagtaacatcccatcctaagctttgcaatctaatgggtgaaaattgatagctcgtacgttttcaactgcacttccctacaaatgagactaagcatcttttcagttcattagccattccaatttccctcctcagcatctcaagtatgaaggaatagttttaatggtgatatttgtaattataattttagatatgcttttgcggaacagctaatcccaatcttatgcaaattgactcagagaacagaaaaagagggaaagttaccctacctgtttatcaggcaagtttagcatttaaatctagaatggaaagactatacaagggaaaatatattacattcagtcttacttatgaacacagacataaaaattttaattgggataggagtttaggacagttcaatatttgaaaattgtatcaatttataagaaaatttaggaaaaaatctagataaatttagtaaaactatatgttaaaactcaatacccattaaagttttaaaaaaccactcttacactatgaacagaaatgagctttttttttcttacagtaaaggctacctttcaaatagaaagcatcatgcttaatagtgaaactttggaaacattctcattaaagccaagggtaagacagatatatctctatcaatacgcaaaaaagaaagaaaatccaaaaggattggaaaggaacagaaatgagatgagatgctccctagaaatattaaaagaaatgaaagtactgtttgtattaataaaataattcagcgttgctggatacaaggtcagcattcaaactagcaatagccaattagaaaataaaaagtatctcctttatatgaaattcaatatagtacccaacattttattgaaggac

SEQ ID NO: 396705 - DNA, 426 bp, Homo sapiens
ggagctcggccatgttacagtacttactcttgtgataatagtttaattgacaaataaaaattgtgtatattggcgtgagccactgcgcccggcctagtgcaacttaatttatcactttatgagcagtgagctttttgtactatttaggaaattgttacctactgtaaggttacagttttttacatttagagttttttacatttagagttactgtacatttggtattgatttttgcatgttggttttaggggtcaagatttattttacattttgtcttaattactatagccttgtaataattctaattcataataaatataataggtaatataaatcttccaatttgttatttaaaatcaccctagtcatttatttcttatttttttttttagaatttgcttataaatttctaccccaccccacccc

SEQ ID NO: 396706 - DNA, 359 bp, Homo sapiens
gccagctgctgggatatgccacagcccaagaaggagaggggcagtacactagataagcaggaaaaaccatgccagcatcgtgacacaaatgcaaagatttgaagaagttcagttccacgtgatcaattcacagattctccatgttggaaacagaaagagtagagatagcaagaagagactatcaataactataaaaggtggaaggtctgcatttatcttggtaccatggggtaatctgttcacatctggaattgaattcttgtatttggtcctcacccaccttggtgcttaaattacctaccactcatttacacaacagtctttcactgagtttatataatgcggtcaacaccctgctg

SEQ ID NO: 396707 - DNA, 241 bp, Homo sapiens
gcctgggtctgccctgctttcttcgaaaggccatttgaaccctgttctgggcataaacagccattaagatgattagtttgggcttgataagtagactaaacaaacccttgaactagttgggagccctttctctcctgtaatctgcctttctactgcattcaaactaatttctcagggtctgaataccttacaagtactatctaatgggtgtattgtttttgtttatgtggtttccttcagc

SEQ ID NO: 396708 - DNA, 301 bp, Homo sapiens
aactagttgggttgtagctgtggctgtgaatctggttcccaagaactggctgtattagtctgttctcacactgctataaagaactacttgagactgggtaatctatgaagaaagaggtttaatggactcacagttccacaggctgtacagaagcatgactgggaggcctcaggaaacttataatcatggtggaaggcaaaggggaagcaagcagcatgacggagcagggtagaaagagaaagggagagtaaaggggaaagtgccacacactttcaaccaaccagatgtcatgagaactcac

SEQ ID NO: 396709 - DNA, 351 bp, Homo sapiens
  misc_feature (282)..(282): n is a, c, g, or t
atctacaaggaataatgtgaaaacacttgagcatttttagaaactgtaataaaggtacaatattaatgctaactgataaaatttttacaggaacttaggcagttataaaaccactttaaatgtatagtaaagtagaacaaacaagtaaatatagataacaggactcagttttcttactattagagaaagaagttttgttgttgttgttgttgttttgagactaagtcttgctctgtcacccaggctggcctcaaactctggacttcaggtgatcacctgccncagccttctaaggtgctaggattataggcttgagccactgcagccaccactctgatatctcttttgaaa

SEQ ID NO: 396710 - DNA, 980 bp, Homo sapiens
catgccaggcacctctgctgagacccaaaggctccataggagtttggcaagtggaaagagaatgaaggtctgggcaaggggtggggaggttttcaggcagaagcactgcacactgaaaggctggaagagaaggtagagtttcagaaagactggagaatggagtaggggatgggtgagatatcacggccagaccctataggccattggaagggagaggcaacagatcaagtcctgggaggcggagttctagttcaaggccatttgtagcttattgtatagcattagacaggtttttagacctcctcagacctcagtttcctcatctctaatagggggctagaaatacccacacgccttcttctcagtgttgtcacgattaaatggtttgaaaaagttaaaaatcctctgcaaaagcaaggagtttgcactgttattcctagaaacactgcttcctcctcctgggtccatccccattcctcccttaggaggtccaccatgcccctctgtgcagcttgaggtaggaagtgtcaacctcagaggagagttggaagaggagatggccaggactggggtttcactgtgacttgggagactcggggtcttattgcctgcctcagggaagatcccacctcccagcccaggcccagaagccctcctaagatacctgccaccctttgctcaagtgacagctgccttttcatgacatgactccctacatgccaagccctatgctgagcactgtcattcagggtcacttcacagttacagcccagactcgaatcagtcagactcaggttcaaatcctaaatatgtccctgccccagttcccatcagtgtggccttgaggaattacttaagcattctgagaaaattactcagtttcctcaacagtaaaaaaagtgcatattaatgagacccaggtcatatggtgggttacgaggtttaaatgagcttattaataaatcccatgataaacagtg

SEQ ID NO: 396711 - DNA, 611 bp, Homo sapiens
gtgtctgtggatgagtgcatttgaaagtctgtgtgtgtgtgtgtgtggtcatgagggtaagttagtgactgcgcaggatgtgtgagtgtgcatggaacactcagtgtgtgtggcaagtgtgtaggcgtgtgaggacaggcagaagtgtgtcagtgtgatgggagtgtgaatgagtgtgcaaaaaggtgagtgaatgtgcatggaagtgtgtgtcaactatgaaggcatgtagtgtgtcagtgtgtgcagtgcaagcatgtgtgggaatgagtgcttgtgggtgtgtccatatccaacgggtatgtgtgaaagcatgtaaaagtgtgtgtagtgtgatggtgtgtggatgtatcagtgtgtataaatgagagcatgtaaatgtgtatgtatgagtgttgagtgagtgtgcatatgtgaggctgtgtgtgtgagtgtaaccatgagggtgtgaacgtgcttaagtgtgcatgtgacagtgcaagtgtaggggtgtgatgcatgtgtgggtttgccagtgtatgagtgtacatggtgtggatctgaatgtgcacagtgtaaagggcatgagtgcaagtgtgtgtgagtgtatgtgaatgagtggtagtgtgcat

SEQ ID NO: 396712 - DNA, 315 bp, Homo sapiens
actattcccacctcagacttgaggaaactaaggtgcagagaagctaagtaacctccccgggtcatgctcctagtgagaagaggggctgggatcccaaactaggctgcctagctcccaatcggtagactacttgcctctcaagaatcagaaactccaaaagcgtgacagggtagttagtgccaaaaggaccaaaaatacactagcatttccatcactacagtggagttgcaagtaggaggtgggacatctgggtgcggtttgaacttggtaattctgacccttctcttcccaatagcaacagagtagcattcccta

SEQ ID NO: 396713 - DNA, 714 bp, Homo sapiens
agcgatgtccttcaacggacgcattcattagaaactgattttcagatgctaccactgcaagactactggagaaatgcaagctgcgctggagatggaattgttcgcagcggcacacaagtttttgcggcaaaggagagagctctaaaagaggaaatacaactagttcatgttaccatgaaccagcgcagtgggacccagaattactgaattaatagaaaactaaatacttctcttaagcagctatgataacttaagaaagtttccagggaagccgtttaatgaaaggaaacaaacaaaaagaagatttattcagtatcctgctccatttttttgaaaaattggaattcctacattccttaacataattctttgtacatctacactgtgaaagcaacacaaactcaaatggagattgcagcccaaatgaacttaaatctgctgtttaactttcttttgaagttatacatggaaatgaaacacaccacagcaactttcatgacatcttgctaacgaagtttggggtttgaaaaatggaatgactagttgactaaaaacacacacgcgcgcacacacacacacacacaaaacaaggagttttgaaaataagcactaagcatctttccaaggaactcactcattccaagaaacttcggttctaactcgcaagctggcggctgctgtgagtgtcctctgaatgcatccgtcgatgtgtcg

SEQ ID NO: 396714 - DNA, 812 bp, Homo sapiens
tggcctcggcctcccaaagttctgggattacaggtgtgagtccatgtgcccagccctttaattctttacttggggttcaggtgactacacatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacactgtagatgctttagcaacctcttcccatgcctccgaagtatctggtttgcatgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatctttacacgatgcaattctcatctgcaggaagcactggcctccttcatccttaggctacagtgctgacactggcctccttcatcctcagactgtggtgccagatgtcacccctctgcgaggcccttgggatcgactgagtgaccagcagtgaagtttgtcagccttctgaatggatgccatgatcagatgtgatggagctcagtgggattctgctgctttccctcccttagctaggatgtccctgataaaggatgacacacaagcctcagcacaactggccaaac

SEQ ID NO: 396715 - DNA, 290 bp, Homo sapiens
tggcctcggcctcccaaagttctgggattacaggaagcactggcctccttcatccttaggctacagtgctgacactggcctccttcatcctcagactgtggtgccagatgtcacccctctgcgaggcccttgggatcgactgagtgaccagcagtgaagtttgtcagccttctgaatggatgccatgatcagatgtgatggagctcagtgggattctgctgctttccctcccttagctaggatgtccctgataaaggatgacacacaagcctcagcacaactggccaaac

SEQ ID NO: 396716 - DNA, 313 bp, Homo sapiens
tcccatcaacctaagatgtttagagaaaaatgttcacttggtccattcagtatcgagatagaaagcctgctgactgttcagccctgtagaacctacctggttgctttataaaggttttggcttggctgtgtagcatttgcaatttccaagtgtggaaaatcaatcctacctccagctagttcagcctgagaaagagacaatttaaggagcattttctttttcttttaattttcttttctttctttctttcttttttttttaaacggagtggaatggagatggatgggaagcgtcgcgcatgggtaccgagctc

SEQ ID NO: 396717 - DNA, 1030 bp, Homo sapiens
agacatagaaagaggtgccagcctctttttaacaaccaggtttcatgtgcactaatagagtgagaactcactcattacccggagaggggacaaagccattcatgagggtctcctccatgattcaaatacctcccaccaggccccacctgcaacactggggatcaattttcaacatgagacttggaagtgacaaatatccaaatcatattaatccacatatctacattgctcctgggatacctggatcattcctggttctctactattgcaagcaatgcttgtatctcacatggaactgcatatacatgtgggcctgacctgcatccctggaatgtatgtatcctagaaaggggttgcagggttgctggagatgcagctccttaatttgactaaacactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggctataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactgtctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacatttactactttaattcatctgggattcatctttgtgtttgatggggatcatgttttatttttctttatataatgggccagtgtgttcccaca

SEQ ID NO: 396718 - DNA, 419 bp, Homo sapiens
tatcttaagcttcaagttcctcagctgtaatgcaaacttaccgcatgagcagtatttacctacatactccaagtcatctctacagaatgacagggagaaatcacagagagaatgacagcaagaatgcagggagaactcacacacatgggaagctcatgttgcctgctgtgcatgagtaataatatcttttgtctctgattccagaacctcatgtctaccatcagcatttatggaaacatgctagagtaaattgtctgtttgcaatgagggtgatatctcagatctttcactatttttgacagtcttgcattcctctattaaagaatttatttaatacaattgatgactatagttagcttgatatatttatgattatttgtccacttctgtttatcacctgattttgttcagtaaaattt

SEQ ID NO: 396719 - DNA, 479 bp, Homo sapiens
ctgatcataactaatgctgagaaaaaaagaatactcttttctgagttaattacccaagttcaaaataagcactctctgacaaagtaataaatactctgctatgttaaaattgattattttaaccattatgcaataaatatctataggtgatatttagtcaactcaaagatatttttgtatgcaacgtaaaaaagcattattagataatatgtacctagagggctatatttaaataaagaaatgttttcattatgtaatatataaaattgacactacaatatgttacttacaggtttataaaaggttattttggtaatgtaacacgtgttccttttgtctgtgatactattcttatgctaagtactagtttataagtcttctaaagccacagtaacatgttaatgggaccaaggatcagcatcaatccaatcctagaaccctgtttaaataaagatcaagtttcagggaaaaaattgtca

SEQ ID NO: 396720 - DNA, 139 bp, Homo sapiens
ccataaatcaagtttgtatacataaacaaaagctacaaagattaaaaaaagaaaaaaatcaatgtacctaatatagatcaatgtacccggagagtcccaggctcagaaaattgacaggttttcattttgagtaatcttt

SEQ ID NO: 396721 - DNA, 154 bp, Homo sapiens
accaccttcaccaagtgatctatactcaccaacaagaatgggacaaatccccaacatcacctccctgaaacaattcctgagaagagcacagcatgtcttttcctgggttcctgccaaggatgcatacatcatttggaaacgtcagacaaatgta

SEQ ID NO: 396722 - DNA, 284 bp, Homo sapiens
aaatagctgttattacaggtgtgcatcaccatgactggctaatttttgtatttttagtagagacagcatctcactctgttgcccaggctggagtgcctcttcatttttatttctttattcagcaagtattgatcaaatgtgctttgtactaggtactgagctctacgttgtgatataatggtgatcaaggagattgtagattctggcagggaaaactgacatcaaacacggtgacccaacatagcaagaccctgtctctgctagaagaatttaaaaaatcaccc

SEQ ID NO: 396723 - DNA, 823 bp, Homo sapiens
caacaattgataggactagataaatatcaattgcatagaataactcaacaacagcatcaaccaacaggatctaattaatatttacagaaccctccactcaaaaaaagcagaatacatactcttttcaaaagcccacaaaatacataccagtgtgggccacatcctgggccataaaacaaacctcatcaaatttaacataactgttctttgaccacagtggaaccaaactagaaaacagtgacagaagataacaggaaaatctccaaatactggtaaatgaaattacagatttctaaataactcacgacttaacgaataagtcttaagagaaatttaaaaaatacattggactgaatggaaacaaagtgacaacatatcaaaatttgcgaggcacagctaaagcagtgctgatatggaaatttatagtgctaaatacatatattagaaaaaaagtctaaaattggtaatctaagttcccacctcaatagcttagaaaaagaagattaaaataaattcaaaacaataataagaaataaaataataaatataagaacagaaatcaatgaaatggaaaacaaaaaatgatagagacaatcaatgaaacaaagggttggttttttgaaaacaataataaaattgacaaacctatagcatgaatgacaaagaaaaaagagagagagaacgcaaattactattatcagaaattaaagagggaatatcactacagacactgcaggcatcaaaaggagataataagcgatattatgagcaactctatatacacaaatttaacaatttagataaaattcttcaaaaaatgcac

SEQ ID NO: 396724 - DNA, 359 bp, Homo sapiens
tattaaccctgacttaagcctcacaccttaaaaaaaatttaattcaaaataaatgtgaaactataaacttttaggaaaaaccacaggagataattctttgggatctggggctaggcaaagagttcttaaaacttgaccgtaaaaagcatgatccataacagaaatagttggtaaactagacctcatcaaaataaaaaactattttgctctttgaacacccatgtaaagaagataaaaagagaagctagagactaaaaaaaaaaatttgcaaccacatatccaagaaaggactagtatctagaattaaaaaacaaaaacaaaaaacctctcaaagctcaacaggtaaccaaccaaccaat

SEQ ID NO: 396725 - DNA, 610 bp, Homo sapiens
tctggatcctggcagtgttctgtatcttgacgtgggcggttgctttacagtaagtcattaagctgtacatttgtattttatctatttatctttaagtattaatatttcataattaaaaagctgaaaataaaacacagcagagcactccaagaaagggaaatgatatcagcaacggcaaaaggaaggaaaacaaacgcaaggtgtgtttgagagaattgcatagaatattgatgttgcatagagacatcttacggaggaatggtgggagatacatcttgaaaactgatttggaatagactgcaatcgatattatcctgctgagagaaagctactgaaatgtttgaacaggagcctagaaagggcttgctgaccgactggaccacagaggagagatgaagagaggaggggataggaaagtggcagagaggaactcaaggttctaaaccacgtggctgtgagaaatgaggcaacactaacagaaaattggaaaacaaaagctgagtgcggggcaaaagtaatggctttagtttaaagagaggacaggccgggcgcggtggctcacgcctgtaatcccagcactttgggaggccaaggcgggcggatcacgagg

SEQ ID NO: 396726 - DNA, 247 bp, Homo sapiens
ctccacagagcataggaaggctctgcagggaacctgcctccacaggagccctgtccaaggtcacacttctcatgagaagcttagacctcatcatgctccaacacattggcccttgcagtgtatgagacttggagagcagattgcagcagtttgtatttatagctgagagcgcagttggggttgcagtgaggctggagaaagtttcaaagcccctcacttgcctgggctttccatggtcctctaccta

SEQ ID NO: 396727 - DNA, 478 bp, Homo sapiens
caggaaaaggagatgtaatctgtaaagggctgtcacccccttgtgatggtgacactgatgtggttaaccccgggacggtgggtcgcatccttgcctagagcagtggtgtgtacagggtcatccttcacagtgaggagaggtaccgacgtcgtctgatgcttgacacaacccgacccacacacattatgcacagatagcaacactgagggtctcggtgacaaatgagtggaaggaacatatgggggtggggggctttcacaaccttgagagcaaaggcaaggcaagttatttctgttgagaaacacaaagccaacaacaccagcagcgaaaggaatgcaaaccacatcttgcttgtttaaagcagtaaaggaacaaaactacataggcaaggaggtgcttttgtgtccccagccatgacttctggttaaaaagtgcacacaaacctcagacagtcaatacactcacttcaacgcctgat

SEQ ID NO: 396728 - DNA, 123 bp, Homo sapiens
agaatctgagacttgtacaatcacaacagcctctgaattacctctggtggtgtctcctcctcctctccatcctccatagggccacagcatctgttccttccagactcccaaggtttgccattg

SEQ ID NO: 396729 - DNA, 641 bp, Homo sapiens
catgtgagaggggaggtaagggatgaacacattctgaggcagatgggaaggaaccaggaaagcaagcctgaaggacagcgacgggcaaagaagaactggcagccagtagggataaatctaacacctacaaaggaatgagccttaaacaaaggcacttttttcgatgtttctctgatcccaccaggcctctgtatcccagtattgtactccctcttttatttcagctagtcagtatttttggcacccttttcaaaagagaaagaaaaaaactcctgctcagaaaccctgttattgtttgtactcatccttacatagcagtaaaatttataatacacaaatttataatatataaactttatatacatatgtatttttccagagaactgttaaacatatacattatttaacagcttaatacactatccaatctattcttcctcaacaatgcaccataacctagctaacctcgaattccaaaataatactaaaatcacactaaagtacaaagaaaagctttagaatcacctgcttggtatctgccttagagtccaacgccaaaagttttttatatttatcaataagggaaacttaagcatatatgaatttcctccagaagaaactatggggaaagttcgaactgc

SEQ ID NO: 396730 - DNA, 388 bp, Homo sapiens
  misc_feature (14)..(15): n is a, c, g, or t
cgttcacaggatcnncatcaaccctaaatttattatggccaatatggcagtaggtttcgggggtggatcagagaaaaggaaagacggatagccacatagttgaacaacatatagcacagcaaaaaaaaacagactagagaaagggataactgggatgggaaaggagcccaaatgggttctaatactgataataaagtactctagttgctttccttccttactagaggctatgggcttcaaaatagcattgctgcctaaaacttcaaatatttaaaggcaaaatagctaattcctcttcatagccttaaacctgtaaactctctttctgaaaatgtggcatataagcacctatgtcataataaatttagggttgatggtaaaaaatgct

SEQ ID NO: 396731 - DNA, 432 bp, Homo sapiens
tatttatattttaaaaagtaatggagaacagtgggttaaaataaccatatcatagtgtttcttgtctgtttccccgtgcccttctttgccacggattttaagtattatgaacattagtgggctttgttggggttagaactaagtatacaatgccctaaaatcttagatggataccaggttacaagtttgataactgtataatggagaattatatctagaagttgaaattatctctgttagtgtcagagtcttgggaggaggggttagatttcgaagaagacttcgaagaggagctgacagggttttggggactgaattttaatttgcttggtgaacaaaagtggaaagtcatttaaggcatatatagacataaagatgtgcaaaaattctgttatattcaggggtctaaaagtagtttggtattgattggat

SEQ ID NO: 396732 - DNA, 150 bp, Homo sapiens
ccagctggtagtgggtctctgcaaggagatggtcgtaggcttccaggtactgttcctacaggtttaggcaggactggaactcctccacagcttgcacatagttttcagattcaacaccaacttctccgagtttaagatgtgcctgggcaa

SEQ ID NO: 396733 - DNA, 389 bp, Homo sapiens
cagacgggcagatcacttgagcccagcggttgtgccagccccactgcactccagtctgggtaacagagtgagaccctgtttccctaaaaaacaattttagtctgggtgcggtggttcatgcctataatcccagcactttaggaggccgaggcaggttgatcacttgaggtcaggtgttcaagaccagcctgagcaacatggtgaaaccccgtctctactaaaaatacaaaaataattagccaggagtggtgttgcacacctgtggtcccagctactcgggaggctgaggcagtagaatcgattgaacccaggagttgtaggttaccatgacccaagattgcgccactacactgcagcttgggcggcagagcgagactctgtctcttaaa

SEQ ID NO: 396734 - DNA, 300 bp, Homo sapiens
attccaaagagattgtgaatgttctccctctggtatgcagtctcctgtcctgtcagaaacatggtacccagaggccaaagctgctgcataagcaagttatcatgaaactattccaggacaggtttcagaagcagggtcttaaaaatgagtattaaatctaatgttcacccagatacatttccaacccacatatagacaccgaatttaacgatgaaagtggaagttactctgttgaggatttatttgaaatgttggttttctcttgtccatctgatacaggtcatagctctgtttctgtca

SEQ ID NO: 396735 - DNA, 526 bp, Homo sapiens
tccctcccttttcttactgtctgtatatactcccttccatttctctgcgtgcgaggatcgaattatatgtcttcctaaaagttgcaggggctaaaaccttgagagagacaaaccacatctgaaaatccagctgcaaaatcccagaaattacttcaagacagctcttgttaaaataatgtcagccagaggtccggacggactgggacccagaagagccaccagaacaagacatgcggacacaggactcagcccgattcttgcgtgccttccttatcaaggctttcccctctgaaaattaaagcagctactttaagtagaaatctggctgcttcccctttactagttttggttaataaattcacgttcttcctaccagaccttatgaattaaactatccgtttaatataatataaactctctgcaagcagcgagagcctccgcatctgcgctgggtcgagtgactgagggtcagctgacttgtgatgaacacaccagggaggtggggcttctttttacttctctcgta

SEQ ID NO: 396736 - DNA, 1033 bp, Homo sapiens
gcttgtttcatagtaggtttgatgaagagtggagagtcttagagaaatgtgataggacaaagcgggggatgagctgaatgttataaactggaggatgcttagtaagacctatttgttcaggtctctatgtcactgcatgtttggagataaggatgcccctttcttctgggtatagggagggcacctcacacattagggtcctttgacctgcttcggggaaggtcataaaacgtaggaaagattttataacctttttcaggggagaaggggagggggaaggtctgttttctcaaatccttcagcttaaaatatctaatatgccaaagtaccatattttggggtaggatgtcttggaccccatcagtagctacctctggcattgtggcagatggtcaccatgtgtcagatgataaacatccacctctggattaattcctcattagggtacttcagatgttaactaataccattagggtgtgagtggaaactaacccagatacacataaatcacactggaaatacttctatattgaagtgtttaaaatttactatagatagtgtaacactttctttgctggagataaaatttatgttgttaaaagagaaaatgcaatattctttaggatgtacagctttaaagctgcattaggagtaaaacacaggaggtacatgcagcatttagtgatcatttctgctcttttctgtagtcttctaggtactctaatcacaaaatgttaatgcgcatctttaggggtaaaataatgtgctctaaagaatatggtagtcactgataatttgtaattatttactagattttttgttactaaataattcaatggtatgactatagtatcagtaatcagcctgctgaagaatgaataatgcaatcaatttacattcttttgttgccattgatagaccagtaacagcttacctttcctatattctgtaggcatctaagaagaaaatataccaaaactttaagatatcaaaatatatttttcagaggtaaaacaatgaccctcgtaaatac

SEQ ID NO: 396737 - DNA, 459 bp, Homo sapiens
attaagaaaacctgttttgatttttaaagatgacaaaatcagttatattgatgtagaaatgatagtttcatatccatgtattcttgaaaaatgccaagacagatcatgtaaaatgttctcattataaaaatgataactatatgaggtaatgcatatgtcaattagctaaatttagtcattcctcaatgtatactatatatacttcaaacatcatgttgtgcataatatatacagttttatatatcaatttaaaataaaacaacaaatcatacattactattaggataagatcctattgtaatgtgtgcagtctgtcatcaaggaaattttaaagcttgactgacatattagtttattggtcataactaatgtcttatagcttgatgtatataggttattaaaagtgaaatatagggaataatatgaaattttggaacaggtgcataatcgcttcatgat

SEQ ID NO: 396738 - DNA, 128 bp, Homo sapiens
acacacaaaaaatactttggttacatacttgtttccctgaaagaatcatgattttattatttttgtaaaaatgacataggttttctttaaaaagaataagaggaaataaaaatcattcagaatactgt

SEQ ID NO: 396739 - DNA, 421 bp, Homo sapiens
gtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtc

SEQ ID NO: 396740 - DNA, 459 bp, Homo sapiens
gagatgtgttattaaattaccagtagcctcaaagtttacaaggataaggattagatcaactatttgctagttttctaatatatgagtacaaaatagagcaatctgataaaacctgaaaataacatgacaaaccctgaaaattaagaaatgaataacgatattttaaaaaattattcaactctagctcttgttaataaaaatacaaatcaagattgtaagctcaataatcaattaattttttatttcaaaacttaaagagctaagtctgaaaaatatatgcatcaacacttagcataatcactaaggtttgaaaaatatgagtctgaaacaatgcacaaaaaacagcgatcacaagtaaataaggaaatgtccacatcagcatattctctcttatagcacttgccactttttaacttagtattaattatttatacgtgccttatgttttcatccccatca

SEQ ID NO: 396741 - DNA, 390 bp, Homo sapiens
gaaaagaagtgtcaaggataactccaaggcttatggtctgagcaactgtaaggacaaggctgccaatttctaacacggtgaagaatgagggagggacaggtttgggaagaggaacgagagtttacttttgaacatgttctgtttcagagtctataacgtatctaagtggagaggctgagcagcagttggatatgagtctgcagttcaggagaaagatgtgggctagagatacagttaggagttgttcatacaggacggaatctaatgtcatgagcctgactgagatcaccaagagtgtaaggaaaaccagagaaaaaaatgtgtccaaagactgagctctggggcattctaatatttagaggttgggggaaaggcaagggaatctgaaaa

SEQ ID NO: 396742 - DNA, 501 bp, Homo sapiens
cacaaatgctagtcagggatcttagagccacaggagttccttagggatcgccactccccacaggtcttgtgtgagaatagatagagtgtgccattgaggaagaagaaattcttgccagtttctcccctttacattccagctttagtgcaatctctgttgaacttgggaatgccaggatgtgtcctggcactgcaagggataggaaagtcgtgttgaccgatgcccttactacatatttttttctgcctagagtaaatgtggggtttattgtaatccaagagtatccctttgaagggttagcagatgaactgtatgtcttaaattgttttctaaacttccatatttgataggatttgtaacatttatttataattaatattgtactgttaaaatcatatcttttatgttataatgtaaagttattttgagctgtttgaaacattgtgaagcagtgggacagctacagtagtttctataaaaactaaacagtaacatttaaaa

SEQ ID NO: 396743 - DNA, 464 bp, Homo sapiens
acactcacagattctggggattaggaaatgtataacttttaggagccattatttaacctaccacagcatctaacaaggaatcaagaatactgatgaaatggaaaaatgaagacattcattatctcttgaaaaatgtccttcacaatctgtatttttaaaaatcttatcttttgccatttgaaatattaatatttgcatatcaaatattcatataaattaattcagactgatatcctttatagaagattccaaaaatgaattctaaggaaaaagtccaatttatcacatatatcaatccttttcacacatagcctcatgaataaccacttgacactgaaacatgaattcagaaactattattattttggcacaggaacaaacttcagaatcacagcatgcagatatctattaacttttattcaagtaaaagttttaaacacctgaataacttatggatacaaacg

SEQ ID NO: 396744 - DNA, 384 bp, Homo sapiens
agttcttccttcttgctacaggtgtgtacatgcagccactcacagaaatcagaagaggccctgagaaagaatttgttctaaccgatcactcagcatttgttgctagttgtgcctgactttgcctccaaaggccccgaccaccattcctgataggtcagattcctttctcaagccacacctctcgagcagattgctacacccgaatccccaaactggagttctacagcatcttacaagagccctttggatttctgggacaattgctgataccataactgggcctccttcctgaaggtttgtcagtcaagggagggacaagtgctaacatagctgtggtcacctcttaaggattaacagcctggagtgcctggctggcagctgtcc

SEQ ID NO: 396745 - DNA, 132 bp, Homo sapiens
ctcagggtccctgggctataaggcagggccatgcttgtacaacaacatctgtgcagtgtgtgtatacctaacacacatcactcatgatgggccaggccccttctatgcaccatgcaaatgtttttaatgttt

SEQ ID NO: 396746 - DNA, 631 bp, Homo sapiens
tgagctgcagaaagtatctaagctatatacatatagcttatccttcggacattgatgaagtatgtataacatttccctctctcttcactatgccaaaagggcacataatgttaacaatgatactggttataactaggccaagcgtggtggctcacacctgtcatcccagcactttaggaggctgaggtgggtggatcacctgaggtcaggagttcgagaccagcctggccaacagggtgaaaccccgtctctactaaaaatacaaaacttagccgggcgtggtggcaggtgcctgtaatcccagctacttgggaggctgaggcaggagaatcacttgaacccaggaggcagaggttgcaatggtctgagatcaagccattgcactccggcctaggcaacaagagcaaaactccatctcaaaataaataaacaaattttcaattatcaattaaacagtaaccaaagaataaaagtaactatttgtttctggatttataaataagatttgtacttgaaggtttaagaaaaatgactacttgcaattctaataaaccaaattctgattcagtataaataacttttaagtctgttcctcacacaaaaggactactccaatatatttctttaaatc

SEQ ID NO: 396747 - DNA, 226 bp, Homo sapiens
ttgatgttggtgatggtgatggcattggtgatgtcggtgatggtggtggtgatggtgtcagtggtaacaaagatggtagacataggggagtagataagagcatagccctggacccacagggctagattcagattctgtctctatccttgcttattgtatgatgtgggccaccaccacaaccaccatgaccatcatcaccatcatcagagtcaccactgcacctcga

SEQ ID NO: 396748 - DNA, 577 bp, Homo sapiens
tggcaaaaggatatcatcaaccctaaatttattatgatgattataattttggcatcacatatataccacctagaatgaatgtggaagaaatgagtcttttatggttagtttgaaagaatccattgaagatagaaaatgagagaatagaagaaacctgagaatagtaaaataaagagcagagaaaatatgggggcagggaaaacatgtgagtgctaaggattgattatgaatgaacgattagggggattgatggatcacagggtaagtatatgcttaactttataagaaacttccacatagttttccacagcgtttctaccattttcatttccacccgtactacctacaacttccactgactccacagccctgccaacagttggtgttgtcttttgtattttagcctttctagtgggtctgaaatggtaactcattgtgattttcatttctgcttctgtgacaactaatgttgaaaacttttcaagtgtttaatggtcactcatatatcttcttttgtgaagtgtgtattcaaatcttttgcccataataaatttagggttgatggggttttattggg

SEQ ID NO: 396749 - DNA, 225 bp, Homo sapiens
ttttggtaaagacagggttttgccatgttgcctaggctggtctcaaactgctgacctcaagtgatccatccactttggcctcccaaagtgccaccgcacccagcccatccttaatcttttttttttttttttttaagagagagtctcactctgtcaaacaggatggagtgcagtggtgcaatcttggctcactgcaacctccacctcccaggttcaagtgattct

SEQ ID NO: 396750 - DNA, 122 bp, Homo sapiens
aaggtttaaggggtctgaggctgggtgttttctcttttcacacatggaaagtctagagggactaattttagatatttctcttcccttgggtctcctatactgtattggagccatagtctgtt

SEQ ID NO: 396751 - DNA, 265 bp, Homo sapiens
gcttacctacccaggcatcacaacaacttctgccttttcagtctctatacaaattttctgcgcctaatgcactgggtggctacaggtcactgttatgaactgccattgttgaattctacgctctcaaaagtctttgtctgctttttgcctttcagtctgtattttgtattgagctgttggcagttgcttttttctgctcttcttgtgcctgctcccagctgctctcccaattcacttgtagtttgttactccaaaacatctttgg

SEQ ID NO: 396752 - DNA, 223 bp, Homo sapiens
gagttttccacagggaggtagtaaatatttgatgggaacttccagctcctcctgactcaggtgaccctggtgacatttcagaacattgggccggagaattcacttaatgactgagaaattagaaggagaaacaaaagcacgtcgctacaatgctcggagctcagaaagggctcatgtaggcaaattctgcaagataggaaagaaaggactctttttttttttt

SEQ ID NO: 396753 - DNA, 404 bp, Homo sapiens
aagcagattatcctccatgatgtggacagacctcacccaatcagttgaaggactgagcagaatgaagactgaaccctatgaggaagaaattctccaagcaaatggcctttggttctgtttctctggagaactgtgactaatacaggatcatactaactgaactacttttcaataggacatttttttgcttaacatatcattgacattcttgtaggtggcagacagggcagactgcctcattactgattctgaaccacttccccaggagaaatagtttcagaattctcctagtgtcttctgaaaatgcttctgctcttctgatgcaggcaacacttcttcctgaggacccaggccctgaaggtgcagccactatcagatttgaccacatggaacaaacatgagga

SEQ ID NO: 396754 - DNA, 108 bp, Homo sapiens
tttttctttctttctttctttcttttttttttttagccctgagatgtatttgacttctgaacacctagaaccctttgttttcttctttcctgtattccctgacccttt

SEQ ID NO: 396755 - DNA, 468 bp, Homo sapiens
cgggcttactgtacgtcagtctagatggtaaaaggtattagcaatctgtcaaataacttgaacagtactctactggtggtcaccatctgaaacaccagggacctgcaacaggaagagtgtagttctggcaggctattgttcagtaattcaaaggcttaagagaaacctgtcctttacctgcaacaaaaagctaaaaagatcaggtctctgcccattagcttctgctcatcatgtcctctaactatatttgaccaattttgaaaacaaaagattatcaatcaacccttttcaaaatttatttaattcaatagataagaaaagagatttaaaggggatgggagaacttgaaagaaagtctggggaatcactacagcgtgcacattattttaaaataataagtcatatttacaatgtcctaagactccaggatagcaattttttctttaactatgttacagtaaaagtcat

SEQ ID NO: 396756 - DNA, 501 bp, Homo sapiens
gctgcagtactaaatagcagaggggagggcaggtaccaactgcagtactaaatactggtgtggggagggcaggtgccagctgcagtactaaatactgctgtgcggagggcaggtgccagctgcagtactaaatagcagaggggagggcaggtgccagctgcagtaccaaatactggtgtggggagggcaggtgccagctgcagtgcgtggggagggcaggtgccagctgcagtgtgtggggagggcaggtgccagctgcagtactaaatagcgggggaagatttttttctgagcaactttgagtcactgctcacatctcatgccaatgtattaatcccaagtcaagggtcagatgaggcactcggatctctccagttgccaacacagctcttccaagtgtactttacttcctttcattcctgctctaaaactttatttatgtatttatttttgagacagaatcttgctctgtcgcctgggctggagtgcagtggcacaatc

SEQ ID NO: 396757 - DNA, 267 bp, Homo sapiens
gtaaactaattaataattttcattccagatttagcaaaaacctccaaccagctttatttttcatattggggctaacttaattgatgctgagcatcagagttatttaaaaatgttagaatataagcaaaattttaccatattcttcgtggtattgatcatcattaggaacatcaaattttatgcttcgctgtaactcattggctctcttgtggggttttgaaggacatggaattgtccttacactgatttcttgcttggcttctaaat

SEQ ID NO: 396758 - DNA, 414 bp, Homo sapiens
acttccaaaattcatgtccatctagaacctcagaatctaaccttatttggaaatagggtctttgcacatgtaattagctaggatcttgagatgaaatcatcctggattcaggtcctaaatccaatgacacatccttagaagagaagaagacagagagaaaggcactatgaagatggagcagagattggagtggtgcatccgcaagccaaggaatgctgaggattgcctgcagaaaccaggagagaggcagggggcagattctcccctaaaaccaccagaaggaatcaaccctctccataccttgattttggccttctggcctccggaactgtgagagaagaaattcctgttgttttaagccatcagtttgtactaacttgaaatggcagccctagtaaactaatacaccaccca

SEQ ID NO: 396759 - DNA, 593 bp, Homo sapiens
ccctcacggattacctcaatataaaaaaaaaagaccacttaagtatctagatctctgtgctaatgaactattaacaatgagtagggaatgacagtcatgcaacttctacattaaggtctaaccttgtctaagaattgaagagctttcaacttggcaagtaacagtcccaacctacaacaactaggataaatccggaagattgaaacaaagaggatgcattcacacttatcgggaaaatatttttatgggaacaccaagaacaataccagacttgtcaattgtcagtcagctgcaaggaaatctttcagtcagctgaaagaattcagtgcagtgtaacacactcatacttagggaaccagaatatccattaatattaaattttttttttctttttttgagacggagtcttgctctgttgcccaggctggagtgcggtggcacgatctcagctcgctgcaacctccgcctccttggttcaagcgattctcctgcctcaccttcctgagtagctgggattacaggcatgcgccaccatgcccagctaattttgtatttttagtagagatggggtttcaccatgttggtcaggctgg

SEQ ID NO: 396760 - DNA, 375 bp, Homo sapiens
tgagatggagtctcactctgtcgcccaggctggagtgcagtgacgtgatcttggctcgctgcaacctctgcctcccaggttcaagtgattctcctgcctcagcctccagagtagctgggattacagagcaagactgtctcaaaaataaaaaattgtacaaggtgagatgtcatattaaaataattacacaaacactgctgtgaagactaagatgtcatgctgtggaggtggaactggagagtttacgaaaagtagaacatggaaaaaaatgcgggactaccagcacagggcaggaaggaagcccagcatgtgtcctggtccccggccagttcccattttcactcttaaccattttaagcaattggatcaccagtt

SEQ ID NO: 396761 - DNA, 496 bp, Homo sapiens
caatcttaactctcatttgcattatacttaagttcaaagcatttccccacttaaaatgattttaaaacaaaaaggtgaacacttgataggttcataattgggaaataagttatcaatagagtaacaaatttgtgaatttatacccagaatacacaaagaaaggaaacacataaaaatattttacccaggtaatctattgaatttctaatgtaaaatagggtattaaatcttgtgtacaacaagatacattatggatatagatatgtgacctcagaatttaaaaaaattcaaaacaagcaaagatacggaatcaaccttaatgcccatcaccaaatgaatggataaaggaaatgtggtatatatacacaatggaataccattcagccataaaaaggatggaatcctgtcatttgtgacaacatggatgagcctggaggacattgttaagttagataagccaggcacagatagacaaatattgtatcatctcacttgt

SEQ ID NO: 396762 - DNA, 739 bp, Homo sapiens
gtcttctcttccactgtgatgctcaaaatctcttcaagactggtcatctaatcagcaggatgtaagacggtcattcttcactgtggccattcagaagtttcctggtaacctggctttctcttgaccattgccccacgagcatggtggtgacaagcttgggctctgaaatccgacagccccaagtttgaaacctatagcttcttacttgctagctgtgagacttgggcaaattacttaaccttaatttcctcgctctgtaaaatggggatataatattgggtaatacactaagcctaatgtcagggatataattagtgctcaataaatgtatctctattacccccacatcccattctgccattcccttctttctcttcctcccgcaaacctccaacttcatcattgcctatgaacagccaaaaggtaaaacaatcacaaaactaggcagttttggacagcccagaagttgtttacaagtctacaagtaaccactgcagtctgcccagctgcctggtcttctgaaaagcaaacttagaagccggtgatgtccatgatctcacagaatttcctaggaatgacagggacgtgtattcacaaagttactcttgactctttaaaagaagacaaccatgttttgctcccatgatatcccaaggggcacctagattgctgggggcctgtggtccgagaagtaatgccacctggaaaagtgggtgtgactggtttagggtccaggtct

SEQ ID NO: 396763 - DNA, 463 bp, Homo sapiens
tgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacataggagaattcatactggagagaaaccctacacatgtggagaatgtggcaaaacctttagacagtccgcaaacctttacgtacataggagaattcatactggagagaaaccttacaaatgcgaagactgtggcaaagcctttggacggtacacagccctgaatcaacacaagaaaattcatactggagagaaaccttacaa

SEQ ID NO: 396764 - DNA, 872 bp, Homo sapiens
tgatgatgatgatggagggacttctgtggttttgcagcttttcatattttgcagagcatttgaccatccactcttagcagtagcccacccactggccacctgggggctccccagtccacttctgcatcctgcataaggcctgcagtgcccactctcagccccttcctccctgaacactgacaccacctgtatgtgtactgccagcctggattccctttcacttgacagcaaccacctaaccctacatgtgctctgcaaaacacaatgacacacacagttaccctccaaagacagtaccgggaaggaatgatgtcaggcagtgatgtcctaaagcccagacaccaggtatgcccaatcctcaccaaaacacctaagtagccctggaacgtgcacatggtcttctgttctgcgatcaaaatgttccatttgtattgagatggcctcttcgctgctgagagaatgcaggaattgcactgagtttagcaaaggaactcgatctgactcaatacaacttagaacaaagaggaacttctcaagcatgtgataatctattcttttcaccaactttctcaggtgcacgaaagtggtcatgcatttctacgctgtatttaaaagaaaaacattttattgactctttaaataaaactctatccacaactataaaggaaaatggggaaatatgacctgtcacacaatcgcataaaaatttacatcgcagataaaatactacaatcgcttcatgaaataacttgcatccatcaaccgtggagatgggcaaggaaatataaccatcctcattttatagaggtaagaacaaagataaagataagaatatataaaagcagaggttagaattataaaaccagtcagcc

SEQ ID NO: 396765 - DNA, 447 bp, Homo sapiens
tgatgatgatgatggagggacttctgtggttttgcagcttttcatattttgcagagcatttgaccatccactcttagcagtagcccacccactggccacctgggggctccccagtccacttctgcatcctgcataaggcctgcagtgcccactctcagccccttcctccctgaacactgacaccacctgtatgtgtactgccagcctggattccctttcacttgacagcaaccacctaaccctacatgtgctctgcaaaacacaatgacacacacagttaccctccaaagacagtaccgggaaggaatgatgtcaggcagtgatgtcctaaagcccagacaccaggtatgcccaatcctcaccaaaacacctaagtagccctggaacgtgcacatggtcttctgttctgcgatagggtatgctctgatggatcctctagatgacgca

SEQ ID NO: 396766 - DNA, 392 bp, Homo sapiens
taaataagaagaaataaactctctagtaaaaattgcagacacacaaaaggcttgaacaggcacttcacaaaatagattatccaaatgaccaataaatacataagtactcaacatcattagccattagaaaaatgcaagttaaaaccacaatgagataccatttcacactagaatgaataaaattttaaaagactgacaatgctaaatgttcccaggatgcagaacaaccaaaaccctcatatattatgggggacatggaaaattgtacaactcctttggaaaacaagtagtttctacagaatttcaatatatacataccatacaactcagccattgcattcctatttacccaacagaaataaaatcatttgtctactgaaaaatttgcaaaa

SEQ ID NO: 396767 - DNA, 358 bp, Homo sapiens
ctgaatagctgggactacaggcacacgccaccatgctcagctaatttttgtgtttttagtagagacggggttttgccatgttggccaggctggtctcgaactcctgacctcaggtgatccccctgcctcagcctcccaaagtgttgggattacaggcatgagtcactgcacctagcctacaggcaattttgtacagagaataattcctttccagaagtagcccgatatagcagaaagcatgagttttgttgtgagacagacttagctctacatcttttatgtgagacttaacctgttttttctatgggcaaatgacctgaactcctgatcagtttccccatctgtaaagtgaggatga

SEQ ID NO: 396768 - DNA, 620 bp, Homo sapiens
agagacctggactgggccacttctggtcttatgtgatatgcataattatggtctttgaacccgttcatttctttattcttttctttttatcttttatgagatggagtcttgccgtgtcacccaggccggagtgcagcagcaccaccaggaccctggtggtgctgcttatttaggaattaattattcaggggaaatatcaaaactaagtttatcacaatatgaaataccaagtttatcatgatatgaaatactattgtttccagctgagttttaaacaggaggtgggacacaattatgcttaggagagttagtactttctcttaccaaggaaattactgagaactcgttttgagagtgagcaccttctctggggagtgaaaaaggaagaggaatgcagggaactgtctttgggatacttatggcctaaaggaaatgtaaagtcggttccacctaaagagcaaaagtctgtagacaatctaaactccagcattagatgactggtcagataaactgtggtgcagtcaacaaaatggaacactatgcaacccttagcatgaagtggatgtgtgccaattcagtattaacagtaactgtggtggcagcagcaccaccatagcaac

SEQ ID NO: 396769 - DNA, 501 bp, Homo sapiens
gtgtcagacacttatttggacagttctctcctttattccgtttttctcccttcttactgattaccataaagtcattttttaaactatcataacagtgatcattttttccaattaccatttactcatgtcatctcattttacctctatttttaacctgattaatacaaattatttttggttgttttaagacaaagtcttgctttgtcactcaggctggtctcaaactcctggcctcaagccatcctcctgccttggcctcccgagtagctgggactacaggtgcccactgccatgcccagctaatttttgtattttagtagagacggggtttcactgtgttgtccaggctggtctccaactcctgagctcaggcaatccgaccgcctcggcctcccaaagtgctaggattacagacatgagccaccttgcccagccaaaaccatgttctaattaaccacttaagttcaaatagcatgcaacaagcaaggaattgtccaggtt

SEQ ID NO: 396770 - DNA, 415 bp, Homo sapiens
attgtcgcttctctcagtgtcagacttgacaactgtcccttcatcatgctagagtcagcatctctgtctccaataagatgcctgctctcagataaggtacaatctgctgtgggatttcaaactatataactgggtcagaaataagagtaaatgattcctctggggcctaaagaatcccatcataagtagtgcaaggacaaagaaaaatttaaaatatgaagcataattctctctattgaaaaaaacagatttccctcctctccattttcttagaaagcttgtaatactaagtactttctcctcctttaaaacatatataaatcctttacaaagctaaataggccttttgtcagtcttatgacctaggaatgtcttaagggcttgcacatcatctccttgaaatgtcaacatcaag

SEQ ID NO: 396771 - DNA, 656 bp, Homo sapiens
gttgcttgggtctcggggtgtgtgggacacatccaaaacaaactccctctctggaacaatgctgttgcatggacttcaggcatttccctatactagtctcagggcctgtgagggctgaggggctctaccttggctaagattgcaggagttcacaatggaaaagtgtactgggggatctctcacttaccttttcccggcactggaaagtttctcctggctttgagcctatcccaaccatgctggctgcttcacttctctctccttccatgcctcagaagttctctgacactgccctgctgaattccaatgttctctctaagatgctgtattcaatgtgtgatcttctactcactgtttaggccctttctggaggagacaagtgccacgtacctctagccaccagccagtaatttattctattaggaattctgggactacaggcacccaccaccatgcctggctaattttttggatttttaggagagacggggtttcactgtgttaggatggtcttgatctcctgacctcgtgatccggccgccttggcctcccaaagtgcttggaatacacgtgtgagccactgtggctcggcactggcaactcttttaatggaagagtgcagcccccagaacctgtcgtgacacgggacaggccgg

SEQ ID NO: 396772 - DNA, 419 bp, Homo sapiens
ttctgtccctttgctgatattctcattttgttcatgcattgttttcctgtctttactcttactatctttgagataaagttttttaaaatctttgtctagtggctgagtggtgagtcacacctgtaatcctagcactttgggaggccgaggcaggtggatcacttgaggtcagaagtttaagaccagcctggccaacatggcgaaaccctgtcttcactaaaaatacaaaaaaaacccaactaaacaaaaaaaacaaaaacaaaaacaaaactagctgggtgtggtggcacacacctgtggtcccagctacttgggaggctgaggcatgagaatcacttgaacctgggaggcacacgtggcagtgagctgagatcgcaccactgcactccagcctgggtgacagagcaagactgtctcaa

SEQ ID NO: 396773 - DNA, 3040 bp, Homo sapiens
ggcacgagggcggagcccacggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggaggtcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaatcgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccaattgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtg

SEQ ID NO: 396774 - DNA, 403 bp, Homo sapiens
gagaaaaaaaagtgacatgagaaaccaagccacagacaattcacatattggagttcactggcaagaactctaagataactatgactaatgtgtttgagacaattatggataagataataggcaaagactttgatcagaaaagtaatctataaaaatcaaatggatattctagaactgaatacagtgtctggagttgagaacacagtaggtggatgtaatagtggatttgtgtaacaaaagacaagattagtgaactacaagacaggtcagtagaaaaaaatacatactgaagcatgtattggaggcatgtaaacacaatgaaaagcctttagaaagataattggagtcttggaatagaatggggccaaagtaacatttgaccaagctcagaaaactaaagcag

SEQ ID NO: 396775 - DNA, 464 bp, Homo sapiens
cccagaattttgagctctttcctcttatctcccacatctaatcaatcactcatccatttatttgctaaatattatgttctcattttgtgcccattattgtgacaaaaattctttagatttaatattgctgatatcttttgtacctttttgctacaatctttgttgtctttctcatgttgtaactaacctcttaacccatctccccttcttaacccatctcctgcgtacttaaatcaaagtgacttttcaaaattcaggtcagatctttttttttaatggtttaaaaccctttagtttcctaattgcccatagtaaagtccagacttcttagtatggcacataagccactctgtaggctgtatttttccactattcttcctttcttcttatgcatttctgaaaccctgttcactaccattgttcagccaacaacagttttctgaatgtgtcatgctgattctatg

SEQ ID NO: 396776 - DNA, 118 bp, Homo sapiens
ttggcaaatgatgatgttgaaatacaacagacaacttctcttgggaaccatttaatcagtgctcacttttgcactctttccagaaatgtcaatggctttaaaatgtagaagtatatta

SEQ ID NO: 396777 - DNA, 352 bp, Homo sapiens
gagaattatgcatacagggctcacaggcggagttggacaatatgctgatggatcaagacatactgcaaccacaaagttccatctcacttagatgtggatgaaaaaagatctcttgctaaattattttctgtgaccttaaaagaaatttgtttcacttttcatctttcaagggtcatcttgatagttaccttaacaaacctttctcagctatttattattgagaaagcccattcttaaattttaagtcacaaaattatagttgtccactctactatgactgaaagaagcagcattcaagaaaaaatttaaacatagttaccaagaaatgtgaagaagtatttataaaaggaag

SEQ ID NO: 396778 - DNA, 631 bp, Homo sapiens
caaaagaggagaaagagccccaactatctatatattgggtattcttgaatggagaagcaacgttgacatttttgctctcggggtgaacaaggatccttttagagtcttgtttactagtcatagtatagaggggcataatttgagaaggggagtctgctcttaacaggtcatcagaacagggtaagtgtcaggtcaaccacagaaaccttgatctgtggctaggactcgcacattttacaaagctcttctattttctgtggccaccactgtcccctcccacccattaaagcagagctacttcttcactattctaactcctccaaagctgccacatcagaagcagaggcttatccctcattgcgttctaggaagacataagtctacatgtggggctgatactttaacacagtttgctaacttagataacaagttattctcatcaagtaaatttttaagttttaacccaaaccacatttaatgtttaatactaaacttagagtaacttttactcctttttttttctaacaggaggtaataataatattctatgtatgaatccactacacaggcagacacctcattttttttctcctcttcttggtggggagataaactcaaacagaacattaac

SEQ ID NO: 396779 - DNA, 889 bp, Homo sapiens
tgaggacttcggcgcgcgccggaagcacgtgcgcgggctgggcgctctggcggtgtgcgctgaggctcctgagtataacagattggttctgattaaaaccatttcagaggaaagacagtgatcccaggaagcgggaagaaaacagcatcacctgaagttattcctattcgttagatttgttttcttcctgcgaaaaactgctatgtacaagaaagaagtcagtgagctgcagtgatagttagcattattgactgaaactggaccagagatccctgaaacctggacaaggtggtagaaatacaaattatgctgccatttcaaagctgtgggcagttttctactttgtggaaaatgaagacttaggtaggcctttgggaaagacgatttgttttggaaaaaccacccaaagggatcatttggtttgcaaatgtaactgcagtatcacaactggaagaagaaatatacaagggcgaggtttgaaggagcccttcagtatccttggatgatactgtggaagattctttgcatctcagtaactttggatctttgaagatccaagaaaataaatttcttcaaaatatttttagagactgctttgattctgaggcactgctgattatatggaagaaaaaaatattggaagattaatttgtggttttctccagttatcgtctcccttctctttgggggaggtttgtgacgcagtaaaaacagatatacaaaagcctaggcatgttagagatttgcctaagggaaatgtaattatgaagaaggattttttcaagctgaaactagatcccacttttttccaggtcagtgggtccttcaagtatctggtactttccttcctgcttcctgacaatgttaaagaatgtggcatgaccttaca

SEQ ID NO: 396780 - DNA, 615 bp, Homo sapiens
ggcaggagaatcacttgaacccaggaggcagaggttgcagtgagccgagattgtgccattgcactccagcatgggagacaagaacaagactctgtctcaaaaagaaaaaagaacaagggctctggattaagacgaccacttatgagctgggtgaatttaggcaagctataacttgtgtacctcatttttctacatccgaaaaatggggatcataattatatatagatgcttctcaacttagggtggggttatatcctgataaacccatcataaattgaaagtaccataaattgagagccaggcacagtggctcatgcctgtaaatgtagctacatgggaggctgaggtgggagggatcatatgaggcccagagttcgagaccagcctgggcaacataatgaaacccctgtgtcttaaaaaaaaaagtttttttttaaattagcagtgtgtggtggtatgtgcttgtagtcccagctactggggaggttgaagtgggaggattgcttgagctcaggagttcgaggctgcagtgagctatgatcactccactgtattccagcctggacaaaagagtgaaaccctgtctcttagaaaaggaaatagaagttggaaata

SEQ ID NO: 396781 - DNA, 786 bp, Homo sapiens
tgacttgccttgagcacatgtctggtagcttcttcctgggaacatagatgacataacgcatattgcctttccaggcagcttgatctgtcatgagacagctctggccttttagaaaccagcctttatactgagctgtgagcctgcttctctgtattgcacattttttgttcttaattctgaacaaaaagtttttgtgaattttcttcctggaaatggtcttcaccacttgaaacaactgtcatgcccatctgagcatatttcttaggtgaggcttcccagtttgggagacgcttctctcataaaatatttctgaattcatcagtatctctgttcctataaaacgcgtggctgtctacttcaggcaaatcctaaccaagctcaggtaacagtgaagtgattgtttgctgtgaaacagtattgtactgttgaagttaaagaggtctatgattacattgtgtttattttggattttgcattattgagtattttttactttattttctttttgtaaagcccatatcactacctataacaagcttttgataagtgaactttctaatttttcctattctatagctatgtaagggaatctttaaattttgccaggactttctagcctaatgcaacaagggaggttacataaactataataatttaaatttcattagttttttcccacatttgctgaagcaattcttctacacaatctatttcattatttctgggagttctaaatgtgtcccacaggaacacatcccccttcttggaactactgctcttccacca

SEQ ID NO: 396782 - DNA, 141 bp, Homo sapiens
tttcctccagttactctctggcacatcaccttattaaattacattgcttatgtttttgttttttttgtgtgtgagttaccattcccccttactagactataaggtacataactttgttttgtttatcactgtattttcagt

SEQ ID NO: 396783 - DNA, 395 bp, Homo sapiens
gttctcctcccacatcccctgcatcattatgaccaattaattaagaatctggaaggtggagccagaatgtggatatttctcaaagctcccagttaaatctaatgtatagccaagccagcgttgcaatccaccacactatacgttctctcctctcaaggagaagagtggtaagaacagaataagagtgaagggaggagcaagcagaaagatgagagaaacttgacaaaacttatctctgaagaatggaatttttatttgctaacatgctaatatagaactagtcttcttgtctcattgctacacctgaagacttaaaaacaaaaggaattgtaaaaagaaaactaattatttctatatatgcatatatgtacatatgcatgtttttacaggaaact

SEQ ID NO: 396784 - DNA, 248 bp, Homo sapiens
  misc_feature (44)..(44): n is a, c, g, or t
  misc_feature (50)..(50): n is a, c, g, or t
ggtacggaagcatctctaagcagcccgatacacatgttaatttnagcccngtaagactcatttgggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaa

SEQ ID NO: 396785 - DNA, 4485 bp, Homo sapiens
aggctggtaccggtctgggagtttgggatcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaacacttccgtcagcctcgggcggaggatcgtcttagtagctggccagacctggaggagagcgggcggtctttgcgggcctcaggagataggtggccgcccggccctttccccgcctgcccggataggtgcgtgcagacccaccaaagaaaagcggtcgctgcgggacccccagtcccacctcggccgcgctgtgggatggctgcgcccccaggggttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaa

SEQ ID NO: 396786 - DNA, 3863 bp, Homo sapiens
aggctggtaccggtctgggagtttgggatcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaacacttccgtcagcctcgggcggaggatcgtcttagtagctggccagacctggaggagagcgggcggtctttgcgggcctcaggagataggtggccgcccggccctttccccgcctgcccggataggtgcgtgcagacccaccaaagaaaagcggtcgctgcgggacccccagtcccacctcggccgcgctgtgggatggctgcgcccccaggggttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgtccacctaaacgcaaactggaatttgatcccagagcctttttcaccaccatctccgttgtttctggaagcacccttcaggcaggcctgccagcttcacggggcctccagtggggtttaacggtttgaggtttcccctttttgaaattctgtttcacaagaaccctgccttttcaaggcctttggtaaacgtttgggcca

SEQ ID NO: 396787 - DNA, 2122 bp, Homo sapiens
cgctttctgaggaggagagcatggcgcgggcctcggcgaacgacttccgtcagcctcgggcgaaggatcgtcttagtagctggccagacctggaggagagcgggcggtctttgcgggcctcaggagataggtggccgcccggcccgtttccccactccctcatgctttgggttagggttttctttcacgctttctgaggaggagagcatggcgcgggcctcggcgaacacttccgtcagcctcgggcggaggatcgtcttagtagctggccagacctggaggagagcgggcggtctttgcgggcctcaggagataggtggccgcccggccctttccccgcctgcccggataggtgcgtgcagacccaccaaagaaaagcggtcgctgcgggacccccagtcccacctcggccgcgctgtgggatggctgcgcccccaggggttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaa

SEQ ID NO: 396788 - DNA, 4479 bp, Homo sapiens
aggctggtaccggtctgggagtttgggatcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaacacttccgtcagcctcgggcggaggatcgtcttagtagctggccagacctggaggagagcgggcggtctttgcgggcctcaggagataggtggccgcccggccctttccccgcctgcccggataggtgcgtgcagacccaccaaagaaaagcggtcgctgcgggacccccagtcccacctcggccgcgctgtgggatggctgcgcccccaggggttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaagccactctgatggtgtcacacaagtaatatattcccctgccgaatagcgactgcgaacactctcagcttataattagctgacaccatgaggcatattgctgcgctatggtaatcctctacagctgactgacggaactgcaaccgtgagactactcggctaggtaaaggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaa

SEQ ID NO: 396789 - DNA, 3853 bp, Homo sapiens
gtatttcaattgcagtgggactggggtttcagttgaaagttactgtgcctgtgtcttacagattacattctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaacacttccgtcagcctcgggcggaggatcgtcttagtagctggccagacctggaggagagcgggcggtctttgcgggcctcaggagataggtggccgcccggccctttccccgcctgcccggataggtgcgtgcagacccaccaaagaaaagcggtcgctgcgggacccccagtcccacctcggccgcgctgtgggatggctgcgcccccaggggttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaa

SEQ ID NO: 396790 - DNA, 282 bp, Homo sapiens
tattacctaaggtgagccctcccagagctcccggagtataaaagcattaagcgcatgttctaacaaactcataaaaatcaataaacaggaaccccccacctgtgcaatggccccagtgttaagttttatacgtgtagtaatagtgcatatcaattttcaccacccttcctacgctagctattacagggcctaccaccaccggagggacagcgagagccgcaccattcatccatcccacagagttgtctacatgccaggcccattgcatcattgtcagtttta

SEQ ID NO: 396791 - DNA, 1034 bp, Homo sapiens
ctgcaccctctgcctcctggctcaagccatcctctcacctcagctactcaggaggctgagacaggagaattgcttgaacccgggaggcggaagttgcagtgagtctagatcgcagagtgagactccgtcccccccacaaaaaaacaaaaacaaaacaaacaaacaaaaaaacccattcagtcccgtttgactccggaaattcggtgagaatgaaaataagtttttaaggcttggagagttaggcacttttagagtttcaggaaggtggagtgtaatgcaattttttcttctccctttaccccatattttctgcatttattttatatcaccctttttatgtctggatctttcccaagggaagaagggatggcactgcagcttgagggctcgaggtcagacttgaagaagaacttccataaagagttttataatagtgggtgggtgagccacagtggtaaggtgtccttttctggagtgacttgaaaaacaaaaatctgaactagtttgtaagataaagtcctgctgagaggcaaggaaacagatgaattgacttcacagacttagcaatgtggggccttgagggctgagctgtttagtccagttccctaaactgtttcttggaaagagtgaatttgcacactaatgggagtgctggaacctgagctgaggatctcagaaggtcggggggtggtgggggcagttggcacactgcagggatttttttcctttgctaggcagaagatccagggaaggagaaccttgactgaggaacccgggagggtcctggagttggggaagtttgccccctggactggggatttaacataagatcaacagtaaaccttattgtgggatttgatgctactgccaccaagcaagagtgaaagaggaagaattagagagacagggccctggagagtgggctatttctgcctcttgtcccctccgtctgccccaggaacctggattgcagagactgtggtactggggaccatggggtctctttgggagaaagtttttgctttgtggaccag

SEQ ID NO: 396792 - DNA, 648 bp, Homo sapiens
taaatatttaaaacatcaagttaacattcctctcaatcatataataaagcatctacaagtttattaaaaacaagtctcaatacatttaaaaggatttaaatcacagaaagtatgttttctgaaccacaatggaattaaatcagaaatcaataatagaaaaaaagataaaatttgcaaatatttagaaactaagtagcatgcttctagataacctgtagatttaaaaaaaaatctaaaagaaaattagaaactattttaagctgaataaaagtgaaaaaacatacataaaagttgtgggataacactgaagccatagcagaaagaaaatttctagcactaaacatctttattagaaaagaagaaagatcttaaaatcaatgacttcaactgcaaccttaagaaattagaaaagaagagaaaattcagcctagagtaagtaagaaaaagaaaataagagtaaggaagaaaccaataagatagaaaacagaaaatctaagaaacccaaaatgaacaagattaataaaattaataaacctctagctctgctaatcaggaagaacagagaagacacaaattactaatatagggcataaaagaggtgacatgactccagattctatagatactaaaaggataatatgggaacat

SEQ ID NO: 396793 - DNA, 568 bp, Homo sapiens
cttccaaatggaatccatactctttgagactgccttggtttttgtttcgttaatggctctcttggaagtctagcagccccattaaaaaaaaaaagtgagtttctcatcctggaccaaagaccaggaggaagtcagtttccatttggaatactgaaggaacagctactgtctgaatcctcattgcagccataccagttgcttgtctttgcctgcatgtcaaccatcaaatgatgaaccagcctagcctcttaaggcacagacacatctaaccttagctaataggagatatcccaagaaatgcaagtaaacaatgcttgggcaaaccaatgcacatttccagtgaaacagaaagaaggggccatctgtaccagaggttgcatttgatgctctggaaactcaccacctgcttgagaaacatgttttctatagccaagagcatattattctgatcttgaactctgttcaacagccaagcctgtgcttgtgtctgaccaaaaggtcaaggatgagcccctcatttggccacttctggagcccccaccctctgtcaccacctccccaggcccca

SEQ ID NO: 396794 - DNA, 335 bp, Homo sapiens
taggcactaaatccctaatgagcttccctggtggacagcatttcatgtatgttgtccaaagttgttgctgagggaattaagcacagcccatatgattccacagggaaaggactcctagaaactttcatacttgtttttcactggacattgccgcatatgccttttccctttacttatatgctttgcatccttttactgtaatatatgatagccatgaataagactatgagtcctcctagcaaatcatcaaaccagaagattcatatggtttttatatcaatgaatttcctaatattgtatcaatatcatattcccagaataaatcacacttgatc

SEQ ID NO: 396795 - DNA, 397 bp, Homo sapiens
ttcaccatgttggccaagatggtctctatctcttgacctcgtgatccacccacctcggcctcctgaattgctgggattacaggcgtaagccactgcgcccagccgacctggctaatttttaaaagaaatttttgtagagacggggtatcactatgttgcccaggctggtctcgaactcctgggctcaagcagtcctcccacctcagcctcccaaaattctgggattacaggtgtgacccgtcacacccagccagtctagctctgactgtatctatctttttttttaaatttgtactgttcattgcagagcagggctaccccataggccagtgtgcccagagtagccgctgtcactatatgtaaatcatgtataggtttatgtgcataagtatattga

SEQ ID NO: 396796 - DNA, 906 bp, Homo sapiens
  misc_feature (17)..(17): n is a, c, g, or t
ggagctcggtacccgtnctccccgtagggggaagtctctgaactcatcaggtattagttaaggcaaaccacacaaaaattgaaagacaagttagaagtgaagtgggagaaatacgactaactgctgcatttctggaagaacctttggcagttatgtttttgtatttattgatttactttttgtatatttcaaataccaaagaaaacctgaagcagaatcatatctcattagaagccacatcttatttgtgattttgctgtgaaattgcagaaaacctatcagaaacaacaggcggcccttgggctactatgtgttggagagctccttggtttataaaagttttgaagaaatgttttggttttcttggaagtatggctttgcccgaagcagcgtttgtggttatgtcttcctgtgttataccatgaggttccacaacatcaggcttgattctccctgtaggtgcctatgtttttcatggaaagactttaattggtaattactaaatgagatcactcatggaccacccatgttctgaatctctttgaacaagtttaaggattcaaagattctacctgcagaaatatctttggtataggacaatgacagtatatacatatcaactgaggaggctgcactctacttccctccttcccctttccccgcctggtataagaaggcttgaaatagttttgtttttaatacatatttaatgattctcttatacttcattgctcatgcagagctttagtttaattcaagtgaaaggtggagtgaattccataggattgcctgcattctcctgtaccaggttattatattgaaaactctttgaaatacataaaatgatagccagagctgagatacctcttccctagagaacttttttttttttttttgcaatggaat

SEQ ID NO: 396797 - DNA, 268 bp, Homo sapiens
ggattttattccttctgctgtttgagggactttaaaggctaatgggcaaaaaggaaccggcaggtttagttcctgttatcatcctatatcttcctggaaaagggtagtacaaaatattctttcttctttctgtcagaagacttaactgcgaataagagaggttccatttggcctctgctttggtttggctgttcctaaacaggaatttgagcaaaaccactgagtcttctaggaggcccctcagcagctgaggttgtgcatgcaccac

SEQ ID NO: 396798 - DNA, 650 bp, Homo sapiens
aaaaactaaccccaaagccagcagaaaaaaaaaataactaaaatcagagctgaatggaatgaattgagaccccaaaatccatataaagaatcaacaaaaccaaaagttggttatttgaaaagataaacaagatcaacggaacactagctagattaacaaagaaaaagagagaagatccaaaaaatcacaataagaaatgacaaagttgacattacaaccaatcccattaaatataaaagatcctcagagactgttatgaacatttctatgctaagaactagaaaatacacaggaaatagataaattcctggaaacatacaatctcccgagattgaatcaggaagaaattgaaaccctgaacagaccaatatcatgttctgatattgaattagtaatataaaatctaccaacaaaaaagcccaggaccagatggattcacagccaaattctaacagacatacgaagatgagctggtacaatttctactgaaattattacaaaaaatcaagaaggaaggactcttccctaactctatctataaattcagcattaccctgatactaaaatctagtaaagacactggtgaaaaataaaaaaattctggtgaaaaatgaaaactacgggtcaatatttctgatgaaaatagatac

SEQ ID NO: 396799 - DNA, 392 bp, Homo sapiens
tgccgggtcaatctagaggaccccagcagttatacagactcacaaactgaactaaataagacaacagtgaacaatccttaagaaacagatatacatgacctttcaagaactcaaaatagctgttttggaagaaactcaaattcaagaaaacacagagaaaaaattcagaatactatcagataaatttaacagagattgaaataattaaaaagaatcaagcagaaattctggagttgaaaaatgtaactgaagtactgaagaatgcaacagaatcacattcattttaacttgtagcccattcattttaactgctacgtagaattctgatctgcgaataatccagttttatctactctttcccgatattcccttgagtctgtattaactgcttg

SEQ ID NO: 396800 - DNA, 205 bp, Homo sapiens
gtgccaaacagaaccagacaggacagaccccgcctcagggctcagtacacagctgctgcaccatctcctgtgggaagagggttgtcaaggcctgaagaaatgatgggaacagggtgatgggccaggggagacaccttataccaggagaaaagccttgtgcctctgtgcgaggctgggaaccttgctctggcctcgccacacactg

SEQ ID NO: 396801 - DNA, 410 bp, Homo sapiens
cagcttacctgggtctccagcttgcagttggcagattgtgagatttagcctccataattgcatgagccaacttcttaaaataaatttctctcagggcatctatatctatatctaatctgttggttctgtttctctggagaaccttgactaatacaaccatccttatgagatttttgaaaagatgtggagatgtggccgaaggtcactgaaggcttctgatctcccacatggtttctgtgtaggtggaataaaaagagatctagaagcttgggaaggtggtgaaagaggagttttggtgttgtattctcttcctgggaaatctgctctagccccgaggttatgagagaagttactgcctcagggtgatgacagcagcgaaggagtgaagcaggcccttccaatgtgatggc

SEQ ID NO: 396802 - DNA, 172 bp, Homo sapiens
caaagcatttcacatctatcgctgcattttatcctcatgccattttacagatgaggacactgggccagggacattagaggactgcctaaggccaggacaccacgcaatgccaaattcagacttcctaacacaatattcagcactctcttcattcttatgtttttctattaac

SEQ ID NO: 396803 - DNA, 472 bp, Homo sapiens
agtcttcttttccatgcactatttttttcttttgtaatagaatctttctctgcttctttaaatttgtatatccacatataacacttcggtaggtaggcaaagtaaagttccctactgtggtctcatggtaataatattgtaaaacaatacaaacaagaaatggttctaccgtttcttcaggtggaggtctgaaatttgcagtgctttactccagaaccataacttgataaaatgcagagctactagaggagcagatcatcttcctaaagtgccttgaaattcaagtcctttttaattgccgagaattcatgtcacttgtgtgacaaagctataaacatgcataatcataaaaacacattttgacatcctgaataaaatcaatgccatgttattgttaattttttaacaaacagatgagttttattaataattttaacagttcagcctatgtcttaatcaatgttttcctcct

SEQ ID NO: 396804 - DNA, 569 bp, Homo sapiens
ataatatgtgaacaaagcagaatatcaaagggttagaaactgtaaaaagaaaccaaaaagaaattgtggaactgaaaagtacagtaactgaaagtataataactagaggcatttaaaggaagattgagcagggagaaaaatagaattaatgaagacaggacaatggaaattatcatgtctgagtgacagaaataaaaaatactgaaaaaacattatcagagtctaagggacgtgttcaacaaatcaagatatgcattgggggagtcctgggagaagaagaaatagagaaaaaaagggcatatttggaaaaataatggttgaaaacttcccatatttgatgaaagacaaaaaaaaagcatccaagatcaacaaattctatgtaagatgaactcaaagagagtcacgttaaaacaaatcataatcaaagtttgaaaaaagacaaagagtgggccttgacggcagcaagggaaaagtaactttggtcaaggggtcctcaaataaattatcagcagatttattatcagaaactttggatactagaaggcagtgggttgatatattcaaagcac

SEQ ID NO: 396805 - DNA, 713 bp, Homo sapiens
gatattctttgcttaggatgattataacagcagttaaaggacaagttgcagttttagattcccgacattatgcctgaagtgttcttcagttaggttgacattgttttcaaagtgtgaggatatttgtcataatggactgtccaagtgttgatgtttgatgcaaattttaggtcacctttgtctctttttcctcattggaatatacttttgtttctggttaaggtgaagttaataattgaagagcactttttgatataaaatttgggaggtcttcatctcaatcaactaaagacattgtgcctctttgttttattaggtcctttaaaagacaaaatgaattaattttgagtgcatctctccctctcctgtgggatcttaattattaatatccagccatttattactttaaagaggtgttgcaatggaatatgttggaggtcagaaagactggatggggcttgttttgtagcatatattcactcattctgcattataaataatgaattctaaaagtttcaaaacattacacctccaatataatgttcctttaaagggaatcctaaatgaggagacataaacacgtagcagatgaatatttggtgaagtctcctcatactacagcaagacaaaatcacctgtagtcaaaatcccatattctcattccgttcattatattgtatctacactatcacctgttagatctagcagaattt

SEQ ID NO: 396806 - DNA, 483 bp, Homo sapiens
atgagtgtttacagaagctttgttgctagtggccccgaacagtgaaaaaaccacagtgtctgtcaataggagacagaataaatgaattgtggcggattaacaatggcgtgcttctcagaaatgaaaaagaacgaacgattgatacacgtgacaatataggtgaatcttcaaaacagcatgcggtgtgatgcggccagacataaaagagcatgtatcagaggattccgtgtatgggaaacgccagggaatcagatccatggttgtcagggtcaggagggaccttactggggtgattacatgtgtacatacattgtgtgaaactcatcaaaaccgtatacctaaagtgggcacattttattggatgtaagttatccctcaaattaaattaattttcaaagttttaaaaaatggaaccatttttgccacattgaaggaaaattatttccaccaagatttccctacagccaaacgatctaccaacta

SEQ ID NO: 396807 - DNA, 164 bp, Homo sapiens
tatgaagcaattgactctcatctagtaatatgttcagaccattttaaaataaatctttctatatagattttttttctttgaacactagagactattttataaatagacaactgctattgctgctggtagtagtttgctcctgatattctcctaatttcctttca

SEQ ID NO: 396808 - DNA, 337 bp, Homo sapiens
tcaagcaatcctcccacctcagccttctgagtgactgggaccacaggtgtgcaccaccatacctggctaatttttgtatttttgtagagatgaggtcttgccatgttgcccaggctggtcttgaacttctgagctcaagcgatccgcccacctagacttcccaaagtgctgggattacaggcgcgagccactttgcttgaccgggtcctttatatcttctggataagtgcctatttttaagcattgacagtaaagcgcttgctgggcagactggatgtgtgatgggaacttccctgagctgggggctccagctcttcaaggggggatccgggtggcc

SEQ ID NO: 396809 - DNA, 348 bp, Homo sapiens
atcacatttttccaacgctatagctaaaggatgaacactgatgcctccaatttcagtacctttgcggaaacatctaattagcaactaagcacttctgagcaggggcaagctcttgctgcttcgagcacacctgtgatgaatgtgtccagaaggaaggagtgagttttgctcagcacacgcttatcaagaacctgttgtgtgtcctgcatgtgcatggccaggaggaacatcctgaccaccaggtgctgaaattttgcaaaagaataagtgcaaataatggcaatacagcattaaaaacaccaaacggggccgggcgcggtggctcacgcctgtaatcccagcactttt

SEQ ID NO: 396810 - DNA, 488 bp, Homo sapiens
tatgagcctggtcccccccttctatatgcagacatcttactacaaaccctccagtgaatgtgtggcccaagggaatcaggagaaagagagacaaagagccactgagaggagatggaaaaaccaagaaagagaaaagaaaaatgagggagacccataaacagatggcaaagtggaggatgggtgagagatttgcagcgacagagtgaaagaagcagtcaagaaagtagcaggggcagaaaagcaattggcgaaatgtagagaaaagctcgatgtcccgagatgcaggacaacaagataaggagagggacagcaaagaaggagcctcctcagacagagagtgggggagaggagaaaggatttggccgagggcagacagagctgcgtggtgctgggacagctggaggggacagctggtgacaaggcgagcagagggagcaccacaacacagggaggcctgggatctgggagtgccagagagtggggataag

SEQ ID NO: 396811 - DNA, 1373 bp, Homo sapiens
caggaagagaggagggccaagggctgagtcctttttcaattaagaggaagggcctatctatttaagttctcattaattggtataagcaaaaagtaaacaataagggcaaggcactgctatagacttaaagctttagtttttcttcggtaatcaaagcatgcctaaaataaatatgccaacatacagttatatgaactgacatgtacaagctatgaatgagactatcttgccccagcgatctagggcaccctggctggtgaaagctgaaagccttcctctcaattgtgtgctattcaatggggttacaatgaaggtcctacagttaattaactataactccatcattcctggggaacaaatgcttgcctctctcaattcctcctgcttctttccctgtttagaatgtctgacttggggagctgtgcatttaatcactcccatctcttgaatacagcaaatacccagctctcctttaccttcactgagagcaatgcctgggattctgcacataccaactgcagggatctactgtaaagacacaggtcctagtgattttattacagaactgtgaaagagatgagattatactctgtttttttggtgtttgtattacctctgtttagcggaacactggcagcaaaaacaagtaaacaaaagcaaacctatagctttcattgtataggataaggaaattgtacaaaaagaactcaaaatattacttactaaaatggcattcaaaatccagcctccagtgacttactgctgttgaataaaggtgacaatctttggtgaaatctaaagagctattgtgcatagtgctagaagttataaccacctgcagacatttctgccgtttcattcgggcagctcagattgggaattggtgatgatggagaaagagctcttgggtcaaattactacactttggattttgatagtttaaggattttagtagccttaagagttctagacagacaagacagttatggataaacccctttggatcccatttctgaaagattcactcccttactgaaacacctgaccaagaattaagttagtcagccctgggtgtctgcaggttccacatgctcagattcaactgactgtagattgaaaatattcagaaacagcaacaacaacagcacaataaaaatacaagtaaaggacaggcacagtgactcatgcctgtaattccagtgctttgggaggctgaggtaggatgatcgtttgaagctaggagtttgagaccagtctgtgcaacatagcaagacctggtctctacaaaaaaatttaaaaatgagccgagtgggtggcacatgcctatagtcctaggcatgtgcccatatactcgttggcggggggaaggggca

SEQ ID NO: 396812 - DNA, 333 bp, Homo sapiens
tgctgagtgtttattacgtgctaggcactgttctaagcgttttgcagtcactaggtcactcctccaaaatggcctacagatgcaaacttcccctaatgctatccccatttaacacatgaggcagagggagagagcagcctcattcagatgagaagctttgaagaaaagagactgagtgcttcctgttccaccgtttctgtaaggggccctctcgaaactccccacgggattgttgtaaagattctcatttccttcagaggctggtgaaggcgtgtgctatcatgatgtggacctaaaaaggaagcagcatctctcgttttataggcacaggcc

SEQ ID NO: 396813 - DNA, 585 bp, Homo sapiens
tctcccttccctgtccatggcttagaaggctttgcatcttgaacatcctggatgcagagcggtcacaggccatccccacagataggttcctacagatggggtgtgtgaccatgttctctcctcctccacacccctctggggcttacagctaccaaagcccaaaatccttcagggctcaggcctcagggctaaacagtgattcacagactttcacacttccccacacacccccgcgcatgccaactttttgtttcggtaaataaagacattcaaaagtaatgaccatctactctggccctcatttcataaaagcaaggctactttatcaccaatgtcagatgaacaatctcagaataaggctaagttctaaaattaaaatacattttatttcatgacaaactccctctacattttcctcactattctgtagacaggcactggggagcctcccacacagctagggcccctggagcacaggctgcaaagaccccaggaggtcccagaatctacctgccttaggcccagagaggggtggacgttgcccaggaccatgccgctggaacaggaaaaaggttttccagtttt

SEQ ID NO: 396814 - DNA, 597 bp, Homo sapiens
aaaatttttttatctttttctaataatatacttgttacagtttttaaagaattatatacaaccatcaaagatattattttctttttattttgctcaattcccccgaggatcagaaatgaaagctccgaaacccctcaattgagccctaatcttagaaaatatcacttcaacatacacctgcaaataaactagaaaatctagaagaaatggataaattcctcaacacatacaccctcccaagatgaaaccaggaagaagttgaatccctgaatagaccaataacaggctctgaaattgaggcaataattaatagcttaccaaccaaaaaaagtccaggaccagatggatgcacagccgaattctaccagaggtacaaggaggagctggtaccattccttctgaaactattccaatcaatagaaaaagagggaatcctccctaactcattttatgaggccagcatcatcctgatatcaaagcctggcagagacacgacaaaaaaagagaattttagaccaatatccctgatgaacatagatgcaaaattcctcaacaaaatactggcaagctgaatccagcagcacatcaaaaagctta

SEQ ID NO: 396815 - DNA, 227 bp, Homo sapiens
gcagttttaggtttacagcgaaaatgtgtagaaagtatatatactcctccttcccaccctgatatatgcagttttccctactattaacctcttgcattaatgtggtatattttgaaaattcgtgtacgactatggatatatgattaacttaagtccattgtttacattaggattaactgtgttgcacatgctacgggttttgacaaatgcataatgtcatgtagcta

SEQ ID NO: 396816 - DNA, 549 bp, Homo sapiens
agctcttcatagctttcaagcttctttatttaaatcttcttcattcagaggtagctttaaaaaagtagtgtaattgaactttgtgtactgaattttcattcaaaacattttgccaaagatgctgaaaatgaagaggtgttgaaaagatatatactataatttaatccagatgtaaatttaggtagcagtttcaaataacttgcctattcctgagtaactgactcaatttaatcttttcaagtacaatagtcaggcctgttttttaatgcacaggtttcagatttcagttctcaaaaagataaaatggatgttgtatgtccgaatacctcttccccttcgagagatgaaagctgtgtgttctccatatatgtgcccgagcttcagttttccttactatttaaattatgtaaaaaagcatgctttgttgacagatttttaaatgacatattttttattaaaatgtacactctagctacacattcaagtatcaaatacagatcaatgaccactttcgtccaccttattttgaatgacttagatattacgctt

SEQ ID NO: 396817 - DNA, 591 bp, Homo sapiens
tgatacattgtaacacatgcccaagtatctccaaaactgacttcatcttttgtgaaagtgatgccaactgaacataccaggaagtcttaggcatttgtatcaaactgcctaagaacccagctgttagcttataagtcagtgaaattatattttatcatttattatcattgatagaacacagactaaaaggaaatacatctgaagtccatttctttaattcatcattatcttcagtggaaaaagatatgaggaacaacatcactcattggaaatgaactgtctttgtcatttcatttgtggtagttgtcctttcttcaaaaagctatttcttgaagaaaaggaaagttagtgaaatttgttttctcattatactttatccaaatttgaagtttcctaataaaagtagataattgccttttggcaagtttcctctttattacaagttcatgtaggtgtttgagtttgtttttcttatttataagaggcagaagatgatacctattttcacagttacttactaacttactgctttagtttgaaagaaactgacaatgtttcttctgaaactttttaacaatacaattaattagc

SEQ ID NO: 396818 - DNA, 596 bp, Homo sapiens
ggggccaggagttcctgaaccttgcttaccatcaggattgcctgggggttttcataaataccgagcacagagcacaattccatatctgctgaatctcacccttcagggagtggagctgggaattctctctctctctctctctctctctctctctgatatttctgacaaccatcagatgtgagaacagttgccataggcagtgagggtgccctaaacggttttaagcatgtggatgatatggcccgatttgcagaattaattggtggagtgggggtgagcatagaacaggaagactgggaaaaaccagtatgggtctgaaccaaggtagggacagtggggaaggattctggagcaatttaagaggtaggtcttcacagggctggatggggcttagcaactgattgacgtggagaggggagggaagaggttgggtgatgagtggatagaaggataattcatgacccagtataggggacagaaacagaagagtgggtttgcatggaagacagtgagttcagtttggaatttattgagcacttactatgtatagtccaagaactgctctaagcatttatgcgcatcacacctcatttatt

SEQ ID NO: 396819 - DNA, 386 bp, Homo sapiens
gagctcggtactcgagagatcatcgtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatgatctcct

SEQ ID NO: 396820 - DNA, 444 bp, Homo sapiens
ccatgccagcattctcaatggaggcaagaagggatcttatgggttttgcagcagggctgctttgggtatatgtttgtttgaacggggtagggacagtggatgaaggacccacctggagtttgctgccttgggaggggaggtgatgagctttaaacataatagaggctgggcgcggtggctcatgcctataatcccagcactttgggaggatgaggtgggcggatcacctgaggtcgggagtttgagaccagcctggccaacatggtaaaacccatctctactaaaaatacaaaaattagccaggcatggtggcacacacctgtagtcccagctactgaggaggctgattcacaagaatcgcttgaacccgggaggcagaggttgcagcgagccgagatcttaccactgcactccagcctgggtgacagagtgagacttcgtctt

SEQ ID NO: 396821 - DNA, 278 bp, Homo sapiens
actggatcacgaaaccagacgtcccgtttaacagctctaataaaatatgtcatcttcgtccttacaaaaatgatcaggctaagagataagatggttaatagtaacatctgaggttttttcagctcttatattcaacttatgctgtgactactacacaaagcagtctctttcttcatcatttgaattctactgctaagaccgtctagaaattcagagcatgtctgtgaatcccaggactgaagtgtgaatgaaaggtattcttattgatgcctgccatg

SEQ ID NO: 396822 - DNA, 383 bp, Homo sapiens
atttaatgttttctatggctgctttcaagccacagtggcagacatcatggtccacaaaacatgtaccatccagccctttacagcaaaggattactgatgcctgaaacagcctcgttttagtattacagtctaatttctgcaaagccgtgggcttcagctacagttgcttcacgtttttcctcagctgtgatataaaacaaagtttgagaaacatttcaagatgtgccaacaaaattgaatattaaaaacttggtgggatctggcaagatggccaaataggaacagctctggcctgcagctcccagcaagaccaatgtagaaggcagtgatttctgcatttccaactgaggtacccagttcatctcactgcgactggttaggca

SEQ ID NO: 396823 - DNA, 405 bp, Homo sapiens
atccccaccacaaccttgtgagatgcacatttaccaatcccattatacaggtgaggaaactgaggcttagagaggtgaaggagcctgcctaatcggaaagctggaacaggatcctggctcaggtctaactgacagcaaacactgtactcttcacctcactagtatgcccatctccatgttcttggtttcagataattaggtcaagaagtaattatttcataaaggccttaagctcagctgtaaactctgtaagtgggacattcaatgatagccccttctcttcttaccctacacgctatccctggtgagctcatcctctcttggggcctggggtatcatctgtgtttagatgacgctcatgtctttcttcaacttggatgtgaccttgggtcgaagtctagttca

SEQ ID NO: 396824 - DNA, 214 bp, Homo sapiens
tgacgggattacaggtgtgagccaccgcgcctagccctctggcctagactttctacccttgctactctcttctacctcctgacagtccccagtcctttcccacgtggccctgccttctgtttctagggattcgagtataaatttccttcataacaatcacttcttaatcacttgattaaaacaaattctgggtatattttaatatactttctaa

SEQ ID NO: 396825 - DNA, 495 bp, Homo sapiens
tggtcattagatagttaaaaagatttaaaattgctatatgtctagtttctaaaaattgctaaatgattttctaaggtaaacacctttccgtgtatccagtgcttaacagaattaatgttatgtgagttttcaaaaaaaagaaaggaaaaaaaggaaatctcttttttgtctcagccgacagcaagcagtgctgctccggaaagaaatgattttatttctagcctctctgcagcatctccctaccgcattagtatgttgctgcaaagctatccattgtgtaactttccccatcagtcagtcagctgtgtagttctctttcctatgaaatcgttatgccacaggagacaaaaataaaaatacaatgcaggttagttcattatatcctgacatctgtttcatgcagattgtgatgcaataaaatattagtaatttaaacagaatgtaattgtggtttgaaatcacttgggtaaatcgtgttattttaaaacaaatctt

SEQ ID NO: 396826 - DNA, 193 bp, Homo sapiens
ttatagttaacattattacctgaatgattagaaagattgttgaagtttccaaattctacttggcaaagagatgcataaggactcttttcattatgagtctgttcatgtctttttaagtgagctgactgtctaaaagatttcccacaaatattacagccaaagggcctctgtccagtatgaattaaatagtgtc

SEQ ID NO: 396827 - DNA, 469 bp, Homo sapiens
ggtggcctaaatatcccattttactgggaaagctgtggtgtagatgaagtggtgacagatggttactaggaattatgttatttcatttgattatcatggtaatcctgtgagacaggaagaggaaactaaagctcagaaaaagcaagtgatgaagtgatgaagctgggctttgaacccagatttgtcttactccaaagtttgtgctcagttcattatattataatatggcctcttatgaaggtaatggcactttcacaaagagtatagggaaaggtctctacttcaagtcatctttttttttgggagacaaggtcacactctgttgcccaggctgagtgcaatggtgtgatcttggctcactgcagcctcaacctcccaggttcaagtgatcctcccacttcagcctcctgaacatctaggactacaggtatgcaccaccacacccagctaatttttttttttttttttt

SEQ ID NO: 396828 - DNA, 719 bp, Homo sapiens
agtagagatggggtttctccatgttggtcaggctggtctcgaactcccaacctcaggtgatccgcccgccttggcctcccaaagtgctgggattacaggcgtgagccaccgtgcctggcctgtaaggtcttttaatgaatctattgtcatttggattatttaatagtcttaattgcacaaaactgtctattttaactaccataataacagtcagactaaaatgtttttcaggtgacatgtgaaatatcaaaaagactaatgattctctgcatttctaagacatatgattagaaatagcagcgtacggcatctgattctatctaaagatgttggtgaagactgcttagcttaaagttgtactcatagaattgattgtatttgtatttgccaatgaatgctactattccactaaactaggaaataaataactgtcattcagcctttcccacaaggttaatccatttccaccaacctctcctcatatcccttgcattctggtaatctgaaaatggcctgtaaatgcttactatggctagacttatggagaaaagaggtgttaagtacatttctaccgagacttcaaagtcatggatttagcagatgttgactgtaaccaagttttaaaaaaaactaatttatttgggccatgcacggtggctccagcctgtaatctcagcactttgggaggctgaggtagggggatgacttgaggccaggag

SEQ ID NO: 396829 - DNA, 719 bp, Homo sapiens
tctgctttcgttccttcatgctttccttgcttgtgtgttcatttgtccaaatcttgttcaagacgccaagaacctggacaccctccaccggtaacatattttggcgagccagacaagaggtaagcccagagttgggatttatttttcaccttttcctttctgctccatacagtggaatctctctctctctctcttttcatttccaactcaggacccttggtgggcagtgcctaaacagagacaactacaggtttctggctgtggccactctctggtgaaactaaggggtttctgtgtggaggtgcctaacagccaccgtccagtttgggtaagggacctggatttttttccctttatttcttttttctctctttctttttcaggcttttgatggctgcttcctagtattaaatagctccttagtaactgagcgcaactgtccagggccactctctggtttacctgaagggcaaggagtaaagggggatagctaccatgcctggaagggggaaggatttttctgtcttttccagttgttgtccctgatccctacatgtgggacagcttttccagggtgaactcgcatgcatttcaggtgacttaaacattcttttcctatgctaaattcttcccttcccctactctactggctagggacgaaagaaacccacccatcctccagttcctgtcattacagttcatggctatcactctagtgc

SEQ ID NO: 396830 - DNA, 270 bp, Homo sapiens
caggggagatactttttccaagcatgtagtagtgaatgccttgcacttggtagtcatgtgatatgagttgcttattggaaatgggtacaagaaggccaagtgaaatttcctggattgctggccgtctttatataccctgggctatgctgatgttattgacatatatacagagtcggactggatcttcagatgtggctatgtcagttttcatgacctttgcctgttagatggggcttcttaagaaatgtcactgattgtgaagatacactg

SEQ ID NO: 396831 - DNA, 935 bp, Homo sapiens
gttttgcttgttgcccaggctggagtgcaatggtgcagtctcagctcactgccacctctgcctcctgggttcaggcaattctcctgcttcagcctcccaagtagctgggtttacaggcacctgccaccacacccagctaactttttgtatttttagtagaaacggggtttcaccatgttggtcaggctggtctcgaactcgtgacctcaggtgatccacccacctcagcctcccaaactgctgggattacaggcatgagccaccatctcacttttaatcctccagtaggagaaatgaagttgtaaggggaaatgatagtgttagactaggcagaaggaatgattcatatatttttgtgcatacacattttaaatcctgattcccatgatcaggtgggaaggtaccattttcaattcctactggaagggaggggttcttaatatggtcagaatcctttgttgaaatgaccttggttaccttgggtatcttctatggtaggagtacaaagtagtatacatgggattaaattttaaaacaattaggccctcagacatacataaaaataactatctcatttactcctttcctcacctatttaaataaataagaaatacagttttggagaggggttttaagtagttgtatatgttgatactgaaggattaatgtttaatacctttggtataatgtttttaacttggtatttcagttgttgagtataatactggataaacacttaacattctgagtttataatgttataaacattacatacatgtttaatgctaaaaagtgtagaagatctgaatgcaattttttagtaatgattaattatgaacatagaaattctgtaactttctcacatatcaaggtgtacagctgcctttttttcaccaaaatataaatttttaccctattttgatttcagacatttg

SEQ ID NO: 396832 - DNA, 499 bp, Homo sapiens
aacctccaaaatgctgcttagatgctatgattagatttgatggaacaaacttattcctaacctaatgtgtgagcttataaaaagtaatgaaagaatgaaagcacctcatcgatcaatattggtctttcacccacaaagaaatatattaaagcttacttttcctcaagctacaaagcaagctaccattgaggaaaactgaatatacagtctttgaacttgacatgatttacattcagtgcataaaacagaaaatagtgggcattatattaaagctttatcatgtttctattaggaagaccaacagacatggaaaccagatgccttcaaaaaacaaaacaaaactctaaagtgattccatcaacagaaaaatggccctgtctccttccctcaagcctgcttttctatttcagaatcatttgctcaaatattcttgcccttgcccattatcaagcaataagctatctttgagtctggtttttggtccataccaccaatccag

SEQ ID NO: 396833 - DNA, 649 bp, Homo sapiens
tttttgtgcggcccatgagctaagaatggctttcacatgtttaaatggttgaaaaacatcaaaagtagaataatattttgtgacacatgaaaagtatgtgatatgcaaatttcaatgtccataaataaagttttataggaacatagcggggaaaaggcttttattcttttagtgtagccttttatgtttgaagagcaaattatattgccttgcaagaaattcaaaggtcagtacccaggtgctagcctctgtacctatctgaacttgctcctcttttttttttttttttccttttccagcctctcttctcatcatataaaccctcttgtctgtcacctggcagtacaattaaactcatggatgattcccttttgtagctgaagtttgagaggcaaaagttagctggttaatagaaaggaagtgagaatacatgttttttctagacaaccaaaatatccctttgcctactgtttattaaaaacaaataaaatcaaaagcttgttccatcaccactaagcaatgcttgtctctattttgtaggcctttactatgatgatcttcagtaatgttaatatattaagtgagtttggccaattcttgatcttttatcataatggagaaattatgataccccgaagggtatcgtctc

SEQ ID NO: 396834 - DNA, 406 bp, Homo sapiens
tcctttctatacttaacaaattcaggtttcaaataaattttacttatacacctgaggtaaagtcttaaaagatcttccaagtcatattacacttatctgcagcggtgcgaccttggctcaatgcaacctctgcctaccaggtgcaaatgattctcctgtctcagcctctggagtaactgggattacaggcatgtgcctctgcctcctggattcaagcgattctcctgcctcattctcctgagcagctgggattacaggtgtccaccatcacgcctggctaatttttgtagttttagtagagacgaggttttgccatgttggtcaggctggtctcgaactcccgacctcaagtgatccacccacctcagtctcccaaagacctattattcttacaataccacaggca

SEQ ID NO: 396835 - DNA, 545 bp, Homo sapiens
catatgtatctcctatgtactatgaaagtactagtttttcctctatcaaatacaacttgcctagaaatgtcattaaataaacaatcctatgattaaacaagtcagtattattttatctctgattctgtgctaatatatatatggttagaaaaacaaaatgcaatgattcttctctagattatttttatgtgagtttagtagtcttaatgtcattgtatgtgaattttttatgtaaacatcattcattattatttttattttcttgtgtttttggattatattttcccaagttttcatattatgatttcatcaggtaatcccagaaaaagaaaatattttggcttcctacagacacagagcacctcattactcagcatacaaaatagtgttctacaatgtgtttccacagaagaagcttctcatgttaattttttttggggggaggaggttgagatctcactctgtcacctaggctggagtgcagtggcgtgatctcggctcactgcaacctccgcctccagggctcaagcaatcctcccacctca

SEQ ID NO: 396836 - DNA, 409 bp, Homo sapiens
acaagttatctgttaattaccactgagtcataaagactctgggtctatctccagctcaagaataaaactgacaccaaggagggaacttatactttagctgtctgttagttaatctgaaatcatctctgggaagcaatatattttctaagattcacttttctaataatgttcattataggtacccaaaggggtagggaataaaagttaagagcactgagcatttggattcagattctgtcttgttatcttaagctaaatctatttattacaattaacctcctttcagttactgagtactagcgagtgacatgaactagtgactactctgtatatattatctcaattctccaaacaatgcaattagtactagggtacaattaaatagtaccataaaatatgccattaactc

SEQ ID NO: 396837 - DNA, 286 bp, Homo sapiens
ctcccaaagtgctgggattacaggcgtgagccacagcgcctgggccttattttttttgttttatagagatggggtctcactattttggccaggttggtcttgaactcctggccccaagcagtcctcctgccttggcctcccaaagtgttaggattacaggtgtcagccactatgcctggcctttattttcattttatattgcatacttgtgggtgtctggaaaatgccccttgttagttgcatgaagtgaaggagaataaaaggcacttggagcttaaaaaaactg

SEQ ID NO: 396838 - DNA, 447 bp, Homo sapiens
gcatatggtgaaaggagcctgaaggccggggtgaaggatgtaagtgaaagaacggcattgacaaagccccagccctgggcctagaccctgcagttgctaggttgctgtttgatgaattagtttgggccagaagaagacagatctagaaggtcagctttatgtcatcatttctccatcaacagacatttacagtctatgcatcaggtcccagccctgaacgtggaatcaaaagaggaaagggctgtccctgatttgacagaatgtccagttagttggagaagacaatgagtacacagttggtcacaactctggtgacagtaaaccaactgggctgtaggaacataggacccagtccagcttagaggaagaaggtctaaacgagctggattacccaataggcagactacactgaggttaccagcaagataagggctaccaaactaagaa

SEQ ID NO: 396839 - DNA, 1156 bp, Homo sapiens
tggtcatgttgaattgcccaccttttaataacttatgtcaggttggacttcagtatttatggtcataacagaaatgtttcttccagttatgaagtgatttgttttttcattaatagacatctgagtgcctactatgtggggggaaaaaagggctctcctgacagttgtttttttgttgttgttgtttgtttgtttgtttgttttccaataatttcagttgaagtatcaggaactacctgggattctgtcctcagggataattctttctgttgaaagtctccaagagtgtggtgatctaattattgatcaaagttcataatatggtttctgccctcctgaaacatatggcctacaaattatctatttttatgtttagtactttaaaaatgatatattaaaaaattaaactagagtgatgatacaactatctgatctttgacaaacctgagaaaaacaagcaatggggaaaggattccctgtttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatttctaaaacaccaaaagcaatagcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaatcaaacaaccccatcaaaaagtgggtgaaggacatgaacagacacttctcaaaagaagacatttatgcagccaacaaacacatgaaaaaatgctcatcatcactggccatcagagaaatgcaaatcaaaaccacaatgagataccatctcacaccagttagaatggcgatcattaaaaagtcagggagcaacaggtgctggagaggatgtggagaaataggaacgcttttacactgttggtgggactgtaaactagttcaaccattgtggaagtcagtg

SEQ ID NO: 396840 - DNA, 359 bp, Homo sapiens
aatgccattggtgtggacattctggctcctgatctccgaggtttttcagaatgcaggacaaggatgtgttcttgcctttcacttccccttggccacaacatgcagtagtaacctctttaattaagagcgtttttgtttgcttgttttcccctgcatggaacatcagaaacttttggtttatcaaggcaagcttttcatgcagcatttagcctttttgtcccagagcatctgaaaactgaatattgtatatgtagttggatgactatttcatcaagacaagaaaccaccaatacatttacctgagatcatgctactgtactccagcatgggagacagaacaagacactttctccaaaaaa

SEQ ID NO: 396841 - DNA, 295 bp, Homo sapiens
tctgagcaaactatcgcaaggaccagaaaaccaaacactgcatgttctcactcataggtgggaattgaacaatgagaacacttggacacagggtgggggacatcacacacctgtacatttttaatacaatcatgtgttgtttaactacagggatacatctgagaagtgcactgttagagaattttgttgttgtgggagcatcatagagtacttacacaaagctagatggcatagcctactacatacctaggctatatggtatatcctgctgcttctaggctacaaacctggacag

SEQ ID NO: 396842 - DNA, 420 bp, Homo sapiens
aaatgttaaaacctacctatttgagaggcctgtaataaaagcagaaaacttccagtaatagctaacaggctgcgatctaccacacaaatttatcataacagtgagacaagcagagtcatttaaattaaatggtttacacaggaaatgggcatactgtaaactagcttagacctttcctgagatcacctttgaaatgttagtaaaaatggccttggaaacacaggcttttcaatacacatatgattcctgtttcaactccagaaaattgctcaagtggcactaatagcaagtgcctagattagacaattcatttctcaagtttattttgatcaggaagtctagagctgaaatgagagtcctctaattttgaattaactcatttacatacataattgccatgctagactgagtagtcatact

SEQ ID NO: 396843 - DNA, 611 bp, Homo sapiens
acttatcacctgggaataaaaaaggcagttttacttctttccaatgcagatgacttttttgttttttttttcttgccatattggatggaagggaaccttaagtatagggcgagagtgaacatccttgtcttgttcctgtttttgagggaaagtatacagtctttcattattatgtaaatattagctgtaggttttttgtagataccctttattggtttgaggaaattttctttggtttgctgtttttaccaggagtagatgttggattttgtcaaatgctttttgtgggtctgatcgagataatcacacaattttaatatagtgaattacatgacttgaattttcaaatattaaagtggtcttgtatttctgggttaaatcacattttggtcatgcaatattatttttttaaccctttttgcatttagaaaaaaagctgcagcttgctgccagttctcatgtaatttcacataaacacactctttgaggctgaagcaaatctgattttcagtgtgaaaataaaatataaaaactgttcttggagttatttctaaacagaactaacatcagaatcatctgactcatcagaatcatctgttttggaaaattca

SEQ ID NO: 396844 - DNA, 226 bp, Homo sapiens
ggagtgtagggtgctgcatggactcaggtgctgaggtcatagtggtaccactgaaactagctggggtcatgatcctgcagccttctgtgtgggcatggtgggatgatggcagatggcacccctaggatgtggaggtgtctgggctattggcctccaggtcagaatgcacaccagcagtggttccattaccaaaatggtgtcatactgtaacagcttgggtctcatg

SEQ ID NO: 396845 - DNA, 447 bp, Homo sapiens
tgctttacttgacgcttttgggaatctaggaaagttcatcattctgccatacccaagataatggccctcattttcctaggccagggtgggtggctacatctctaactgtcacatctgtattctgctggaggaaagacaaagaaaaagggagcaaaaggcaagtgccaagtggtcttaaagatggtttttggaacctgccgtaggacacttctacttacgtcctattgaccagaacctagtcatgtcatatctagctgcgagggaggctgggaaattttctatttcagactgccatgttctgctgaaatttggtattctcttggaggaaagagaatggatattaggagaatgaatagcagtctctgccacatcattttttatcattatatgcaaataatgtgaaaattagttctcgatgcattgatgacttctgagtgttaggaatca

SEQ ID NO: 396846 - DNA, 210 bp, Homo sapiens
cgcctgtagtcccagctactcgggaagctgaggcaggagaattgcttgaacctgggaggcggaggttgtagtgagccgagattgcgccactgcgctccagcctggtgacagagcgagactccgtctaaaaaataaaaaataaaaataaataaataaataaatagttttctttttggccggttgcggtggctgatgcctgcaatcccatcc

SEQ ID NO: 396847 - DNA, 183 bp, Homo sapiens
gtggtctggccagttttagttcaagaagttttctctgacccagctgaagacaggatcttagaaggacaatgaaaacaggctcagggctcagcctctatggggacacggggacatggagacaccctgttcttgcccatgttaaaggtttctttcttttgctaagccagaaactgcaaagaaaag

SEQ ID NO: 396848 - DNA, 184 bp, Homo sapiens
gagaggtctgtcccagaagacccagtgcggtttcaatggtcattcccttccaatccggtcaccatgaaccccagagctcctccagcagctgggagatgctcagccatgggtcgggtgtggtccaaggcagggctggcttccaaaatagtcaacagctcttaggaaagttccaaaccaaacaaag

SEQ ID NO: 396849 - DNA, 388 bp, Homo sapiens
tacatcagctaacagaacaaaaagttttacagtgctttctcatacaatgtctggaatttacagataacaccaatagttttggtcaggggttaataatattattattatcttagccaccagggccaggtggtggtgccaaggtcgtctagctatttatcttacttctgtttctttccaactttttgctttctcccttttctcctgtcttataaactagggaaaaggggaggttggggagaaactgagaaggacaacaggagaagtggtgacctcataccataatcctagcattttgggaggccgaggtgagagaatcgcttgaggccaagagttccctaccagtcctggtaacatagtgagaccctatttctaaaaaaaaaataaaaat

SEQ ID NO: 396850 - DNA, 161 bp, Homo sapiens
gtgacctataggctgggaccacagcaaagccgaaaggcaggaggcgagcccgtccagagagtggccaggagggacgtccaaaagcgggaactgacagggggaccacaggactctattatgtcctatcattatttatttatttatttatttattttatttat

SEQ ID NO: 396851 - DNA, 445 bp, Homo sapiens
cttttgggtctttgctcttttggggttttgttgtcttaaaagattttattaaaggtctttacaaggcaacatccagactccagatccagctgccaaggagaccctattacacagttggggctgggtagagcatggcttcctaaccatctgtcctgagatgggcatggcgaatagtatctcatctttagggtctacagtgctcacgtggtcaggcaggggattcttaaggccaatcttaccacttgggcccaggacgcatgagcttcactttgatgcccagcacaccctgtcttagcagcacatggtggatggcagtatcaatgcagtagttaacaaggtctctgctgtggatcatcagatcacacacaaaagttcatgaattcagttctctgtccttagagtttcgctgacaccatgacctcgtagctcttgccccactctccat

SEQ ID NO: 396852 - DNA, 660 bp, Homo sapiens
aagagacatagattggcgaccatttcaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaat

SEQ ID NO: 396853 - DNA, 400 bp, Homo sapiens
taccatttgcacgtggaacttcagcaatgtaatgtccaggcaaatgagtatgtgtgcattatgtgtactctcccacacaaaatctgattctacttgggctaattcactaaattcttgtttacacatgaagctgtttattttgctttgaatgggaagctgttttggagtcatgtgaagaaggatagaaaactactgagaaatgtagctcaaaaacctggaggatgctggtagcagatgagttgggagtggattgcatggtgacaaccagagagcgtaagtagtctcttattacgtacagtatttcattggttatatcttgcttctggattgttttggaatttttttagccttactattttattagactggcaggggaatcataaatggaggaaataaataa

SEQ ID NO: 396854 - DNA, 455 bp, Homo sapiens
ctgtgatgtacccattcagtggtgtcctactcagcaataaagaggaacagatgctgacacacacgacgtggatgaatctcagaacacgcaacgctgagtaaaaaaagacacaggaatacatactgggtgatgccaatcacatgaagttcaaggacatggaaagtaacttatggtcgcagaaaccaggaagcggtggctctcagggctgaggactgactgggcagggccccaggatctttctggagtgatggaaagtttctctgtctttggggagccggtgactcaggggtgcccatttggcggagctcatggaaccgcacatgtgagatctgcgtctttcatggtaggtaaatttgcctcaactgaaaagctaatgctagtttcaaatttcaaggaaaaacaagcaaataaacaacctgcaattttaaaaaacacatgttaaaaattttgaggaa

SEQ ID NO: 396855 - DNA, 894 bp, Homo sapiens
attctactttatggttagttgcataattatttcattatatattacaaatgtaataataatagaaataaagtgcacaataaatgtaatgtgcttgaatcatcctgaaaccggttcctggtgccaaaaaggttggggactgctggattaaaggacagagtcagctggacatcattgtaacatcattgcttggtgttttagtagcattaagacttaagttttgctttttaaatttacttctatatgttgctggagaggatttacttctgtctctggtgatattcagctaggttttttagaatggtctgtctgtgggacaagaaaaaaatctcagctaacaaaataggtagggatttctggatgtaaacctaggagaagttaggaaccacagaagtaagccttaaatgccttttccaatctgaaagaaatagctataaaaacaaaggttttggcaggcttatggggagacagagtcagagttcagggcctttcaaagatatgtggtctgataacctcccaaacctttgagcttgttctctaaaaagcttttatcatctgtgtaaagggaaaacagaaatacaccattctgtgagtagagttggagccagctttgcatcacctaggtaacccagtgggcactcaagccttgaacttgtgttaaggtcaagccagtttggtgttactcccaggtgtctggtataagcaagtgaacattgttttggagcaagatactaggcctcaaagtactcatatatatgtgtatgtctgttttaaaatacagtgtccagcacatagtcaaagatggttaggcacattaaaaaatagggctataaatgaaagaaaacctagcaaaataatagacaagagaagcagatacccaaatttcaggtatagaaa

SEQ ID NO: 396856 - DNA, 888 bp, Homo sapiens
atagcaggtacagtagagagtctgtaatatgaagttacatatggaattttaaaacatatactccaggcagaattcaacagtggaaaactgtctcccacaaaacggttcctggtgccaaaaaggttggggactgctggattaaaggacagagtcagctggacatcattgtaacatcattgcttggtgttttagtagcattaagacttaagttttgctttttaaatttacttctatatgttgctggagaggatttacttctgtctctggtgatattcagctaggttttttagaatggtctgtctgtgggacaagaaaaaaatctcagctaacaaaataggtagggatttctggatgtaaacctaggagaagttaggaaccacagaagtaagccttaaatgccttttccaatctgaaagaaatagctataaaaacaaaggttttggcaggcttatggggagacagagtcagagttcagggcctttcaaagatatgtggtctgataacctcccaaacctttgagcttgttctctaaaaagcttttatcatctgtgtaaagggaaaacagaaatacaccattctgtgagtagagttggagccagctttgcatcacctaggtaacccagtgggcactcaagccttgaacttgtgttaaggtcaagccagtttggtgttactcccaggtgtctggtataagcaagtgaacattgttttggagcaagatactaggcctcaaagtactcatatatatgtgtatgtctgttttaaaatacagtgtccagcacatagtcaaagatggttaggcacattaaaaaatagggctataaatgaaagaaaacctagcaaaataatagacaagagaagcagatacccaaatttcaggtatagaaa

SEQ ID NO: 396857 - DNA, 221 bp, Homo sapiens
aagactttaaaatcacattgtttctattttaaaacttagaccatcaaaatttttctctctggctaggtttttaaaatattttatatttaaaagttgatttttttccacgattatgaataggttcctgctaagttttagaagacgagagcctacatttttctggtgaaagtgtttaaactttgagaaatttgttttatgttctaaccagatgttctggataa

SEQ ID NO: 396858 - DNA, 463 bp, Homo sapiens
gcggccgctgggggcgcccccgacccccgaggcgctgaggcggcggttcctcgagcctcgcctctcccgactcccagacgggcggcagcggcggcggaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccaggtaactcgcctcccgcgccgcctcgcccctttctgcttggccagggcttgttggatgggcagcatctctccttggcccatttgctcgcctttccctagggaccgctctaaaatcagtcgaatttattgatctgcaaagtgctttgcaaatgggttcttctcagctggccttggttcct

SEQ ID NO: 396859 - DNA, 296 bp, Homo sapiens
ccatgcggacccagcggccagcgccgcgccttgggagttccctccgcgaagggggtgatcaaggtgcggcggcgccccaggggcgagtggggaggggactgtgtcggcctctgcgtcactctgcgggcgcacagagggctggcgaaccgctagtggacacccggcaaagccgcttctcagctggctcgctcctccagccccttccccagaggccaaggagacgtctcctcggctccctagcgttcgccctctttgttaacggtgtttctggggttcaggctccttcccagttcgta

SEQ ID NO: 396860 - DNA, 115 bp, Homo sapiens
tctctttacgatttgcaaacgtctctccgtgtcttttgcccacttgcctactggaatccaactttgttccttttttatgtggtttacatgataagattattgacgctatttctgt

SEQ ID NO: 396861 - DNA, 422 bp, Homo sapiens
ttacaagctcagagaccttaaccctggaacaaacccctaatgagtcagatatatcaaaccccgggactgagccctctgaaaaggaacagagacttcacgcctgaaaatatatcccaaacaggtcaagggactttgaaaccaaaagagctcagggaccacgtatcctaggacaccagtggacaaacagctcagagacctcacaaggtaaacacagtccgcaaaacagcccagtgaactcacccccctggaatgtagaccagaaaaagcgcagaaccctcgcattcaggattcagaatccttctgagacttagggtatagaccccaaaatatatttcagagaattaatatgctggatgcagagtatcaactaattcagaggcctcaaattgtgggacgtacacacccaaagagatcagagaact

SEQ ID NO: 396862 - DNA, 251 bp, Homo sapiens
tatcaaggcaaaaaaagaaaagaaaaacagattaggtaaagttattctgtgaaataaccatctgattacagttacacgtatcatatcaacttaatacaaatcttacacaatgaatttgtgtcaaggtttcccaagaccaccccaggtttggtggttcattagaaggactcacaggactcaacaaatagtcatactcagatctttaattgataacaaggaaggggacaagcaaaattagtagaggaaaaagg

SEQ ID NO: 396863 - DNA, 442 bp, Homo sapiens
agtcatgtaccatacagttcagccttttaaaatatacaattcaatggttcttagtatatttacatagctgtgcaactgttgccacaatctacgtcagaaccttttcatcacccctaacagaaatcctgtaccttttagctctgcctggtttatcgccttgtccccgcagcccctggcagcctctcatctaccctctgcttctgtgggtttgccgattccgggcattttatgtaaatggaatcgtatgatatgtggtcttttgtgatcatctttttacacttagcatgatgtttttcatgtatattacggtcgggtgtggtggctcacacctgtaatcccagcgctttgggaggctgaggtgggcagattacttgagctcaggagttcgagaacagcctgggcaacgtggcaagaccctgtctcaattctttttaattgtaaa

SEQ ID NO: 396864 - DNA, 298 bp, Homo sapiens
gtgtgtttgttttgttggatggatcctgccgaggcactgagagacagactttgctgggccctgttttgtaaacaaatctgttcacgcacgctttcttctatcattggatgtgtacactggctctgattttcccacccgacacgccaaagcctaagcatttagaagcttgttttcttttagaagtaggcaggcaccaaagaaaaacctgcatatgcatttaaagtgtgcacatctaccctaagtaagtctttggatctttacagttttaactctgggccatgtacagtgtatttcagcc

SEQ ID NO: 396865 - DNA, 505 bp, Homo sapiens
atttgtgaacttaaactatcttgctcaaggtaataaaattattaacaaacatactcagaatttatttcatctgagaaaaatgagtttttaaaaaatttatttacacattcaaatcagtatggtcctctttaaaataagttactttggaaggctaccacttactcatttattcactccatccatccaaccatctgatgcactcaaccaacatttatgtagtgcctaactaactacatgtgaagctatcacccctgttcaaaatatttccaacttcctccttgggagtgttttcaaaatcagctaataagtcaaccaagaaaattattcccgtttctgtgattaactggatttaaggcaaaactatttttcattcactctatttgatattgactaaccttcagcatttctaaaaatcaaaatttcaaagtaaaaagatctgtcatcaataagaccattcagaataagattataccatgtattatttaaaagtgtgcctcttggccgg

SEQ ID NO: 396866 - DNA, 273 bp, Homo sapiens
aatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtct

SEQ ID NO: 396867 - DNA, 644 bp, Homo sapiens
attagtctgtttttctttttctttctccctggagccatttcagaaatggaagatttccttagatactaattttctcagcacgggttggaaaaacaagcaaacaagagggcctagattctaagtcacatcattgtctgagagaaaaaggacttcaaacttttttttctcagtaaaaaaaaaaaaaaaattccatcagaacagctgcttccatttcctttgaacttgtgatggtagaaacattttggtaactttgttagcaggcagtaggattggtagataaggctctttttagtcttcttctggctgtccctgcatctgaaccctctgttgaacttccgctgcactttattcttaccttttccctggttctaaggcaccagagaaacaaaagttgaaggtgagcaaggagcataaagtagaatttttaaaaagtatattctagagcaaagaaatccagggagagaccccagttcttgattctactcttcatcctgaggccatagcctccatttgtggttttcttctgttaccctttccaggttccccttgcatttaggcaacactttagccatcattttctgggtagggatcccaatcctcctccctgtcccgaatatggcagctcttttcctcccatatttagt

SEQ ID NO: 396868 - DNA, 265 bp, Homo sapiens
attttgtgtagtctcacagcctcctatcctgggctggagctttggtgatgtgcacacagcactctgatgccagagggcgcagcctgtgctagggtaggtcagcaggaaaaccagtgaaaagagggagggggcatttctcctgcctgcccttcctctgtaaaatcacaaggggtcactcttagaccagagatggcaggagcagcaactgcttccaaggcaatttccctctggcctgaggctatgctgctctcagatactttgtgtc

SEQ ID NO: 396869 - DNA, 487 bp, Homo sapiens
gatttcctgggctcaagcaatcctcccacctcagcctcctgagtggctgggactacaggcgcacaccactacgcctggctagttttattttttgtagaggtgaggtttcactgtattacccaggctggtcttgaactcctgggctcaagcaatccttccaccttggcctcccaaagtgttggaactgcaagtgtgagccaccattcctggtcattcactgagtatttattgagtccctactatttgcaaggcaccaaggagacaccatgactaaaacaggcaaagattcctgcctttatggagtttatatcctgtgtgtggagaaagaacagcaacacataggctagtaccatgtatcctggcacatagtgaaatgctctgccaaggtgccaagaagggagggaggctgcaagtgctggaggggcatcgaagaaggcctccctcatgagagattggaggtgagacctgaaggaggtgaggagagcta

SEQ ID NO: 396870 - DNA, 468 bp, Homo sapiens
gacccgggtgaaagttggacagcagagctgggccatccgtcacggagagaggggtttgtgttttacactagcgagcttgaatttcatccagagagagacatgatcagatttatcctttgcaaagattggctgctgtatgtggagggaactgcagcaggatcagcgtgattgtcagaaggctgaccattcggcgggcccaacccggtggtgcccttagtctctagaaacgtggagggactcatagaggggcatcagttatgccagcacctgtcccaagacactaaaatactgttgcactttaagattcttgaactatgtttcaagtgtaaatttcattctacatacatatccatctgtatgcagatctttaaaatgtatgcatatgtgaatcccatctgcttcaagagaatttggaaaatcctagctgaaaatacacattttaaagaataaaagaaatagaaatatcgc

SEQ ID NO: 396871 - DNA, 331 bp, Homo sapiens
tctcacagctcagccatcagccagcagtgcaacctggagaagttctttacttctctgagcctgtttatttgtttaaaatggggttgaaattatgcctcattagattgttgagaaaaataaatgacatatattaagtttcagaacagtgcctggatgtagtaagtgttcaataaatgatagctgatttaatttttgtaatgcaacttaattatcaaaataccaaaaagtatccggacccaggcaaatttttttttttttttttttttttggggaaaaaaagctcttgcgtgtttggccccttggctatatggcccgggcgtggaagggatag

SEQ ID NO: 396872 - DNA, 495 bp, Homo sapiens
ttagctatttcacattatgttggcaaacatttactgattgctaactgtacgccagcactatcctagttgtttggggacagggcaacaaataagacaaacttgtcatctggtggagggaagccagacaataaacgtgtaacaaacaaggtaatatcatatactgaaaataagatgatgtgacagcaattgaaggcactacttgaaataaagcgaagccgggtgcagtggctcacgcctgtaattccaacactttgggaggctgaggcaggtggatcacctgaggtccagagttcaagaccagcctggccaacatggtgaaaccctgcgtctactaaaaatacaaaaattagccaggcatggtggcgcatgcctgtaattccagctacttgggaggctgaggcaggagaatcacttgaacctgggaggcggaggttgcagtgagctgagatcgtgccattatactccagcatgggtgaaaagagtgaaactctgtct

SEQ ID NO: 396873 - DNA, 505 bp, Homo sapiens
acattcttggtgccaactgtgaccgttaaatatgtggattctgtacatgcttcaagattgttcctggaggtcaagccttgtctgatattcctctctttttaaaaaattttattttggttttaaatagagacagggtcttgttatgttgcccaggctggtctcgaatccctgggctcaagcaatcctcccgccttggcctctcaaagtgctggattacagttgtgagctactgtgcctggtctgatatttctttatatggtcctcagttcctgccctcaaaattggcacataggatcactcaataaatattgttgaaggaactatgggaagggagacaaattgggaagcttttaaaattggttggttatgaagaaaatgaaggcctggacttgcgagtggcagggaaaatggagaaggaattaatcagaaatatattagaagaagaaataatagaactggataattgaactctgaatttgctagaaaagaaacatagtattacggt

SEQ ID NO: 396874 - DNA, 256 bp, Homo sapiens
cagtacagacaggagaagttccgtggttcttgctctctcctcatccccacacaccacccccaacccctttcaacagaacacacaaggtaaacccttgcttcacgtcattttgtctggacatctgtgacttttgtgtgacctcttcccaggcttgatgacctgacctcccctgccagggctgatttctgtataaacaaagtttgcccctctttgaacacacctgttccttcagtgaagttgatctctcagttatttt

SEQ ID NO: 396875 - DNA, 104 bp, Homo sapiens
cctaatagagcacctattctaaccttttcttcctcttatttagccttctcaattttctttctcataaatgatgccctgaacccactagctaacctgacaaacca

SEQ ID NO: 396876 - DNA, 297 bp, Homo sapiens
agtttaaagaatacttctaaaaaataacttcagtttacaataacttcagtttgctcctaaccaaaacttcattttacatttctgactaaagaaaaactttgctgcaaaagtcgaggtaaaagaaggttcttagggcataatagctcagggtgggaagggtctgccattagaaattatgaacatttataccagcaataaacaatgagtttctggaggcaacagtcatcaccctctctgaaagagcagaggagcaaaaccttggcaactcacataatgagcccttgtccaaaggaaggc

SEQ ID NO: 396877 - DNA, 885 bp, Homo sapiens
  misc_feature (5)..(5): n is a, c, g, or t
  misc_feature (808)..(808): n is a, c, g, or t
aggantcctgcttgcctgattttagttcttcatgcataactcactctgttgagccacaacgcctgtgccgctccctagtaatactgtattctaaacttcagtgttgtaatggaaacttttagtaacacgacaaccagttttcgtgtgtgtgtgtgttttggtacaacaggatcttgctatgttgctcagactggcctggaactcctggccttaagcagtccttcctcctctgcctcccaacgctgtgtgattacaggcgtgagtcgcagcacccagcctttcctgctcttgtgaaaagctagctgtcttgctcatctccctcacacctgtatgtttttatgctgtgggcagggccgtgacgtgcacaagacgacccacaggaaaccctggctgcaacccacggaggaagaatggcctgaggatggggaccgccttcccaccccacccctgttgataggtggatcttgaacagagttgtgttggtggctaggagtgctagaacctgtgggggtttgagctttcttgtagcctagtgatttattctaacaccaggacttggtctgagtcctgtggaggcgggtggaattgctgagggaagctgtcatcaggtgtgtgagctcatctcatttcctcagaccgtcggcttcacctaaaaaatctgttttctgctctttgaggggcctgatacctggccccagggctcactggcctgggcccccagcttcccttggctgctctggccttttgtgcaggtggcttttctgaattctctgctgtggcttgggctctttttgggtttggttcccanaagcagggttggggcccgcttttctggatttcctccaactttttgaaaccgaactttcaaaaggggtggtttatttt

SEQ ID NO: 396878 - DNA, 874 bp, Homo sapiens
  misc_feature (9)..(9): n is a, c, g, or t
  misc_feature (797)..(797): n is a, c, g, or t
aggttctgnttgttgatcagctgctgatgcatgagcagactctttggatcaccgtgccgctccctagtaatactgtattctaaacttcagtgttgtaatggaaacttttagtaacacgacaaccagttttcgtgtgtgtgtgtgttttggtacaacaggatcttgctatgttgctcagactggcctggaactcctggccttaagcagtccttcctcctctgcctcccaacgctgtgtgattacaggcgtgagtcgcagcacccagcctttcctgctcttgtgaaaagctagctgtcttgctcatctccctcacacctgtatgtttttatgctgtgggcagggccgtgacgtgcacaagacgacccacaggaaaccctggctgcaacccacggaggaagaatggcctgaggatggggaccgccttcccaccccacccctgttgataggtggatcttgaacagagttgtgttggtggctaggagtgctagaacctgtgggggtttgagctttcttgtagcctagtgatttattctaacaccaggacttggtctgagtcctgtggaggcgggtggaattgctgagggaagctgtcatcaggtgtgtgagctcatctcatttcctcagaccgtcggcttcacctaaaaaatctgttttctgctctttgaggggcctgatacctggccccagggctcactggcctgggcccccagcttcccttggctgctctggccttttgtgcaggtggcttttctgaattctctgctgtggcttgggctctttttgggtttggttcccanaagcagggttggggcccgcttttctggatttcctccaactttttgaaaccgaactttcaaaaggggtggtttatttt

SEQ ID NO: 396879 - DNA, 933 bp, Homo sapiens
  misc_feature (856)..(856): n is a, c, g, or t
caaaaaataaataaataaataaataaatttagattgaaattgagaagtgagcagaaagatgccagtttagatgtgatcagattttgttaaagaaatcctataaaatgccaggatattttggcctagtaatactgtattctaaacttcagtgttgtaatggaaacttttagtaacacgacaaccagttttcgtgtgtgtgtgtgttttggtacaacaggatcttgctatgttgctcagactggcctggaactcctggccttaagcagtccttcctcctctgcctcccaacgctgtgtgattacaggcgtgagtcgcagcacccagcctttcctgctcttgtgaaaagctagctgtcttgctcatctccctcacacctgtatgtttttatgctgtgggcagggccgtgacgtgcacaagacgacccacaggaaaccctggctgcaacccacggaggaagaatggcctgaggatggggaccgccttcccaccccacccctgttgataggtggatcttgaacagagttgtgttggtggctaggagtgctagaacctgtgggggtttgagctttcttgtagcctagtgatttattctaacaccaggacttggtctgagtcctgtggaggcgggtggaattgctgagggaagctgtcatcaggtgtgtgagctcatctcatttcctcagaccgtcggcttcacctaaaaaatctgttttctgctctttgaggggcctgatacctggccccagggctcactggcctgggcccccagcttcccttggctgctctggccttttgtgcaggtggcttttctgaattctctgctgtggcttgggctctttttgggtttggttcccanaagcagggttggggcccgcttttctggatttcctccaactttttgaaaccgaactttcaaaaggggtggtttatttt

SEQ ID NO: 396880 - DNA, 533 bp, Homo sapiens
acagatagaaaaaggctactactccagataaagaaatgaagtgaatgaaaagataccctggccaggtgaggtggctcatgcctgtaattccaacactttgggaggccaaggcggaaagatcacttgagcccagggggatcacttgagcccagaagttgaagaccaggctgtgcaacatggtgaaaacctgtctcaaaaaaaaaaaaaaaaaaaaaaggtaaaatataatccattaccagtgagtactgtgaaagaacaataaaaatctaaagaatgaagtatcttttggtaactcttggatgttgacaattctatttgtaaaagacttgacttaagcagtattaaaaatgtttatttgccaagtagctaaacttaaaggtaacaaaattagacaaaagcattttataaaacagtgtaaacaccgcatgttctcactcataggtaggaattgaacaatgagaacacctggacacaggaaggggaacatcacacactggggactgttgtggggtgagggaaggggggagggatag

SEQ ID NO: 396881 - DNA, 507 bp, Homo sapiens
gacctttacatcttgcttattccccactcctatcatgtggaacagggagtaagcccactgaaaagccatcagaaaaagcaaagtagagataggaattcagtttagcttttactaactacataataatgctgaccctctgttgttagagactttagtagccaagttcaacaatgaaaatatgttcctcattttttaatggtggttccttgttggggaagaaggatgtccctgcctattgttcaagattctctggtaaaggatagaacagccacctctacttttacaaggaagttttttttaacaagaatagtatgctattttctttcactgtgcgttaggagctacctgattcctattctgattaaacatttaatttcaaaataatattttaatagattatttttccttttgtttatttaggtcacagttttgaaatccaacaaaggaattctgagtttctaaaatagtagtttgtgggtcacatttaaatttgtggtaaggctgttg

SEQ ID NO: 396882 - DNA, 560 bp, Homo sapiens
agcagcgtctgcatgaaggaggttttccctaattgcacctagaaaacaagactttttttttctttaaatctttgccactgaatctggtgttcgtgaaatgatcgggagttacaagcacaaatcaagtttttctgtgtttctacaacatgctgcactacttcacactgaacatgatgtctggaaaaggtattctttattcttcattactgtccagaggaaaaacaagaggcatttcgtcagagaaattgtcaactctcttttaaccctaagagctttcatgcaagttattaagaaccaaattttctgatcttgtacttttctactaagtaaatattcctcatggtaaaaagtgataggagatagagacaacaaaaataaactagaaacatttttaaaaggctacagaaaactcctcccttctatattgatatttagaacagtcatgctttcattcctgtcaactttccactctaaagctattgcaattactcaatgcaaacaggaatgtattgtttttaagagcgtgggctctctgcacatcacaggttattaaactgggc

SEQ ID NO: 396883 - DNA, 215 bp, Homo sapiens
aatagttgtcagtcatgtcattcttcactcaaaaccatccagtagctttgtttcttattctaaataaagccaaaatcctcagactagctcccaaaaccccatagacatcatcttgccctaccctttcccatttcccctcagatctcaaggcctctaactctctccctcaatccccctgctccggccacaccagctgccctgcccctcctactgca

SEQ ID NO: 396884 - DNA, 437 bp, Homo sapiens
tagacaggcaatttacataaagagaaggatagccaatgaatagtttagaatgtaagtgcttccagagaaaagaagaacagaacaggacaatgggcagaggtgatctgaaaaagctttttttttttttcagacagaatgtcactctgttgcccaggctagactacagtggcgcagtctcggctcactgcaacctctgcctcctgggttcaagtggttctcctgcctcagcctcctgagttgctgggatcacaggtgcccgccacagcatacctggctaatttttgtatttttagtacagacagagtttcatcatgttggccaggctggtctcaaactcttggccttaggcaatctgcctgccttggcctcccaaagtgctggcattacaggtgtgagccacctcgccaggccagcttcctttttttttggtttttctg

SEQ ID NO: 396885 - DNA, 427 bp, Homo sapiens
cttataaatgggtgttgaattcatcaccaaaaatacagtaacttattttgtatctgttttattgaaataaaccaattaaatttctattatatgccacttcaaaacaaccaaacgtgacatctttaaagcaaatcaattatttggttcaaaagtttgaccctctgactttatggtcatgatgtatgatataatcatgtatgctgtccaatgcaataaataaggggttgtgggcaaaagcccaaccacatggcttaataatggagcccaggccccatctgttgaaaaaaagtagataggtatgaaaaaagggactcaagggtcacttccattaagagaggcagagaggacaagctgactggaggaagatgagccctcacaggttgagccccaaaatcatgggatgaagtacttaaggacactgagctta

SEQ ID NO: 396886 - DNA, 622 bp, Homo sapiens
gaaactctgtctcaaaaaaaaaaggataatccaatgtggaaattaataggagcagttgaaattattcaatcaacaggactgatgtttcttgtttattctgttttcaaccttggggtcacaggattcataaaatgattcccaaaggcatttaagtacattataggaaaaagagttcaagagctaggtatagctcaaacacactaaggaactaaagaaatatcaaaagagacttgctaataaaaacaaatatttcccataggacaaagaggcagagaagcagaggacatctctgaaattagggcaggagaactaataccattgttaaagaaagaagtagcaataatttggcagaggcaattcagacaaaaagttgtgatagcatagaaagctcactggacagacaccagtccagtgatttgcagagactcaaatatcttcaggatctctgcacacagaatctgaagatatctctgaacagagaaccatacatatgcatgttaaatccagaaaaaaattcgtttcaaacacctgaatccaaagacagattcttcaaaggagagagagagatagagagaacaaatatgaatacaaatggagaagcagagatgcgccaagataaatg

SEQ ID NO: 396887 - DNA, 137 bp, Homo sapiens
tgtaaagagctctggccaatcaacaaggagtggacagctcatacaaggacgaccaagtggccaacaaacataaagcgatactgagaggcaccaacttcaacgcgtgaatacgaccttatccctccaccatcgcagca

SEQ ID NO: 396888 - DNA, 677 bp, Homo sapiens
cataggagaattttaagatctcattctaagtgattctaagaagtatttattggatcgttgattcatgcactgtaatgccccttagcttcttaaaagttacataagtatttctcttatttagccaagatttttaaatgaatgagcagtacaaggagctagtgtgtataattaattactgctaactcctcttgcttcttccttatgttacaggcctactttcgagaagctgtactgtggctggcttgggttggctcacttgtgtcacccaaaagtacagtaatggagctgggataaattgaaaggcagagggaatcattattactcttttgggggataaaggaaatgaaaatttaaataggcgtgaataaccttctctagctatatgaagatctatagttttcaaactggacgtagagacatgtgtccattaactaatttatacattcagttataaggagttggtctcaagctccctggaggacgacagttattacattcacttggatcagccctgatgcgttggttattaatactcattaagcggaagtatgtagtcgactacatacttccgtggagtgtggcgagtcagctaaatactttgacgcaggtggggatagcgatgattatggtagcggaggtgaaatatgctcgtgtgtctacgtctattcctactgtga

SEQ ID NO: 396889 - DNA, 807 bp, Homo sapiens
aagataatcaaagaacacccacctctcaaagcacacagtgtctgcccactgatatggctagaaaccataggagcttcaaaaagggttcacttggttaactgagaaattagtcattctgtggatcctaagcaggatctcagccactttgtgtcttcatggctgaccctgctgtttgcagtttcctatacacagcatgcctgtccgagtaattagcccttcgcatgacccaaagtgaccttcagcgagtaactctagcaggcctgggctagctgaagggactactgggcttccggagccttagttatgtctgatgactttcaaaatcatcctggtggaggctttagcctcgtcaaggtactgtgtcttctaggctggtctcctgggctccctgcaagaaaccttttggcttctaagatttggacaagccacctagagtgtggctacacttacagagtaaacttgctctccgagctgaaaacaaggacacaggacaaggacacagaaaggacaagagctcttttaagcagaccagaaagcagaggggtctggggaatggggttttagcactgtacctaaagccatgttgcttttcagccccaaactgccctcaagcccattcctcagttgtcctcattttaccttatacacttctctcctaggatgtctgaattcagagttctgcgcgtgctctacacaactcctcctgcttggaattgcaattaccccacatctctctaatacattaggtgccctgtttttaaaatttatattgtatctctgttgtacacgcatagaacatttctgcaa

SEQ ID NO: 396890 - DNA, 959 bp, Homo sapiens
  misc_feature (9)..(9): n is a, c, g, or t
  misc_feature (13)..(13): n is a, c, g, or t
  misc_feature (23)..(23): n is a, c, g, or t
  misc_feature (789)..(789): n is a, c, g, or t
  misc_feature (934)..(934): n is a, c, g, or t
agcggtacngcgngccgagcggngagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatngaatctaactggcggtgtggacgacacaacttgcagaggattcagtgccgctctgaaaatagtaaaggtgtctactgtttacagtacgatgatgaaaaaattatcagtggcctacgagataattctattaagatatgggataaancagcctggaatgtttgaaagtgtta

SEQ ID NO: 396891 - DNA, 1223 bp, Homo sapiens
  misc_feature (9)..(9): n is a, c, g, or t
  misc_feature (13)..(13): n is a, c, g, or t
  misc_feature (23)..(23): n is a, c, g, or t
  misc_feature (1053)..(1053): n is a, c, g, or t
  misc_feature (1198)..(1198): n is a, c, g, or t
agcggtacngcgngccgagcggngagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgttaccgaagtgcatgtttgggattttgttgaagaaagctggatacagtaaacggaaagaatcttggaagatgcttgactgctgtcttttctcagactagtctgaaagggaaaacccccattcattctggattggtggatctgaagtacaaaatattttccagtgttctgtgccaaggtctttgtggctaggctgcgccaacctggtagagagcatgtgcgcactgagttgcctgcagagcatgcccagtgtcagatgtctccagaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatngaatctaactggcggtgtggacgacacaacttgcagaggattcagtgccgctctgaaaatagtaaaggtgtctactgtttacagtacgatgatgaaaaaattatcagtggcctacgagataattctattaagatatgggataaancagcctggaatgtttgaaagtgtta

SEQ ID NO: 396892 - DNA, 1061 bp, Homo sapiens
  misc_feature (9)..(9): n is a, c, g, or t
  misc_feature (13)..(13): n is a, c, g, or t
  misc_feature (23)..(23): n is a, c, g, or t
  misc_feature (891)..(891): n is a, c, g, or t
  misc_feature (1036)..(1036): n is a, c, g, or t
agcggtacngcgngccgagcggngagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatngaatctaactggcggtgtggacgacacaacttgcagaggattcagtgccgctctgaaaatagtaaaggtgtctactgtttacagtacgatgatgaaaaaattatcagtggcctacgagataattctattaagatatgggataaancagcctggaatgtttgaaagtgtta

SEQ ID NO: 396893 - DNA, 998 bp, Homo sapiens
  misc_feature (9)..(9): n is a, c, g, or t
  misc_feature (13)..(13): n is a, c, g, or t
  misc_feature (23)..(23): n is a, c, g, or t
  misc_feature (828)..(828): n is a, c, g, or t
  misc_feature (973)..(973): n is a, c, g, or t
agcggtacngcgngccgagcggngagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatngaatctaactggcggtgtggacgacacaacttgcagaggattcagtgccgctctgaaaatagtaaaggtgtctactgtttacagtacgatgatgaaaaaattatcagtggcctacgagataattctattaagatatgggataaancagcctggaatgtttgaaagtgtta

SEQ ID NO: 396894 - DNA, 896 bp, Homo sapiens
  misc_feature (9)..(9): n is a, c, g, or t
  misc_feature (13)..(13): n is a, c, g, or t
  misc_feature (23)..(23): n is a, c, g, or t
  misc_feature (726)..(726): n is a, c, g, or t
  misc_feature (871)..(871): n is a, c, g, or t
agcggtacngcgngccgagcggngagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatngaatctaactggcggtgtggacgacacaacttgcagaggattcagtgccgctctgaaaatagtaaaggtgtctactgtttacagtacgatgatgaaaaaattatcagtggcctacgagataattctattaagatatgggataaancagcctggaatgtttgaaagtgtta

SEQ ID NO: 396895 - DNA, 1058 bp, Homo sapiens
  misc_feature (9)..(9): n is a, c, g, or t
  misc_feature (13)..(13): n is a, c, g, or t
  misc_feature (23)..(23): n is a, c, g, or t
  misc_feature (888)..(888): n is a, c, g, or t
  misc_feature (1033)..(1033): n is a, c, g, or t
agcggtacngcgngccgagcggngagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgttaccgaagtgcatgtttgggattttgttgaagaaagctggatacagtaaacggaaagaatcttggaagatgcttgactgctgtcttttctcagactagtctgaaagggaaaacccccattcattctggattggtggatctgaagtacaaaatattttccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatngaatctaactggcggtgtggacgacacaacttgcagaggattcagtgccgctctgaaaatagtaaaggtgtctactgtttacagtacgatgatgaaaaaattatcagtggcctacgagataattctattaagatatgggataaancagcctggaatgtttgaaagtgtta

SEQ ID NO: 396896 - DNA, 337 bp, Homo sapiens
ccttaaagttgttggaaaaggattcactaaaaggaagacaccatacacatttattagttcctaacactattgttttaattgctgcagaatctagtgaagcggtgcatgatgatgactcagttcataacaagtgctgagcgagccttagtttactccatttaaagtgattacatcacataaaatttgattttgaattttttaattccaaatgacagataaaacaaaaactggatggttttctagatgtgaagtataatttatctagaaaattaataatgtcaattcttattttttgaggttcaaaacttactatgagtttcccttgcaattaatattg

SEQ ID NO: 396897 - DNA, 393 bp, Homo sapiens
gagatgaatggaacctgggctgttctgaacttcaactctggggggctcatggtctggggaaggagagaaactaaacaccactgtcttgagtgcagggctagatggtggttattgcttaatttttagaaccaaccacttggaggggtgatggcacttggagggaaggactgactcaagctcactggagggctcttggggagggcttcttagaggacatggggatttgagctggaccaagaaggaatgggtacttagaggttgggatggaatattcttggctaaggaaagcacttccttgtgttttggcccaggggtaggatgtgtttgggtaatggcagccagtttattcagtgcattacttaacacttctaaactttagttgtcttctgaaag

SEQ ID NO: 396898 - DNA, 668 bp, Homo sapiens
taaggaggttcactgatgtggtttctgtaacagcaaaaaggtgaaggtaactaaatgttcatcaacagctgattaattaaatacaatgacacatttatacaatggaatactgcatagacactaagaatgatgacacatacatctttatatagtgactcaaaacagctgtttacttgttagagagtaaattattaaacaatatgaatttaattttcttcaaaaatttaaatatttgcttcttcaaaatacacaaggaatgaaagcatatataccaaggaatttactgtggctgttcctaagcaggagagaatacaaacaattctcttaaaattactcatctatagtttctaattttcctgtaacatttactagcaggatgaaagataaacatttttttaaggtaaagaaaaaaactgaataatcacccaatttttctttccaccaatctcattttattcacaatgagtgaggtggaaattctgatcggcatattagaacatcataaactttggaggcagggagatccagattcaaatcctgactccatcatttaaccttctttaaaatgagactaatgcctgatcatgtttgcctgtatatgcattaagtctccctggaaggacagaaaagaagccaagagcagtggctgccacagtaaacagccataa

SEQ ID NO: 396899 - DNA, 461 bp, Homo sapiens
atgcaatcgctcatctcactgttgggaatgggggaaagttggaaaaagaggatcttgttttcatataacagtgtgaaggaatgattttgattgtgagggctagggaagttgagctctcaaactcataaaagggaaagcaggaaataagaaggaaactgattaaagcagcaaaataaaagaaaaaaagatgaaataatgtgaaataaatagtgtaagataaaaaataaaatcagatatagtggttattactctaaagacaaatggactaaattctgtcaaactaggtttaaaaacaacagttaaatgctcttagaatattgaaaatgaaggggcatgccaagaactagcaggcaacagctgataaatttaagaaatgcagcactactttcagataagattgaatttaagattggaatataatcgaatcttaaatgagataaagagggatattatctgaagac

SEQ ID NO: 396900 - DNA, 453 bp, Homo sapiens
aataacctcccttgggggtgagtgagttctcactctgttacttcctgtgagagctggttgttacaaaaagcctagcacctccctgttccacccacctcctctcccaccatgtgatctctgcacatgccagctcccctttgccttctaccacgagtggaagcagcctgaggccctcagcagatgtcaatgcccaatcttgaactttttagccatccagaatcatgagcaaaataaaccttttttctttataaattaccctgcctcaggtattcctttatagcagcatagaacagactatgacttccagttttggaaaaatacaaaggatagaggaacaagttaaacagcaccacaagaaagctagcaggcaaattcagaaagtaggatactgtgtagtgtagctggtccagtttcttcaacaagatgctatcatgaggaaaagaaaatgaggga

SEQ ID NO: 396901 - DNA, 250 bp, Homo sapiens
ccactggacttgggcacatgtttacaatctggagggcaatgtagagactaaaagtaggaaagtaggaagcaaaaggatgaaattctttttcccaataatgaatgtaatcacacataacactgagattcaatctttgtggctcacgcctataatcctagcctttcggaggctgaggcagatggtttacttgagcccaggagtttgagaccagcctggacaacatgagacccagtctctacaaaaaaaaaaa

SEQ ID NO: 396902 - DNA, 209 bp, Homo sapiens
tggtgtctgctggagaatacagtgtctgaagtggtatgctgagtggtgtatgagaatcggaaaaacacttttataggcttttcctatctcaaatagcatgcattagatatgatagtcaaaaaacaaataataaaagttggattgtctatttaactatcagagagacactaatctgagatgccattttatagttgagcaattcatttttt

SEQ ID NO: 396903 - DNA, 109 bp, Homo sapiens
attggtggcaagggccgaacatcgaccttcagggtcctgcccagtggaggtcccctccagcagactcttctctgtcatcagggctttgagcccattgtgtctcatcaac

SEQ ID NO: 396904 - DNA, 736 bp, Homo sapiens
ctactacctaacaggtctgggggccagaagtccaaaataggtctattaaggctaaagtcaaggtgtcagcaggactgcatcccttctggaggttccagagagaaggtgttcccttgcctttcccagttccaaaagccacccctattctttgcctcatggcccctaaatgcatcttcaaagccagaagcaaagcatattcaaatctccctctgtgacctgtgcttccatcatcaaatctccttcaattctgactctcttacctccctctttcacttataaagacctcttgtgattgctggacacagaggccggggctcacaaccataatcccaacagtttaggaggtcaaagcaggagaaatgcttgaggccagaagttcgggaccagcctgggaaacacagtgagaccccccccctcaattaaacaacaaaaagaaataagagaaaattagctgggcatggtggtatgcatctgtagtttcagctacttgagaggctgtggtgaaaggattgctttagccccagagttcaagaccagcctcggcaatataacaagatcccatctctacaaaaaaatacaaaaatcagctgggcatggatggtgtgcacctgtagtcccagatgcttggaaggctgaggcgggagaattgcttgagcccaggtggttgaggctgcagttagctacgactgcatcattgcactccagattgggtgaaacagagacacttgtgttcaaa

SEQ ID NO: 396905 - DNA, 318 bp, Homo sapiens
taatttttgtattttaatagcgatggtatttcaccatgttacccaggctggtcttgaactcctgacctcaagtgatccacccgtctcggcctctcaaagtgctgggattacaggcgtgagccaccgcacccagccaagaagtacagccttgtgccacatcacgatgtttagaccgatgatggaccatatatatgacggtggccccataagattataatagggcatatgcagaaacccgatatatggtgctcgatattggccttgaggatcaagcaggggaaatgactgatgttcagtaatgggacatgtgctgggaca

SEQ ID NO: 396906 - DNA, 501 bp, Homo sapiens
atgaaagagggcttgcattgctcaactaactaactcacccgtctctcctgcagtattagaaactacttctgtatgtacacgttacagtttctaggaactccatttttgcaagacagataggagccagaaaatttgttccttcaactgtatatcgctaattaaacataaaatcaaatcagcattttaggtacttgaataactagtctgtgcttacttttattcatatggaagcagtgtttaaattattctctgattgtaaactcacttatgtaaaccattatacaggaaaaaaatgagtaatgaagcaaagttctgaagcagatctatgtaagcaaatttcaataaccttcttaagagaatatgacacttagtagtggtgagggacattttaagctttttctatttacaagttttttttaaacgagggtgtttcaaagtaaatatttgctgttacgttatgccacatgatatactaataaatgaattaatgaaattaaccta

SEQ ID NO: 396907 - DNA, 297 bp, Homo sapiens
actacatacttccgcccagtgactatctgtccaaccttagacaagcgtcagtcttgttattaatctttgaagccaaggataattatttcaaaaagactatggaatcctcacttacaaacctctgtcttcctttatctccctagatacccacatagtttacaatggcacgtgtattcccattgcaaagccctgttcccaaatcaatctcttttctttcaagagagcccctctctgtttgttatttaagttgacactatcttgaaggtcaaatcaacgagctctcggaagtatgtagtg

SEQ ID NO: 396908 - DNA, 260 bp, Homo sapiens
ttcaacaccagacctctgcgatgggcttccggattcgaggccccgtccctttctcagaagagtaaggaaggcgagtgacttctagtcctggagacggggcctgcaagagccagagtatatagaaagctgcatggtgaaatgaatggtgtctgttccacttcacagtttatacccagcatctaactcaggacttggcacatcacaggagcctaataaatatctgttgaaaagtgaacgaaataaaagctacacttacgcaa

SEQ ID NO: 396909 - DNA, 462 bp, Homo sapiens
gatgtgtctgggtgtgtctccccacgcaggccatattggggaaggctcttggattctccttccctggtgggctcaggggcctgcaggagcatgcatgctctgtgggtctcctctctgtggaggcccctctggcttcccagccccgtggcatggatgtcactggagtgacagcactgtgacaacccactgtactttctgcgggttggacgcttcttgaacatggctggttcagcatctcgggggcctggacactgcctcgtcagcacaaatctctccccagctccttgctgggatatgtggaaacatttttcccatggaaagagagtgtggcctttgtcagggggccacggccagcccgaattacagtaaagattaatcccaaacaagagacagagacagagacaaagagcatcatacacttgggttttcaatggatgttttcataaatgtatgaataattta

SEQ ID NO: 396910 - DNA, 669 bp, Homo sapiens
ggttcagagttcaacttctccttgcagccagcatttggatacttttaatagctgttctctgttactgggcaggactggacacagagaaaatgatgacactctttaaaattcctggcaattatttcctgcaagaatgagattcctccccggccccaaaagctacgtcatgtttttatttcggtactaaacggagcaaaggagcgtgcaaaaatgaaactgatgcatctcacttagcattgcagttaacggaaaggaaatctcttgagagcaaggtctattttttatttttaatcttgggtaataataaagttggcagtctgtatatgcctgagtgcgtaaacaaatgtacataggcaaactttcaaactagacatcctttgtatcagtaagatggatgctcaatgtcttgggtaatacagagatacagaagagacagtctttacccttgctgagtgtgaaaagatccttcgtttagtaactgtaacaaccattctttttattgtgttttgtgtctggggtgagcaagctgaattctggattttattccagatcagaaattactccttattactaatccagtcttaaggatttacagaatgtttttctttcagatttagttaaatttcccagcatgcctctgaatgaggtaagaaacatacatgtcctaga

SEQ ID NO: 396911 - DNA, 758 bp, Homo sapiens
tcaagcaatccccccacctccacaaagtactgggattacaggcacgagccaccacacccagcccatttgtcttgctgtgcctgacttatttcacttaacataatggtctccaagctcacccgtgttcctgcaaatgacagaatttcactcttccaaagataatttttttttttttttgagatggagtcttgctctgtcacccaggctggactgcagtggcacagtctcagctcactgcaccctccacctcccaggttcaagcgattctcctgcctcagcctcctgagtagctgggattacagacctgcaccaccaccccccgctactttttgtattttgtagagacggggtttcaccatgtggccaggctggtctgaacccctgatctcaagcaatccacctgcctcgccctcccaaagtaccaggattacagatgtgagccaccatgtccggccccagagagaatttttaaatcacatgggttgtgggatcatgtgccttggagagagaaaaaccgttaggaaaaaagagtagaaaaccaaccaagcaaacaaacaaaaaatagcaggaagacaaagggcgtgcagtgtgctttcagtgaggatttacacaggacagaaacggtaggaatggctgtgtggctttgaaatgaaaagtaggttaatagagctgatcaatgcacggcgagtctggatgcaggatgccatgaaggatggctgttttaatgatgagagaggctgggagaagggccgatagga

SEQ ID NO: 396912 - DNA, 516 bp, Homo sapiens
agtcctcacttctcctccctgggcagggtcacccaacctggaactgtagcacaactaccctgagcttgcctgaccacttcaatcagaggcagcccagcagttaaaggaacacccccacgcagagatggaaccatcagacagaaggaatcaacggaagaactctagcaacacagatggtcggagtgtcaaatggccactagttctccaacaagggttcttaaccaggctgagttggctgaagtgacacaaatagaattcagaatatgaataggcatgaagataatcaagattcaggagaatggcaaaacccaatccaaggaatctaagaatcacaataaaacgatacaggcactgacagatgaaatagccagtataaaaaagaacctaactgatctgatagagctgaaaaacacaagaatgtcacaatgcaatcacaagtattaacagcagaagagagagaccaagctgaataatttcagaacttgaatactggctctttggagtaagacagtcaga

SEQ ID NO: 396913 - DNA, 334 bp, Homo sapiens
tatgggtaagggtgtggagacaacatgctggctgtgttcctggggcagtaaggaccctgagcttgggaaggagttaacagaatataagcaggagaggaaagtgaaaatccatcatggagaatgaaaatcaggaagaaaaatgtggattttatatggtgggaaacaacacagaaccaagaagcctcctctaagctaccagctggatcttaattgcatgatcccctccaggagacagaatgttccagccaggaggcatgcatacccacattctggctccaggaaacatgtacccgatcctgaggtaatccttctgagttccagctactcatcactt

SEQ ID NO: 396914 - DNA, 289 bp, Homo sapiens
cctccaacattgaggattacagtttaacgtgagctttgggcaggacatccaaactatatcaaaggttatttgaaatcagacagaaacttaatagcagatgtggatgaatgtgtccctaacacatgcagtgaacttaggaagttagtaggtttgagttgcgtgcatgtgtgaattttgtgtatttctcagttacttggttcaaatgggtgcagtttcctgcattcatctcatgtttcttacaaagaaaattgtgggtgggcttcccagaaggaaatcttgaatagggact

SEQ ID NO: 396915 - DNA, 614 bp, Homo sapiens
attttctttcctaacctagctctcctacaaacatgcaaataaactgaaccagctaaagaagtggtcccaaggttttaataaaaaaaacatttaacccttccctaaatattatctaatgagggagcaaaatgtgtcactctcccttaacagatgggattctcatggctgctgttaaaggggaaaaaggagaaaccaaactgggtgactctctgagttacatctttggctctgaactcggtgagtctatggtttgataggttggcagggcaaagggaaaaacagagttggagctgactgaggattagaaatggaatctggggctgggtacagtggctcacacctgtaatcctgaccctttgggaggttgaggtgggaggatcatttgagcccagaagttcaagaccagcctgggcaacatagtgagatcccatcactacaaaaaatttttaaaaagtagctgggtgttgtggcacgtgcctgtagtcccagccactcaggaggctgaggcagatcacttgagcccaggagtgcaaggctgcagtgagcaatgattacgccactgcactctagcctaggccacaaagcaagaccctgtatctaaaataaacataaca

SEQ ID NO: 396916 - DNA, 408 bp, Homo sapiens
ctgtttgtcagagccaggcttcagagaggcagatgcatcattagttgcttagtcagataatcacatattacttgctatagaaataaatgcaggggaggcagatgtcatgttaggtcatgcaaagttttatgaataaaatggcatttgagcaaggagtgaagaaatggagaagcaaagagaatgtcaggagcaggaaaaaggcaggagaacagcagacaggtgtggcaaagccggaagaaaccattttgataggagtgaaggagttcctgttgggaagagtggaaacgagactggggaagcaggatgaggcgtgtttttgaaggtcatatggttcaaggatccctcagttaggtatgggaatgctacaaaaggggcaaaaacggagtctcaggtttgggcgtacgggag

SEQ ID NO: 396917 - DNA, 414 bp, Homo sapiens
cagaacgggaatcccagggggtctccgggagtttgccagccacgctggtcctctttgcaacctcctctacctccccactcccatgtctgtgcccttagttcgaaatggatcagaaggctgtgtctcaggccagacacggtggctcacacctgtaatcccagcacttggggaggccgaggtgggtggatcactttaggccaggagttcgagaccagcctggacaacatggcaaaactccgtctctactaaaactatagaagaaaattagccaggcatggtgggcgcgcctgcaatcccagctgctcgggagccttaggaaggagaatcgcttgaacctgggaggcggaggttgcagggagcctagatgataccattgcactccagcccgggcaacagagcaagactctgtcttaa

SEQ ID NO: 396918 - DNA, 397 bp, Homo sapiens
acatcgccctactcaacccagttgaggcctccccaccacaagaacccaggggccatgccctgcgcatacacccgacccacactggagttccagactcgggcccacactggactctccttcagtggctccccaacctcagtcctactccagggagactcttgtcatccattcactccctaggttcgggcccttccagtcactacagacactgatagcctccctctcacttctcagccctgctgtctcccaacaccaaagccaacaatggctccaccgaactaactgttaaggacacatgccggacctctcggcagcaccccgccctgctgaccactcctcctccttcgcacacttttttctcttggcatttcttgacctcacacactcccagtttccc

SEQ ID NO: 396919 - DNA, 380 bp, Homo sapiens
aatagtgtacctgaacttctcatcaaggaagttggtataggcacctttctgtgtgcttgtgggcctagtaatgtagaagaaccttaaaatggattttttaaagagagttgttcctcccattctttcgggagatgtggttttggatactagtactgaggaaagttccccaagattagttaagatgaaacgtcttagctcactttcatctgagaagacggtggatgagcaaggtggaaccaatttctgtcatagtaattatgacaaatacgaacaccaacaactaggtaaagtaaaaacgtatttctttgcatcctttaaaaaagtattttaggaaagtaaaactatttttacaagtatgaattctagtgagcaggaatatt

SEQ ID NO: 396920 - DNA, 718 bp, Homo sapiens
tgtgtacatattactgacctatagatagtgctacataaggaggctttattcacatatatgtataggatagggatgtagaatgagtcctcgatgacagcaccttcaacctcgcttttctggctgcatctgagaaattgtgagttagggccatgggctgggttctgagaggacctaatcagttccaagcaccttaaagtccaagctgggaaatttatatattcttttaaagaaaaatgtctcctttagtagtggcagccaaagaaaaactacatttttgcctggcagaaatgatagcctattatcccacctgtagtacctgcttgtttaatgaatagttgaatgttgcccagccaattcatatgtcattttctccttgcatgttccccaatcctagagagggcttgagcctttgatatgctttgaatgtttgtcctcctcaaatctcatattgaaatgtgatccccaaagttggatgtgtggtctagtgggaggtgtttgggtcatggggtcactatcctcatgaatggcttggtgctgtcctcctggtaatgtgtgagttcccactctgagttcacatgagatctggatgttgaaaagagtctggcacctcctccctctctcttgctcacactctcaccacgtgatatgctgcctcctcctgtgccttccaccatgagtaaaagcttcctgaggctctcaccagaagcagatgctggca

SEQ ID NO: 396921 - DNA, 509 bp, Homo sapiens
cttttctcagttacattcattctgcatcttccagctaagtacatttccaaaggaacatcaacgaaatgccagttgaataaagcgattctacaactggatagcaggataaagtgctaggcaccttcccacaatttctccctttttcttctccaactaaacctcctaacttcaatttctgataactttatttcagaataatatgtattttcacacggtctccatctcacatccacaaggcatgagtcattattcaatgaacaatagacatttataatgaaccacatatatgtcaagaatccctagggaggcacaaaaacaaagacaatacaggttttgcagttatctcacatctcagtttatatcttgtactgaaaagcagcaagatatgacaaaacaataaccataaatattatagaagcttaacacataaacagaatgtgctacctggggtaccatggccagttggtgcaattctctaagaaagaaggaccaggaagatggatagagtc

SEQ ID NO: 396922 - DNA, 320 bp, Homo sapiens
acacagctcacaggaaagaaaatatgcatgactcttcaatatataaagatgttcagccttacaataggagaaagataaataaaactcccctgaagcatcctttgtgtatgaatgaataactggcttaatttgctggggctgccagaacgaagtagcgcagactgggagccttcagcaggaattcgtttgctaataaacctggaaagatgttggtagggtggtttcttgggaggcctctccccttggcttgtggatgaccgtcttctccctgtgtgctcatgtggtcttcccgtgtgtgtgtgtgtgtgtgtgtgtgtgtg

SEQ ID NO: 396923 - DNA, 372 bp, Homo sapiens
ccctttcgaaggagcccggagcagcacacccagcagaggtagtgtcctggtctccatttctcgtaacttgatcatgctggcctggtaagctagcatccctgacctccacattttcaaaacactgcacgaatacccaccatcactgtgcctttctttacttggggtctgctgtctgcgataggtccctctttgccttggaaattgtcctgccttcacttctccacaaagaaaaggctgggaatgtctcaggagcatttgaaaactgcatttaagtttctctttcatggagggttttcactcagaaggaaaccaaaacttccccaaaggtaaaatattttcctaagttatctccctaccatcagaacacttctt

SEQ ID NO: 396924 - DNA, 599 bp, Homo sapiens
agcaagcaaagcttcacagccactccccactgctcgcattaccacctgagctctgcctgtcagatctgcagtggcattagactctcataggagcacaaacactattgtgaattgtgcaagcaaggcatctaggctgcacactcattaagaaataatgcttgatgatctgtcactgtctcccatcacccccagatgggacccttgtggaaaacacgctcagggctcccactaatcctacattatagtgaactctataattatttcattacatattacaatgtaataataatagaaataaagtgcacaataaatgtaatgtgcttgaatcatcctgaaaccatcccctgaccctgtggaaaaatagtcttccatgaaaccagtccctagtgccaaaaaggtagggaactgccgctttaaatcatctgcagattacttataacacctaaacaatataaatactatgtaagtagttgttatactgtaatgcttagagaatcctgaccaaaaaaaaatgtccatacatgttcagcatagttgcaattttttcccaaatattttagatccaaggttggctgaatccacaaatgcagaacccacag

SEQ ID NO: 396925 - DNA, 308 bp, Homo sapiens
tggtctttatgtataagcatgaacaaaatgataatcagcttatgtaatctagaaatgttctaggggcctttaaaaccttggtctggcatttaatgccacatgtgtataatttttataacctttgaaatatataattgttacatagcatttgaaacctccacctgttatgtaaaatttggaaactatttcttgtctatcacttttccatgactgtggatgaaaattacatcattctcagtcgtgagtgttaagtatgttgtcctttaagtaactgtctacactcacgaactcaaattttctttccattc

SEQ ID NO: 396926 - DNA, 252 bp, Homo sapiens
tcccctgcacacgccgagtgcccaaacaaaaagctccatttctggaacacttaaaatatgtactgtaaacaaaattcaaagaaagaaaacattagaaaatgaatttttgtcaaattggactcaccaaatttcagcttcctcactatgagcaaaaccagcccctatcttctagacaaaaagaaactaaaatttctacagcacatcattaaaacatactacttattctcaaaaaaaaaaaaacaaaaaaaaaac

SEQ ID NO: 396927 - DNA, 337 bp, Homo sapiens
gcgtgggggtgcacagctgggacctggccgctcctccactgctctgggccaatatctttcagtatctgatgctgactgtaccagctggggacaagtaacatatctgggcatttctgccttgcttcatgtattctggttttgtgctgctgcatgttttatctaagaggctacatccctgccccggactctcaggtctgcgagcaagtgctgggtccatcaacagcagctctcacctactgtgggattctatttttttgttgttgctttatcacagtgaggaccacctgctacatataaacccactgaactatttctgccaactgtagctggcttttct

SEQ ID NO: 396928 - DNA, 878 bp, Homo sapiens
  misc_feature (876)..(876): n is a, c, g, or t
ttccgcgtcctctacctgggaaccaccgacccccgcccggcgactttgtcacagactctgttgccctgtgatctgcaggtcctgggagacgcacagccaagatgccagggcaccctggaagctgtgaagtggttatgtgaatcctcttcttcccagatcctgccaaaaggaaagattgtgacatatcactggaaccagcacttaggctattgtgacatatgcctgaggctaacacccagatgatataagtcttcatcctggaccctgtctacagaagtcattgcgatatatgtcttcaccaatcactgaggtcgaacgcccagtgatgtgactctccttcctggtccatgccctcagggaagattgtgacataccccggcccagcacacagttaatgtcactcttgtgcttgctgtctacccatgggtaggattgtgacatatatcgtggccaagcacaaagatataatgactgtcatacctcgaagaaagcaatagagttaatgttgctcctaggtaggcttaggaaaatgaggaagtcgtctttctgttcaaatctcactctctgacatatataaagccctagtgtgttacagagaatgtcataacagggctcctcacacaggtgagatcgtgttctatacacagcccaccaatcttgagaattgtcaccctcacacatggacagagtccactggtgaagtcctgaatcacacatgaatgcagttcacaattggaattgtgactgtcatcattgaacatctagccacaatttggatggtgattcttttttttttttttgagacagaatcgcttgaacctgggaggtggaagttgcagtgagctgagatcacgccattgcactccagcctggggnaa

SEQ ID NO: 396929 - DNA, 620 bp, Homo sapiens
ggactcttgtcactatttttatttattctaatgagaaatgtattcatggttccaggtcagtatgtcaaatgtctaactccctgtcttaaaaagggagttcccaaatgactgttcatataaccatatgtgtttcttgtggagactgtctgtattcttggctttgtcactggatttgtggcttagtgctgtcacgtttcctatctgaggcaaatgccatatatgtttagaccagcctttctcaattgtggcacttttgccatttttggccagttaaattctgttgtgggggctgtcctgtgcattgcaggatgtttagcagcatctctggcctctacctactaaatgccagtgcaccctccctgcagttaaatgaccccaaatgtctccagacataggcaaatgttccccggagaacaaagtcatctttggttgaggaacaaaatgaacctatatttaagatggtctaaatgtttctgagatggtctaaacatttataagcttaacaattaacttgaaactcttcaggactagagaagctatttgtaaatttaaacatctgacgccttgaaacacctttatcataaagataactaaaccagtgttctttgtgaatggccaat

SEQ ID NO: 396930 - DNA, 600 bp, Homo sapiens
tcagtgtgggaaaggaaactgctttggggctgcctatttaagaaatgctatgattctctctaggctcaagatgtgatttcttcattacccaaagccctggggttaatgtgacttttagggtgaacttttggactaacttaggtagtgatagaacagaggacaaaactactgaaaattccagatatgtcaatggtaactctggctgattgaggctgggttccatttttgggtatgggtcatacttcctttgtacttggggtcatactggtccaagttttaacttctagctcagcagttccagattttatcagtgtgtcaggaataattgctaagccaccccgtcagagactgtgttttaaactggacactatcttatttaccatgaaaggatctacagttgtcctttggtatccaggggggattggttccaggaaccttctggggtactaaaatccacagatgctcaagtccctgatataaatgttgtagtgcttgcatataacttatacacatcctcccttatactttaaatcatctctagattacttataatatctaatacaatgttaatgctatgccagtagttgttactctgtataa

SEQ ID NO: 396931 - DNA, 722 bp, Homo sapiens
caagtattaatagattttccttgatgtaatgcatgtttataggattaaacaatcctcttcctatggtccagtgacccttttccaggcctaatcacccacctttcctcaggaacagtgcatgtttttggtttgagccctaatgacatctggcccagacatgtgccagctgagccattgcccctctgtgctcttccctggggagtcctgctttcacactataatccatccatacatcagtacacacctatatgtctttctgatttctgcagccggtctcagcttgtctataattcacttcattttattctctttctgccaactttctgaaaagttcgtgctcgcctacccaggattatcacagcttctggttaggttcctggaacctgggaccaatccctttgactttatctgcctttttctaggaggcacaattgttattagcatgttgaaaggaattgccttttaccctggtcctcataggtttccaataaaacgtttaaaaaatttcagggtccacatttacattttaatttagaaactgtcttcatccaaagagtaaattaccatgtgggattagatgcttctccccacagctcagatagtctagagctgtgctgttcaaaatggtaaccactagctacatgtggatacatgaataaattaaaattaaataacattaaacatttagtgtcttgattgcactaatcacatgtcatatgctc

SEQ ID NO: 396932 - DNA, 485 bp, Homo sapiens
ttttttttttttagaagacacagtgtttcaccatgttggccaggctagtcttgaactcccaacctcaggtgatccacctgcctcagcctcccaaagtgctgggattacaggcgtgagccactgcacccggcccatctatagctttttatcagcattcatcagtttataactttcctatcaagcaagtcctttaattagccattccctcaaaagctttaagagctagtctgctgctgcctcctactgaattccttgctccttaaccccttctgtgtatttcccatgcagccgaccatttagacctagacaggataccccattctaaatctttattccacacctgctctgccagtaggcccttccttatgtaatattttctttcctttgcttccagtctcttatttcatactctcttatgacttttggcccagcaatgctgtcttaccttcctgttgatgtgtgtcattccttagtgaccaactcct

SEQ ID NO: 396933 - DNA, 501 bp, Homo sapiens
tgagatggagtctcgctctgttgtccagggtggagtgcagtggtgtgatcttggcttactgcaacctccacctcctgggttcaagcaattctcctgcctcagcctcccaaagtgctgggattacaggcgtgagccactgcacccggcccatctatagctttttatcagcattcatcagtttataactttcctatcaagcaagtcctttaattagccattccctcaaaagctttaagagctagtctgctgctgcctcctactgaattccttgctccttaaccccttctgtgtatttcccatgcagccgaccatttagacctagacaggataccccattctaaatctttattccacacctgctctgccagtaggcccttccttatgtaatattttctttcctttgcttccagtctcttatttcatactctcttatgacttttggcccagcaatgctgtcttaccttcctgttgatgtgtgtcattccttagtgaccaactcct

SEQ ID NO: 396934 - DNA, 570 bp, Homo sapiens
atatatttttattccttgtgtcttatagcccatgaagttttaaagtatgtcagctggttttcattttctatatttaattcttccttttttttcttactggcatagagctggcataattcactgaaattattcactaaattcagttattttaaatttgaaatactaacattctttccagttcattgagcaaattgtatacgacacaaaccttttagtaattgtgaagttaagctgaatttatgcagggtagattctctgctaaattgaaaataattctaggatgtatgtctggttctgtgtgtgcgtgtgtgtgaccatgtgttcatgaatgagctcaggtatgtatgcttggaggagaacgtgaggtgaagagggtcatttcagacaaacttctatagtgtttgttttggattaaattagactgctagtctgaactaagaagtagtatttctcctaattaatcaagctagtcctaggtacattttgcatatcattcattctgaccaaatgggaaacactatccgtattccccttaattattaatctatgctgtttctatcaaaagggcac

SEQ ID NO: 396935 - DNA, 494 bp, Homo sapiens
aaagacagtcctgacctgccagttccagagtctgtcctctgctccttccaccacccatatgagcatgcctagactctcccacttgtgatttttactgcagcaaaacctctccagtgaagtctctgtgacggaacacaacagtggtcagacccgccaatctgttcctttgctcttctgtggatgcggggctggggggcttctctgagcctcctctccagcatgtcagatatgtccagagtccattctccaccgtgtcctccccttcctactcctcctttgcttcatctagttggtgacacagggaggtgtccagttatgggcctcactgctccatggcagaaatcctggcatgccctggatgaggcttcattggccttatttgctgttgaaagttcaggattctgttgggacttctgattctataggagtactaacatcagataagtcctgcagcgggtggcttggggaagccctcaggccactgcattccagat

SEQ ID NO: 396936 - DNA, 260 bp, Homo sapiens
ttctcccacctcctccctcgccagcatttgaattgctgtcttttggatagaagccgttttaactggggtgaggtgatacctcattgtaatttttatttgcatgtctgatgattaaaggatattgagcatgctttcctatacctgttggccgtttgtgtgtcttcttttgagaaatgtctgttcagatcttttgcccatattttaatcgaattactcatttttttccgattaagtcgtttgagaatatacaatgatctggt

SEQ ID NO: 396937 - DNA, 534 bp, Homo sapiens
tgaagggccagcgtccctacccggtatgcagagcccggctcgtgatggtggctcagctgctatggcatgtccagattgcgccttggccacagtgtgattcgtatcgaggccgagccgaggcccctggccctgaggatgactcgagcggtctgatggacactgtgccacggctttgccgtctgtcatgcttcccagtgtgctgggagagggagctgccctgagactgtggctgtgcgtaaatccaggctgccccgctttccctccccttggttctttctgtcccgtcttcactgcttctgatttgcatgagcagggaccctgaaggactgtgtgcattttgcccactgccttggtcagagggctaccgggtgtggctgcagtgtctcaagggaggctgcgtggctgggtgctcaggtccaggctcggggctccaggcatgtggcggctcctggtagcaaagtgaggggtagtgccgctctggagggcagtgaaggacagggagatgggagaggtcagggctggggctgcggccgc

SEQ ID NO: 396938 - DNA, 277 bp, Homo sapiens
gcaaagaaatcatgaacaaaaaagaggcagcatcctcttgtgtgctgaaccaggctgaggtgggaagagtgactcaaagaatctcagaactcacttggttctatctatgctttgtgcaaacctattttctttgaaaatattactgtaaaatgtttgttatctacttaacgatcagggaggaaataattatagtcgtagccatcatttcttggacccttactaactaccaggcactatgttaaacactgtacatacgatatcgtcgctaatccccaca

SEQ ID NO: 396939 - DNA, 244 bp, Homo sapiens
tctgggcacgttgatttggagatgtgaacaggccatctgccacatgagatcatgaacccccatagcctaggcaacttgatgggcttcttaaccagcccctcacaggtgacttccaggaaacacatgtctggctatgggcctgcagatgtggacatggaggtcctttgcatagagcagattgttggagctctctgagatggcaaagagggaacttgaaaagagacagccaagtatagaaaattgc

SEQ ID NO: 396940 - DNA, 589 bp, Homo sapiens
ataagaagaagggtagggggcgggagtataaacagcagaccccaagccctgagagctcattaataaacctagttggatggcaaaatggaactacactctactgcagtggaattcaaagtccccgtgtagaagggagccatccaggcctccaaacaaagaccagcccagtggcagctctgaatgtcatccccgaatcactgagtttttaataaacttggaaagggaagggaaacatgaatgcatgggagaatcttaagcctctggctttagaaggctagtttctcagagtttattgcctgacagcgacaagtatcctcccagcatcctaagattataggattaaattgagagaagaacttcagttctgactcatgacacagggctttgggaaaagaattacatacatagcctgggtttctttgactagtcaagggcagatttcattggcctggaagtcttgcctccattggtgtatgttagatctccagggggagtttgaagtcagggtattctattcagaagcctttgagatcaaagtgggtgaccagctgccctccttcctggactccacagagcctctgtcagagag

SEQ ID NO: 396941 - DNA, 656 bp, Homo sapiens
agtgtgcatggaggaagaaaacagtaattctgattagaatattgaaaaaagtttctgcaggacacattatggaatggattggtttatggataatctcaagcatttacctccacctggtgaaatcagacagcaactgtctcttcttacatttatttggccacaagtatgcttagagcagctaagctcttgagcacataagcaagtatatggcggagtgggtggtggttccggaatggttgacgtgggaaatgcagagagagcacttaagtgtcagattatgacactgaatacgggaaagtgatgggagtgaggctggttaaaatttttcacccacgcagtctccctgtgttgcccaggctggagtgcaatggtgtgatctcggctcactgcaacctctgcctccagggttcaagtgattcttgtgtctcagcctccccaatagctaggattacaggagttcgagaccagcctggccaacatggtgaaacccctttctttactaaaaatacaaaaattagctgggtgtggtggtgggcgcctgtagtcccagctacttgggaggctgaggcaggagaatcgattgaacctgggaggcagagtttgcagtgagccaagattaggccactgccctgtaacctgacagagggatactctgt

SEQ ID NO: 396942 - DNA, 313 bp, Homo sapiens
agtgtgcatggaggaagaaaacagtaattctgattagaatattgaaaaaagtttctgcaggacacattatggaatggattggtttatggataatctcaagcatttacctccacctggtgaaatcagacagcaactgtctcttcttacatttatttggccacaagtatgcttagagcagctaagctcttgagcacataagcaagtatatggcggagtgggtggtggttccggaatggttgacgtgggaaatgcagagtttgcagtgagccaagattaggccactgccctgtaacctgacagagggatactctgt

SEQ ID NO: 396943 - DNA, 463 bp, Homo sapiens
ttaccaatgtcatatctttttatggtatattcacttcttgcctaatgcatctttcaaaacagaaaatgagataattcagtttgctcttactgaatttatgctgatttttaacttcttcctttactaatgctcccaagtcaaaagctgaatgacgtttgtaggattcctttggggttagatctcaatctttctgatttgtttccatcttttccctacttcccctacaacatccacctttttctttgggaaagaacctggagcaacatttatttttcatcagtgtggtatagtgatctgttacaaaagcacttaaaaatatagcaggtgccttattctggatattctatatatgccctctgagcagaaggcagacaggagtactgtacagtaagaaaaggacatcttaagtttaaatttggcagaactctaataactaaggactcggcttgaatatgctgagagc

SEQ ID NO: 396944 - DNA, 352 bp, Homo sapiens
ctttctgcctaataattttcaaaaaaactctcaaatacatggtcagcaccaccaatacagtattggtggtgctggcggttaagtagacattgtggactttttcttaagagagaattgcttacaattctgcaggctatataaatgtacttattttcttgctgggattacaggtgtgagccaccgtgcccagcattgttgtgtattttcttgacctcctacatcagagggtagtgggcttttttttttttttgagacggagtcttgctctgcaccaggctggagtgcagtagtgcgatctcggctctctgcaacctccacctcccgggtttaagtgattctcctgcctcagcct

SEQ ID NO: 396945 - DNA, 696 bp, Homo sapiens
ccctctagtgttcactgctcatcagattattcctccaacaaataagacagagaactgcctgtttttttggttccctatcgaaggacggagcttggaacaacatttataacggtttaatgacacaaagagtaaaagaccagtctatggcaaattccactgggacatcccattcgccacaaggactgaaatgacccactccgaaagcagcatgtgaagctttgagtctttcttccctccgccactctccagagaacattaaatcgtacttttcattcccctcaccatagggggaacccccttaatgatgacagagaaagaaaaattccatcacactgtcctatgataccattctgctgtcaagcaggcgtttccctggtcagagaatcaaacatggcttccagcaggtggatgttgctgaaggtcacagacagcaaaatgcagaggttacacatggaggaagcacaggttcccacagcaaattaagtcatctgtgaagccttctcatttcccagcgactaaatttatgactgcttttaagggtcatcatcgcttgcatgcacttgcactttatttaaagtatttgagattttggaaaagcagggttgtcccaattaaaaatacatacatgagctacatgtttaaagaaaatggggaaatttaaaaatgtgtttatgtaactcttttagtaattttaaa

SEQ ID NO: 396946 - DNA, 829 bp, Homo sapiens
atacatcattttcctctggtgatagttgttccctattgttatatatcagttaatgttcttttcctgcttgtgccagaaaatgcatttaaatgacactaaaaagaggaactttgatatgttagtcttcaaactatttttaataacaataaaataatttaaatgagctctatttttgccaaaaagcaggtttttaaggtaagtataataaccaatttataagtatatgctttatataattaatttttccttaaagtttcagagaatagaaacatatcagaagaattaacacaaaatgcaaactggtagattcagatctaaatttgttttgcaaattcaatttaatacagaaatgttaagccatttttaatgattaaataaaagtttacatgggaagcaaaacaaaaataatactgttaatttatgtattaaaggtttaattcatgacttccagtttccaatatggcatgtaagaaccttgggcatcatcactcccattctcactacaatgaaaaaacagaacaaactgaaactcaataactcttcttagatacatcagagaagtgaggtcaaagggcaatatattgctccctaaaatggagagacacacaggtaagatacagagaatcacgatttactgaagcagaagcctagaagcagaaacctccatgggaaacaatgctgttaggaaaccctaaactgtaattgacaaattgctgaaggcacagtgtggaaaaaattctaggggaactcaatcttacgaggcccccaaactttcatgaaatgtacctcctacagcccagttgggttctctcagtgaaaacctgagagg

SEQ ID NO: 396947 - DNA, 663 bp, Homo sapiens
  misc_feature (467)..(468): n is a, c, g, or t
  misc_feature (472)..(472): n is a, c, g, or t
  misc_feature (474)..(474): n is a, c, g, or t
tatttttaatgtatgaagcggttttcagatgtattctttattagtctcaatcacttgcatttcctttctttcttttctttttttttctttctctttctttctttctttctctctctttctttcttcttttctttttctcttttctttctttttctcttctctcttctcttctctcctctcttctgtcctgtcttctcttctctttcttgagacggactctctcattctgtcgcccagactggagtacagtggtgtgatcttggctcactgcaacctctgtctcctaggttcaagtaattctcctgaacctctagagtagctggggctacaggcgtgcaccaccatgcccagctaatttttgtatttttagtggagacaaggtttctccgtgttggctaggctggtctcgaactccagacctcaggtgatccggcctgcctcgtcctcccaaagtgttgggattacannctcntngcttccctcctttctcccccttctctctcatcccccttctttcctctctctcccccctctccttatccctcctcctcccctccttcctacccttcctcccccctccttcccccctctcactccacactcctctcatttccctctactctccttccatctctcctcacccctcccttcctccccccctcc

SEQ ID NO: 396948 - DNA, 861 bp, Homo sapiens
  misc_feature (665)..(666): n is a, c, g, or t
  misc_feature (670)..(670): n is a, c, g, or t
  misc_feature (672)..(672): n is a, c, g, or t
ttgaatgggagaggaggaagatgtggggttgcagtgggttcactgggaagcatgcattattctacatatactggggagcacatggtataactggcagagtgtatccagggggagaaaaaatagcatgttggttcttgattttattgtgtggcatagggtgtcacatagtaaggggacaactcaaatttcataggaaagattgccttacttggaatgtagagtcaaggcctacacccaatcccctgcatttctttctttctcctttctttcttttctttttttttctttctctttctttctttctttctctctctttctttcttcttttctttttctcttttctttctttttctcttctctcttctcttctctcctctcttctgtcctgtcttctcttctctttcttgagacggactctctcattctgtcgcccagactggagtacagtggtgtgatcttggctcactgcaacctctgtctcctaggttcaagtaattctcctgaacctctagagtagctggggctacaggcgtgcaccaccatgcccagctaatttttgtatttttagtggagacaaggtttctccgtgttggctaggctggtctcgaactccagacctcaggtgatccggcctgcctcgtcctcccaaagtgttgggattacannctcntngcttccctcctttctcccccttctctctcatcccccttctttcctctctctcccccctctccttatccctcctcctcccctccttcctacccttcctcccccctccttcccccctctcactccacactcctctcatttccctctactctccttccatctctcctcacccctcccttcctccccccctcc

SEQ ID NO: 396949 - DNA, 472 bp, Homo sapiens
ccaaatggcttcaccactgaatcctaccaatcttttgaagacaaattaataccaattatttgcaaactattaaaaaaaatagacaaagaggtgacattttccacttcagttatgaggcatcacccagataccaaaaccagacatatatcacaagaaaactacagaccaatatcacttatgaatatggacacaaaatcctcaacaaaatacgaaccaaccaaatctagcaacatatgaaaagaattatacaccacaaccaagtggaacttatcacaggaatgcaaggttggttcaatatccataggtcaattgatgtatcaatagaattttttaaaaaatcacatgatcatatcaataaacacagaaaaagcatttcacaaaatccaacatcctttcatgataaaaacactctaacaatgaggaatggaaaggaattaccttaacctgatgaagggtatctaccaaaaactca

SEQ ID NO: 396950 - DNA, 658 bp, Homo sapiens
attataagaagtcttcgtactaagttccctgggtggggaacttgttgtttgcctgtttgtttagtgacttggctggactattttagtaaaatctattttccccatctatgaagcctttgatgtcactcttcagcaagcacagcttagggcatatgtacaatcaccctggaatgacagtgattttaacagggcttttctatgactgtttcattccctggtctttttattaatctgtctgcctctgttggtgccacccccagttattaggctccactaattgtcagctgattcctctgttgtttccagcagtgtcctggggcatgaattgtttcacaatctgattcaattaagttgcagactccttacaggagtactttttgtggctagctttgaggttcattttgattccaggacagttcttcttagctgtttctttttaaaaattctatttgctaattctgtgaagaatgtcaatggtagtttaatgggaatagcattgaatatataaattattttgggcagtatggtcattttcatgacattgattctttccatccatgtggacggaatagttttccatttgtttaggtcctctcttatttccttgagcagtggtttatagttctccttgaagaggtccttcacatccttgttagct

SEQ ID NO: 396951 - DNA, 372 bp, Homo sapiens
ctttttggttacaaaagacttttttttttactgtatggaaatattaatattcaaatactgcgccttttgaataagttttagggcactgaataaaaggctcttcaacttggccacttaaaggggattgagccagatggtagtttaagaattccacagttctgttctttttgcctcatcgtagcccatcatactctgtttgctttcagattagtccccttttactgttctacttatttattcgatgactgaaactatcacgattcactgcccatcatatttctaactattctttatgtaatttggaagcaatttagaataaagccctgtcaaggttttacaaataagaactattaaagaataaagctttggata

SEQ ID NO: 396952 - DNA, 313 bp, Homo sapiens
caatcaggaggggaatagccaaatagaatgtgctatgttcatataatagactgtggtccaacagttaaggggaatgaacagtaagatctctgttaatcaccctcagtaactttcagatatgttactgtatcaagaaatctttcgtgttaatagaatggtagatgattggatacatgataaaatgtatatgtgtcatgtacagtgacaccaattgtttaacaatttaagaccctgtattttatttttaaaattttttttcatacatacttccacatcatgtattttctatatgtacatttatgtatgtaaactt

SEQ ID NO: 396953 - DNA, 487 bp, Homo sapiens
gcaaatgaagttagttgctttagaaagagatttagaactctgtcttacagcatacttctccccctaggcaagtctctatctctggagctggggaacaatggtgcacttctctttgaatgacaacccagctagaggacaaaaacactttgtggagttggggcaacagcctcgggtctcaacttgcctctcccaatgtggaactgctggattacaagctggggcatgggtgactgtgccttcagtattctcagtggtactgtacacaggtacagcctctgtaccatgagtaagaaatagttcctgcctctcagccccactcatccagaacttgacctcaccaacaggccactaaaaaaaaaaatcttgatatcctattcctttgagaaagataccctccaactaggaaataaaggaacaggtaatcttgtgttcttggctgcaccagtctggagtgaagtttctatctcagcaagctgggaaagaggaa

SEQ ID NO: 396954 - DNA, 432 bp, Homo sapiens
caaaaatgtctaagtcagtgtttttaaatgctgctgggatccccaaaccagctacataggcatcacttgtaagctgttagaaatgcaaaatctcatacccaaaccaagaccgaccgaaggaatcagaaactgggcaggtgggctgagtctagaaaaatgtgtttttaagaccccgtcagattcacatgcacctggacggccaccactccggctggtgagaccaagtctctgcacacacacctgttctttacagggcagctacagtccacctggttagccccctgaggttttaagctttttctccttttctgcacctgggaattcctcattctttccagcttgcctagtcatgcttataaagtaatgtttattatgttttatctcttttaaaataatatgcacactgactaagaaccagctgaaaatttttta

SEQ ID NO: 396955 - DNA, 607 bp, Homo sapiens
ctggttcctcttttgctgtgggtgaaagtctcagaaagcatgcaggtgacccgattgtcttgactctctctttaacatggacactcagatgtccatgacccataaggcctacctgcttcactgctggaagacccccgatccagggaccctctcccctcagaatacatctcctcatatccaaaaactgcatccaggggggcgtgctgcccagggcaggacctccatcccttagaggccagcttgtcagagcaacatggcccctgccatgttcactctcacacacgtgcacaggcatacatgcgcgcacacatgcatacaggcacatcacactcccacacatgcagtcacactcccacccacacaccacacactcagacatgtgcacacacacacacgtgtacacgagacccatggatctcctcctccccagctaggccaatgatggaacccaagaataggtccagactggagattgagccctgaggtccctcaccgtagacctcctttgggggcagcccatttaataagcacctactgtgtaccaggtgttgtgctgggagcgagttacagaatgagggagacatggtccccgccctctgggagctcc

SEQ ID NO: 396956 - DNA, 337 bp, Homo sapiens
agtaagcgaacagtaaatggtatatttgtaattattcttttttacgttgctttctacttaatatgcgtttattaagcttcaccttaagtataatttagcaaaggattatttcagttttcccttaaaccagtttataagtttacatagggaggttaaagccaacaggaatttttatgtaataaggaaattcaaatatttcagtatctgtgataagagttgtgttaatttgcagaggaataacacaaaacattgattaaatttggattgctaaatgttaaacagtgtttgtacaataaaagtgtgattcagaaaaagccttattataacatgcggaatg

SEQ ID NO: 396957 - DNA, 442 bp, Homo sapiens
aatcataggaatcatccccccagccacagcaaactgatccaggcagggaaacatgttccaacctgagccagtcagctcctctcccttgggaatctgaatttgagtactgagaaggaaagcaatagcagtctgagatgcctgtcacctacgggaagcatcctaaagaaaaaggttgccagttctagctgctgaaattccaggagcaggcttcatctcaggccaccatcctgctcttcctttaaacaaatccccattttgcttgagatagtttctttccattgcttgcaaacaaagaacacaaatgattcacaaaaaaaacttactacaacataatatacaccttgctgaatttacatcttgtactagtgaaactgaatattaaaatgattgctagatattaataacattttatgctgtcaaggacaatactttaaagcattac

SEQ ID NO: 396958 - DNA, 211 bp, Homo sapiens
atgagtctgctgatgtgatcttttaagaaacacctaggataataaatcttgaacagtagagattaaagaaaactaggtcataaaatcagaattttcaaagagaaacatttgtttgcataatccagaaacactttcacctaacaggttcttgaaggtgtagttacatgtaatacctgaaaactcagcccgttaggatactaagaataaacag

SEQ ID NO: 396959 - DNA, 261 bp, Homo sapiens
atgtagaggcttgaagttgtgtaagtgcctgacaaaatcccacacgacagaagctgtgcgtacaagcaagcatatatatgtgcacatgtacagcaactggtatggcaactagaaaaggtacattgaaggtcgggtgcggtggctcacgcctgtaatcccagcactctgggaggccaaggcaggaggatcacctgcggtctcaggagttcgagatcagcctggccaacatggcgaaaccccatctctactaaaaatacaaaa

SEQ ID NO: 396960 - DNA, 731 bp, Homo sapiens
ggttgaaacacaccccttctgcctcagcctcccaagtggggccttagatttcttacagtaaaatggggatgatgatagttcctacctgataagattgttgagaggacagtatgggttaatatgtaaatggctcaccacgcttggcctgaagcaggttttagattatttcagcaacactcaactgttatttatcgagcccctattatgtcccagggccttagaaatacagcattgaataaaacaaagtccctgtctcatgaaacttatgttccagtgagatagttttagggtgatatactagcagaggctgaacatccctgttggagggagattcaagttgcagggaccttccaacttagcctgttgacgtcatgaaattcaatggctcatcgccttagtctctaagaaagcttgttggctaaaacaaggccagtcaggtgagttgtacatgttccagctgcttcctagcagggaattcctgggggacttcagggggttgagatccttagcggatcacacagtgtgccttccgctttgcctcgttgtagtatatttatccagattaaatctgtaaaacaaagttgatttgaaaagttacagtatcaagacaggtagaggaaagaggaaaaaaaaagtattgtgttacttgatagggaagactaagattttgagctgactttatatagaggagactcagggcattttgtaaaaactgtcttcagctactgggg

SEQ ID NO: 396961 - DNA, 336 bp, Homo sapiens
gtgccgttgggagaggaataagttccgggacctgatgcacagtttggtggccccgatattcacggaccttaccacagacacaatgagagccccgtgaggccaagggggcatggatgaggtcccttgtggcgatcatttcacaacgcatacaagtatcaaatcatcacgccgtacgctgtaaatacatgcgactgtttccggttagactttcacaaagccggggagaaacaagttcaactaaggaatctagcaacattgtccccatttgctctgacaggtttctcagtggttgaccaaaaaaagcatgtgtttcaacactagtttcacttgatgatt

SEQ ID NO: 396962 - DNA, 445 bp, Homo sapiens
ctctttgcaaaagaaacaaaacctttgtcaacccctgccctagaccagcataggtagcaggaggcagaggtggcaggaccacttgagcctaggaggttgaggttgcagtgagctatgatcatgccactgcactgtagcctgggtgacaaagcaagaccctgtctcaaaaaataaaaaaaaaaattatgaaaattacaggagatagtttatgtaaaacatataagaagggttgttcaggaaatggtatcattgaaaagtcacattttgtgtaattctcttttcctcaatatgctttatgtttacaccagcgagaccaacatctccaggagtatgagccgtaacttactctccagatcctgtggttcctggcaccgtgcacagtacatagtaggtactcggtgagtacgtgggatctgtagctacctctcacttgggaatatatgtg

SEQ ID NO: 396963 - DNA, 262 bp, Homo sapiens
ctaactccatactaaggcttaaataggattacagttaaaattttctaatataaatttagtagccggtctccacctgaagaaatcgaaaggatggttaatgatgctgagaagtttgctgaggaagacaaaaagctcaaggagcgcattgatactagaaatgagttggaaagctatgcctattctctaaagaatcagattggagatatagaaaagctgggaggtaaactttcctctgaagataaggagaccatggagaccggct

SEQ ID NO: 396964 - DNA, 579 bp, Homo sapiens
ggaacgggtgcaggaagaagggacaagctggatgtgttttgaggatgggagagcatcagtccagctctgcaggtggaggttgctgagcgttgtcctatagggaactttatgcataagggaagtcaggtttagagtcctcactactataaagtggagttggtcagggctgatttgttccgattgaaaaccatgccctttgctttttgggtttacatttagatatttcccatcagagatcatgaggaatagcagtgggatttttctatttagcagccatggtgtggtcaaagctaccaaaattaaatttgaataatatacaaagttcaaattccctggcttccccgttttccatttttaaggataatttcaagtaagagagatgtaagtatttctattacatgtctgatttgaatatgagagcaacctgtctgctcctaagatgtcaggatttgtttccattttttatttccaggagtcagattccttgttaatgtaaaaatggttctgtttcctagaagttttgaatctgctatggatctaggtctggcccctcgttcttgagcttcactcttaatttcc

SEQ ID NO: 396965 - DNA, 692 bp, Homo sapiens
gattctcctgcctcagcctcccgagtaactgggattacagggatgcaccaccacacctggctaattttgtatttttggtagagacggggtttctccatgttggtcaggctcgtcttgaactcccgacctcaggggatccacctgcctcagcctcccaaagtgctgggattacaggcatgagtcaccctgcctggctgggctggccatggttttctctgggactaatgggtgtttaagcccacctcttgtccttgcagggtgccttgtgggttttttgctggggatctctggggatttatctctgcaattccctggtccaagagatgtctctcttccaataagccatttcaggcacctctctttccctgagccccacacccctcttttgtttccctctccctcctcctacagcctggaggtgaggtcattgagggatttcaaacctgcttctcagacaccccttgtgcatgtcctgcttagaggcctaactccttgagtggcgtgtgggagagggtgggaatagttgccatctattgcctggagccctcaaacgacactgagaaagagcccgcttttaataccctgcaagatgttacaaggaagtatggctcaagatggaggttaggacagatatttacaatgtcagccttggattgtttctgtttccttcatgtaagtggtatttcgccttt

SEQ ID NO: 396966 - DNA, 451 bp, Homo sapiens
agggcatccatacataactataatacaacaatcatagcaaactttttattggatgtatcatgtgtcagacacattttcaagcagttgacatatattgtcttatttaatccataaaaacatataaagtagatagtattatattctatagatgaggaaattgaagtcccaaagtagaaacagcccaaatatttattgacgataaaacggataaacaggtttttaaaaaatgttgacacatcaaaatattatgcaatggctgaaagtgaatgaagtatacacaataacaggaaagactcagaaatatcataaatttgagtagttaacgcattagaagagggaactggttatagtgcaatttttaataaggattaaataagttggaggagcctagattccctaattagcaggggtaagcaaaccataacccttggtgcaaatctgatctgctgcc

SEQ ID NO: 396967 - DNA, 271 bp, Homo sapiens
gtcagggcagagaaaggggacctgaagtcaaagagacttgtggggatcaccccatgacccatcccctgccctgaggcaggaccttgctgccagagacagaatggggcccctccattcaaggggggctgttctctgggcatgccatgtggggcatggcctcagtcacatctatagaagtgagatcacagggacaaggtggcctaggaggaaggggtgtgaggcccgctcccttccagcaccacactcactgccagagtctaaatctgcctcc

SEQ ID NO: 396968 - DNA, 430 bp, Homo sapiens
ttaatgtttcccggggtgttccttaagccaacccctcatccccaaatcccagcaggatgatgggagcactcttcccctcccctctaagaagggcttaatttggtgaccgattcctgggccactcacccacagcaggcagctggatgcaggatttactttctctgagtatccatctcctattctctctctttccatcactcagagcaccccaagatctggctacctcgggccctgaggcagacctacatccggaaggttggggacacagtgaacctactaatcccattccaggtgatcatgccagccccatactgggtccatgtctggggccagtgcaggttttggatttggaaacagataccaagagtcctgctagcagaggggcaatcttcccagccttggatagaaggggtcacaccaccagaagtct

SEQ ID NO: 396969 - DNA, 151 bp, Homo sapiens
gaaggtgatatgaattatacagggcaaaataggggttcagaaggttaatatctaaagaactattcagtcaaatgtagggtgagttttaatgtctctgaataaaaacacttacaatgcaacataagaaactagcctccctccccatctacca

SEQ ID NO: 396970 - DNA, 534 bp, Homo sapiens
agaattcaggacaggattgttcttctgaaaatcagatgttcaagaagaaaatatctgttgtgaactagggaaattttaccacaatgcacgtctttattattgatagtaacccaaagagggtttgtgtttattgttgttaaaaatgtgaatagtaagagctcttattagtagatggaaattcttttatgagaatatgaattggtgctcaaagttctaacagtaaaaactcatttatattgtgcatgtcagtgaggacgggagatctagaaaagtagatattgaattgattatttcatttccacaaaagtatacattgaatgggaagtttttaatggtttgttttagtggaaggcaatttggaggcaggtggaggagtacacaagtatatcagacatattattaattaggaagttccctcttcaacatcatattttatacgtgttagcagataccatggaaatatcagtgatttgatctcagtatattaaactcttactttttggaaggacaattgccttttgcctataaagtaaa

SEQ ID NO: 396971 - DNA, 332 bp, Homo sapiens
caacaagagcgaaactctgtctcaaaaaaatatatataatgaaaataaagtaaataaataaataaataaatgaaaagaaatggaaaggacccctttcaaatcctttctggttccataatatttagttctgtcttttagctgctccatattttaaatgattaaacagacttctgtcattcaaataaaacatttcctagtcatcttcagttagctgttttcttctgagggaacatttctcacaaagaaacatgtcccttgacccaacttgttagttacttcagatgttagaatggaaaatataccaccttaaggtatgtgctgaacatatatag

SEQ ID NO: 396972 - DNA, 911 bp, Homo sapiens
  misc_feature (731)..(731): n is a, c, g, or t
  misc_feature (898)..(898): n is a, c, g, or t
ggacagagctaggaaatgataaagaagatgaagatatgacaagaatactgttatagaaggctgaaaaagtagtaacccaggtcttacactgccaaaacaatttcaaaattatcaaagtcaataacttgaaatatagaaaatgtacctaatgaactttcgtacttgtccaaagttatatccaggcataattttggaagcatgtgctgagatttttttctacagcaaaagttaaggtatcatatgaagcagatgaactcagacaataactgatcaatttgcagagaaaagtatggagataatagggaggccagaacttcctgagctgggaaactaaactatagtcacacattgcttaacgacacaagcacatctcagaaatttgtcatcaggggatttcatcatggtaggaacatcctacttccagaaacctagatggtattgcctactacacacctatgctatgtgaaatagcctattgctcctaggctacaaacccgcacagcatgctaccgcaccaaatactgtaggcaattatgacacaatggtaggtatttccttatctaaacatatgtgaacatagaaaagcacagtaaaactatggtgttataatcttgtgagactaccattgtatatgtggtccattttgattgcattatggaacacataactgcacttcttaatttgaacctcttcagccaagaaaaattatttaagtaagacatgactcgggncagaaaatcaaggggaggaaatcctgggaccccaaaaaaagggtagaagcgtacacgagcggggggaagggtccaacaccaagagccccaacataaaggagccgccgagaactacatacacgccacgaagggcggcgaaacccttataagagagcgctgggtgttantacaccgcagcgg

SEQ ID NO: 396973 - DNA, 707 bp, Homo sapiens
ggacagagctaggaaatgataaagaagatgaagatatgacaagaatactgttatagaaggctgaaaaagtagtaacccaggtcttacactgccaaaacaatttcaaaattatcaaagtcaataacttgaaatatagaaaatgtacctaatgaactttcgtacttgtccaaagttatatccaggcataattttggaagcatgtgctgagatttttttctacagcaaaagttaaggtatcatatgaagcagatgaactcagacaataactgatcaatttgcagagaaaagtatggagataatagggaggccagaacttcctgagctgggaaactaaactatagtcacacattgcttaacgacacaagcacatctcagaaatttgtcatcaggggatttcatcatggtaggaacatcctacttccagaaacctagatggtattgcctactacacacctatgctatgtgaaatagcctattgctcctaggctacaaacccgcacagcatgctaccgcaccaaatactgtaggcaattatgacacaatggtaggtatttccttatctaaacatatgtgaacatagaaaagcacagtaaaactatggtgttataatcttgtgagactaccattgtatatgtggcgctgtcgttggacctttggagactaatggcttctaattggaacctttgccagaattttctttcacgggg

SEQ ID NO: 396974 - DNA, 440 bp, Homo sapiens
agtcaaggaccatgcctgtgtgttggttcttccttgctactaagttttccactcccttctggcagcacttcgccctctgaggtgctggctcagaagctctgaggagcttctttcataagctcaggttccagagcaaaacactggcaaacttttcttttcatgagaacatggactttgtactattttccttcctaaaagacgtttttgctggctattcctcctacctacggaagtaaacttttttttttttttttgagacggggtctcactctgtggcccaggctagagtgcagtggcgcaatctcggctcgctgcaagctccgcctcccgggttcacgccattctcctgcctcagcctcccgagtagctgggactacaggtgcccgccaccacgcccggctaatttttctgtatttttagtagagacggggtttcaccgt

SEQ ID NO: 396975 - DNA, 123 bp, Homo sapiens
ccacagtcagcccagattcaaggggtgcgtcaatagactctacctcttcgtggaaggagctgcaaactattgtgatcacgtttgcagtctaccacaaatgtattgctatatgttagcgctatt

SEQ ID NO: 396976 - DNA, 283 bp, Homo sapiens
ctgctgttcccctggcctggaatattctctcctccgcttccatctttgtgactcactcctcactaccttcaaacgccatctccacgaaacctcccctgactaccgtatctaaaattgacaactgcctggtctcctgcctctcacatcccctagactcctcccagacttttttttttctatttcatttgtcaccatttgacattttgatatagtctattttttccttatttattctgctcatggtctgtcactaaaatgtaagtttcataaaagcaaggatttt

SEQ ID NO: 396977 - DNA, 673 bp, Homo sapiens
tgaatagctgaaataaatcatataatcagttctcagaaatggtttaaagagaaaaaattaattattgctctaaaagtatctctgacatttgcaaacacatataacatgcctctttagcattcaaaacaactctgccaaaactcacttaatatagaaaaaatttcaaattgtttgccttcaaaatttgctgggctgctacacctagatttctcagtgcccacctccgctgcatgtagagacctcaagcaaaatccactcctggaaatcttaactcaatggtcccatcaagggagaacacaccaagcacaggagacatgaccatctaggatgattcctaactacctttatagtgaagatgagatggtcagaaagacgtacgtcctgccaggcaacgataaggatttaaaaaaaaaaaatttttttaagaagaaaaatgggctgggcacggtgtctcacgcctgtaatcccagcactttgggaggccaaggtgggtggattacaaggtcaggagatcgagaccattctggttaacacggtgaaatcctgtctctactaaaaatacaaaaaattggctgggcgtggtggcgggcacctgtaatcccagctacttgggagcctgaggcaggagaatggcgtgaacccgggaggcagagctcgcagtgagtagagatcg

SEQ ID NO: 396978 - DNA, 508 bp, Homo sapiens
ccgctttccccattcaaggttagtgttccatttttagccctgaaatacacatgaattagattactagactattcactgatcaataatgtgaaaaaaacaaaaaagaaaaactatgagtcagaagaggaaaaatagtgactcatcagacagagggcgtctctattctattaatttcaactgcacagtctataataaccagtgtgtgagagtttcagccttcatccaaataacgtatgtgaaaccacaaaggaattcaagctgcagacaacaaggcacatttaagaggttacaatgttagtgttgagcttggggacatagaatagagcattgatttctgataaattattgtgtgcattgacattttcggcacaggcatttctttctatattatggttccataaaaaagtcagtttgggtccattaattgcctcagagggaagggtgtgtgtgtgtgtgtgtgtgtgtgtgtgtgtgtgcgcgcgtgtgttaggtggaaaggtggaatgtg

SEQ ID NO: 396979 - DNA, 101 bp, Homo sapiens
tattactcaatcaactatatgccactccaatagtgtatcatcctcactttctttcggtgtaagaaaggcttgtcattttcctctagccctagtggaaaact

SEQ ID NO: 396980 - DNA, 392 bp, Homo sapiens
acaaaaagatcatctctagattgctggtaatacctcatacaatgtaaatgccatgtaaggagttgttatactgtaccgatttttaaatttgtattattttttgttttttttccccccaaattttctatctaagattagttgaatctgaagaagtggaacccacagatacggagggctgactgtagtaatttgacacttcatttttcttaaggtgtatgaaggtcctttcttctctatttgtaaattatgtggtgaataacagtattaaaaaataagctggcttaaaagatgtcagactcacctagggaagtccttactggacataacgtttaatggcaatctgtgggtaataattacaaaataaaatgcatatttgtgaacaaggactgaaa

SEQ ID NO: 396981 - DNA, 541 bp, Homo sapiens
atgcagagttgggaagatgtgcagtagcataacatgataagggtttccaccatacgactgatgtgtaccattgagtaggtataaataacctcaagaacatagacgatagtaaaataattaggaagtgatcagctttgaatatttattacctttgcatttcatatcttttttatttaaatgtatataacttaattgttaataatgactgttcttaacaaatgactcacagaattcctgaaaatttagcaaatgactcttgtcagccagtacaaaccagctccaacacaccactgggtgggatggaagagaatctgattcagaaagagcatgaaaactttcttgatcaattgagatttggtccattttttttccctctctttcactacacaaatctcaggaaaaaataaactgtatatttgtttggactatggaaaggtgcgatagaatgatatttgttctcttccatgtcaatgagaactacagaaagagttaactttgttcattacaggtaaaaataaactgataacaaaataaaattagc

SEQ ID NO: 396982 - DNA, 416 bp, Homo sapiens
tccagcctgggtgacagagtgatactctgtctcaaaggaaaaaaaaaattggtcattctctttttctgatttaaaaggattttgttcctccatggaaaactttaaaaataggagcaagcgtgtatattcttccagacttctaaaaggaattgcaattgctccttttgtagcagacaccatcagggacttgcctggggcctctcatctagcaagtgggagagtccacactggaacccagctgctgaatcctgaacttcattgtgctccattgtattttttatttttattttaaaaaattaattatttatttttgagacaaggctctgtttcccaggctgtgtggtgcagtggcatgatcacagctcatggtagcctccatctcccaggctcaagcgatcctcccaccttggcctccc

SEQ ID NO: 396983 - DNA, 455 bp, Homo sapiens
atccctcctccgtcccaccaccgttcttgtctaatggccccaagaaattccttccagagcactttcctggcagaaccttcctctctcagcaaccctcagggaagacagagaactcaccctcccgctgctgtttggctatagaggctcagcagggaggcccaggcgcccaggccaagagaagatgagttttcagggctctctgagctgaacccagcagtgggtctctggccaacacactgtcccaatccctcctagaacccacagatgagggtgtgactgaaatggaagaagcaccaggccttcaggcttggaaccttgggcacttctccagactggggaggagggagtgtttgttcagcccaggtatacatagcaccttctgtgccccaagccctgggccaggcaccaggtggcaaagctgccatcaaagagggaggtcacaagttagggtctgg

SEQ ID NO: 396984 - DNA, 323 bp, Homo sapiens
ctctctctgctacttcctaattatcagaagcatcaaatgagaatgtgctttgtaaactattaaatggtaagcagatgaaaagggtagttgatattatctcatccagtttcctgctctttgcaggaattccccctacattttccctgataaaggatcgtccaaccacatattgacttaaaatctgtaaaattaaaactgtggtttggccggccacagtggctcacatctataatcccagaactttgggaggccaaggcgggcggatcgcttaagcccaggaatccaagaccatcctgggtaacatggtaaaaccccatctctac

SEQ ID NO: 396985 - DNA, 462 bp, Homo sapiens
cccctggccctgtcatgcagcagatctgtccctactcattcatcagctcatcacctccttcatccgtgcagtaaacagagatgaactgagcatgtgaagggtcccaaagaaggtcatgcaacctgtcttagtttgcaaaactgtaaaatggaaatagaaataccttcttcctagaactgattccagtaccaaataagaaaacttgtaggaaacgtggcatttgtttttaagtgctatgcaaatacaatatatatatatttttttgagacagtctcactctgttgcccaggctggagtgcagtggcatgatctcggctcactgcaacctctgactcctgggttcaagctattctcccacctcagcctcccgagtaggtgggattacaggtgtgtgccaccgcacacagttaatttttgtatttttagtagagatggggttttcaccatgttgcccaggctggt

SEQ ID NO: 396986 - DNA, 175 bp, Homo sapiens
tgtcccaggggaggaggtgaaattcctcagctctccaccaagattggccacaaaagcctgatcccctggaacacagcaggcctcacatagacggtcagccattggatcataggaactgccctggcctgactcacccaatatggaggaggtgcctggggatgccctgtgtgaacac

SEQ ID NO: 396987 - DNA, 221 bp, Homo sapiens
actaaagaaatgtaaattaatccactttggtactactgttttgcaaatgttcaatcaacaagctctttaaaacctaccattttgaaagtctaccattgaatgacttaggaacgcattttgacgcgttgttgggtggctatcaatttaatttgtgcagtctttctgaagaacaatctagcaacattcttaaaatagggcattaaaatagttatatcctttgg

SEQ ID NO: 396988 - DNA, 539 bp, Homo sapiens
ctgtgtttcttttgtaatatggatggcaagttattgaaattttatgaattcattactataaaccggatacagttcagtcctctttctggaataaatgcacttctagacagttaccactatagcactctatcccatcccactgattgtataataaaagtcaacatgtattaagtactcttcaagtttggtccaagaggcatacatgtgttcgtttaaatccccaccagaacaaccctataagtaccattgttatcaccattttacaggtgatgatctgaggttaaatgagtcacctgagttcacacagactggaaggaacagagccaggatccaaatccagacatttgacatcagggcttacactctttttttttttttttttttttttgagatggagtctcgctctgtaacagggcaaaaccgcagggttcgcattctgggcccacggaaacctcggcccccggggctcaaagaattctccggctataaacctcccgagcacttaggaccacgggcacccacaaccaaggcgtggcaaa

SEQ ID NO: 396989 - DNA, 533 bp, Homo sapiens
gatgcaggttatgaatccattcaaaaataagatttttgcatccttcatttaataaagcaaggtggtaaaaagtaaaggaatggaaactgccttattttcaccagaaaatttagccctagtcacttggtgagtttatgttatacttcaggaacccaggcttctgttcttaccctgtttcagaggggaaagttacatctttatgctttgttatcttgacatgggcacgtgagttgaatgcagtgccatttagttgagcattggaggatagtctgtaaattacgacgaagttgtttagtcagttaacataaatctttggggattataaaccttggtgtagcaacttaacatttaaggtagaatagaattaaataaataaagcccacattctcttttcttctggctgacttcaaggaatgcactgagcgccatctgctggttgttactttttcaaaactattttcttaccaaaccactgtcatttgaaattgactctaggtatatataccaacatataaaggcagctttatgaagag

SEQ ID NO: 396990 - DNA, 231 bp, Homo sapiens
gtttgagtcctgccagccgaatacatcctagagatgggctgtacagcagagcgccgtcagtgttggacacttacaatctgttaaaagggtaggacccatattaagtgttctcgccatataataaaaagtgtaaacactaaggaaatcaatggactttatagttaataatatctcagtctggttcgttaattgtaataaatgtaccatgctaacataaaatattaataatgg

SEQ ID NO: 396991 - DNA, 593 bp, Homo sapiens
ttacattattttgttggaggtgttggggaacctttcatggaaggtgtgtggtagactgttggacaggtttcctcaactttcgttccactctttgaagaggttagaaaattaaaacaaaacaagcaatgcagcttcccttgagctagctttatgaatgcagcttagaccacttaccgattgtttgcatatgaatcagacttagaaaaatggaagagatcaaagcctgtcttgctattgttgattctggcaagtgaaatcatggggacaatagttcagaagtagtggaagtggtaggattcaatatccttgtgcctaatccccagtttcatgggcataagaggcttaaagttttaatagcaggagcatctttttgacccaggattgcagaaatgattgcgtgcctttgaattcaagaactcaaaaccttcctccatgccacagctactttagttattttagcccttcctattgtatatgtatgaaatgcactttctgcttaagatacctattgcggtttttatttccttattaaaaccttggaaaaatatagcacttaaattatgttttgtagaaattcactaagcaaataaagc

SEQ ID NO: 396992 - DNA, 562 bp, Homo sapiens
gaccctttcttctctgtccatttgaggatgaaattctcagattttaatggaatggatagaacttcagtgaattgggagagctcacacagcaccccaaaagccttttttctaaggaaaagcagaactgtgatggagtcaggttcaggattctcagctctgttcagcaaaatcttaagtcattacaggtatgtgtggaaaactcagtaatctggcagaatattagaccaacctttgcatgtttttaactttttaaggatatctttaaagctcaatttccatctctttgttctcaaaaagttttataattgtcaaaaatttggatactattatgtaccaatagtggtttcattatttgcttttaataagtggcaatgtcttgctaaagctaacctgacatttgcccttcccttcaaggtctttctgctatattggtgtccagctcatttgttaaaactctggatttgttcctttgacctcagctgggctttgattaactaagataattcttgagttctagctcccatcatttaagcctttagggccttcaatttaggaacttcca

SEQ ID NO: 396993 - DNA, 616 bp, Homo sapiens
tatggaactcagaaaagtgataggggctacaagtatggatttgggagtcaacagcaaatagttggaagtctactttgagtatcaagctttccttttctcaaaaactgtgtgtcatagtattggcttctggtacattggacaatgagccctttttgcttgctaacactgctgcattctgtatctattatttatcctggacatctcgccatatcactacacagaaaaattccttattcttggctgggtgtggtggttcacgctgcaatcccagcactttgggaggccgaggagggtggatctcttaagctcaggagttcgagaccagcctgggtaacatggctctcagtattaaggtacttctacctatttctttttgcatgtcttgtaatttatgctttatgaaagttgttacttggtgtggtattgtaactattataaagtccttatgaattatagtatttagaattacaaagtgcacttttttgtcttatgttttctggcttgaattctgccttgttttattaagatcatgactcatgctttctttttatttgtatttcctggcatgcctttaaccatccttttatttttaacctttaacctatgttttaagtat

SEQ ID NO: 396994 - DNA, 249 bp, Homo sapiens
tcctgagagaataggttcaggaagtaaggcaggttttagggatggtttagggagttctgtagaaatggggtcagtgaatgaggcaggttataggaaggatttaggggctcctaagggaatgggttcagggagtaagacaggtttcagggatggtttagggggttctgaagaaatggagtcaatggatgaggcaggttataggaaggatttgggggctcctgagggaataggttcaggaagtaaggcagg

SEQ ID NO: 396995 - DNA, 579 bp, Homo sapiens
caacagagggagactctgcctcaaaaaaataaaataaaaaaagtctttggaattacccgcagcttggacccaaatgaggcagataaacttgaaataaggtagatgtaagctgacagtagtgattggtcaccatgtgacaaactagcattgatctgttccaagtatagagtaccaatgtgagaaattgaatgagttgtacgtgaagcagggaatgtgtattctgtcagactcatcttggtacattttggactagttacttggtaggaagtcaagtcatgtacagaattaaagttctctgactggctgcagtggctcacgcctgtaatcccagcactttgggaggccaaggcaggcagatcacttgaggtcaggagtttgagaccagcctagccaacatgttgaaaccctgtctccactaaaaatacaaaaattagccgggcgcggtggtgggtgcctgtaatcccagctactcgggaggctgaggcaggagaatcgcttgaacctgggaggttggggttgtagtgagccgagatcatgccactgcactccagcctgggcagcagagtaagaacctatctc

SEQ ID NO: 396996 - DNA, 521 bp, Homo sapiens
ccatgttggcaagggtggtctcaaactcctgacctcagatgatctgcctgcctcggcctcccaaagtactggaattacaggcatgaggcaccccgcccggcccaattgtgtgggcttctatgtaggcagaactgaccataaactgtggctcaggtaaccgaaactgagtcattgaacctcttcagggaccccagtaaaggccaaagtctgcaagcctgcctacattgctgtaaatgggtgccttcatccaggtctctggaatggcaggacctctgccagactgtggctgggagtttgagctggttacagagtaagttcagaattctctgtgggaccaacttgggtaaaccctatcctggtctgtagccatgaacaggggtactgtagtttcccacgtgaatgagagcctgccttctgaatagaacacttctcaaccttacgctttaacagcatttcacaactcccaccctagctctcaaatctcccttagaggcacttattttggaaatggcatcttgcta

SEQ ID NO: 396997 - DNA, 802 bp, Homo sapiens
  misc_feature (41)..(41): n is a, c, g, or t
  misc_feature (242)..(244): n is a, c, g, or t
aaagccccataatccaaaaggaaaagggcaggggaaggaantaaaggttctttcgcttggggaaaaaaagaatgcggaagacagattttcccaaaaaagccaaaggccaaggttttttcaccccacttccttagtaatttgtgaagaaaaggtttttccccccaccccccccaaaatgcccaaaaaaccccaaaaagtcccaagtgacctaaagtcagtgattcaactggaaagaaacctcnnntgtcctccagagctttttggaaatactcaggatcctggccgcctttgtaacctttcctaaacgtcaggcctggacttaaaagattttttaaaacctcccaaagtactggaattacaggcatgaggcaccccgcccggcccaattgtgtgggcttctatgtaggcagaactgaccataaactgtggctcaggtaaccgaaactgagtcattgaacctcttcagggaccccagtaaaggccaaagtctgcaagcctgcctacattgctgtaaatgggtgccttcatccaggtctctggaatggcaggacctctgccagactgtggctgggagtttgagctggttacagagtaagttcagaattctctgtgggaccaacttgggtaaaccctatcctggtctgtagccatgaacaggggtactgtagtttcccacgtgaatgagagcctgccttctgaatagaacacttctcaaccttacgctttaacagcatttcacaactcccaccctagctctcaaatctcccttagaggcacttattttggaaatggcatcttgcta

SEQ ID NO: 396998 - DNA, 300 bp, Homo sapiens
tagaggaccccggtcaacttgctacacactatataacgcttttgctgtacacacacacacacacacacacacacacagacacacacacactcattcttttgtaatgttattttatataaatgcataatagttttatcaacaatattttaattataccaacacataacaggcaattattttaagtgctctatagttttagaataccaactgttgttatcattctatttatattatacagaatacatgtttgtgtattactatttagcaatcaaccactattttagaatctacagatgggta

SEQ ID NO: 396999 - DNA, 345 bp, Homo sapiens
tcggtacctgtgacgtgagctggaagacggtttcaccatgctgcctaggctggcctagaacccctggactcaagtgatctacctgcctcaggctcccaaagtgctgggattacagacattacccacagcccctggccaactctcctaaagttctaaacacatgttcatttgtttgtgtacttacttattgattgattgattgattgagacagggcctcgctctgttgcccaggctggagggcagtggtgcgatcatgactcactgcagcctcaaccttccaggctcaggtggtcttctggcttcagcctcccaaggagctgggtgtccaggcacacagcaccgca

SEQ ID NO: 397000 - DNA, 217 bp, Homo sapiens
ctgttagcatatctgaaacatggtacttgtgggtcttactgtgaactgatgagtaattatagttttgattggggtagagaggccagtaacgttgactgtaaaatggaggaaagaagacagactagaagagattgggaggagaaagaaggagatatccagatctatattttaaaaatcctgatattccacatgcagataatggcaatcatgcataagt

SEQ ID NO: 397001 - DNA, 484 bp, Homo sapiens
tcctccaagtctcatctcagtatcacttttgtaaagcagtagtaggtaactttccctctcttaccatgctattccttgtacatcttaacacctgtcattaaaaaaaaatttttttgcaggtctatttccccattagactgaactctctgagtgtggatttatgtttttcatctttatagttcctcagcagtgtcgggcctcgagtgactattccagtagttactgaattagttaattaattaatgcatgcatgcatatatgtgtcttgccacatgagtcactcctcaaccagtcctccctcatcctgtaattgacttctattttatctgaatgcacaacaacatccctctttcatttcatttgcttggctcttggaaagataaattggaatctttatgctaacatgttggctttctttccccgcatggtgttttctgtatcttatttcaaacctgtaataagattgttggatcgaacaagggca

SEQ ID NO: 397002 - DNA, 447 bp, Homo sapiens
agagatgaagagagtgtgcaaccctgacacagctcagctggtgctttgttaagagatatttataagtcttcagattatgccccccaatttccaggcaacgaagagacttctccaagtgtcgtgctttgtgcattagtaataaggacacatgctccacagtaatgctggaacacaggatgatgctcttcagctgtgtgcttcttcctggcggagcagatgatttcataattagcctgaggaaacaggcagacctaacagccaaggaaacaatgcacctgaattgacaaacgaagttcaaggctttaggcaaccaatggcatatttctagagtgttggaaggagaggcaagagtctacttcaaagaaactgaatggtggtttattgatttttcatttgtaatagagccatattaaaataaagttactggtgaaggggatgaattcatta

SEQ ID NO: 397003 - DNA, 411 bp, Homo sapiens
gacttaaagaaaactcaaggaatttattttttttcaggtgacagagatataaatttaaatatcacgatcagggcataatattattaaataagacaaccaatcaaaattacagactctttcagaagttataaggttagttcctcaagacattgaaaccatcttgaagtctagtaattatacagtactaattatcacagttagagacagagagatgcagagaaaagtgggggattctaagatacaaacttgcaatgcgggaaagaaaagggcagaatagaagatgagcaaatgagctgggtgcagtggctcatgcctgtaatcccagcactttgggaggctgaagtgaaagaggcatttgaggccaggagtttaagaccagcctgggtaacagtgagactctttctctttaaa

SEQ ID NO: 397004 - DNA, 953 bp, Homo sapiens
attgagcccacatccagattttaatagtgccacccattccttactggtgagaccattctcttcctacggtccaccccaccagctgactgcctctcctccccactacagtttcccagctgtctcctgccaccctgcttccatttgctgttgtgtatgctccaattttttaccttcacacgacgaaaacttcaggggcaaaaattatacctatgataatgtaaagagatcttagaacaactgagactggcagtaaaaaattcaaaattttgacattcctagtttggggagacgagttagattcagggatagctatgaaattgtgctgtctgaatttgtaaagtatttttcaaagcagattaacaggacacagtattatgaggaaatcacactgattttcactttctttctcgcttgttggtttccctaaatgcttaaataagaatataattacaatatttctaaacgattgtgcaactgctctgaagcttgactatttacctcccaccactcagaagaatacaagcggtatatatctgttaggttacccattaaacgactgtgacagatcgtatttctggttaattgttagttccttatgaccttagactttgcctgtgtatttaataacaccatctgctgtctagggtagcaataccacctttttacatgaggattactgttcttacttcgtaaacaaaagtgctcaatctgaggtgttgaaactgtaccacagaattatttaaattatactacctatggaaagcttaaagaagaaaaaattaactttcttctctatggtggctttattagcttcaagtaaaatatcagaatttatacaccataagaaaagtatttttaaaagatttacaagttttattattggtctgcaaaatgaaatgttttaaaagaacgttgtctctgttatacttgttttgtttatcttcttctagccg

SEQ ID NO: 397005 - DNA, 1149 bp, Homo sapiens
tagggccaatttgtcaccctttaaatagacttatttgcatataaactaaagcaccttagggcatcattaccgaaagtgtctaagcaaatgtctgatatagttacgtgcctgcattaaaagaaagcagcccccttatcttgccttaatatccttacagtgttttaataagttcataatgcatcctgtatgtgcattttttggtataaaacaccgaaaggtggagaattgacttcagttctctccatcctttccccttaagtgttggtggcgctgcaggggcaacgtgcctcccattggaagtggtgacttcctctttgatagaggtttgcctgtctcttgaaaatgaaaagaagcggagattgatctctggagtcccatggtccagtttggactattgggaatattttttatgggatgttaaaaacaatattagagacgtgagatagtaaatttgtggtaataccggatccaggaagcttacagtgaagagtatgaacttaacctgaaaagtatttctctgttctataaatctctcagtgacatttggattaatcaagcataattaaatgtagttagatttttgtcagattgtagttcaaaataatattcatctatggagagggtaatatattatgtagaaattttattaagcactttagttaagcaaacactaaggagaacaaaatcaacctcaggaaggttaattactaaaaaaatcacaaagtatagtagattatgtaaatcattttaattttgaataccatggcttgagctttaatttacatagagacgtattttggatttgtttttcacattatattttctagtacaggattgcaattgcattcttgaaaagttctactcattttaggattccattaagtttgcttaacttttttcatgttataatttccaaaagcaaagaattacaattgtattctagctaattattttaatgtttcactaactttgtgtgtattgtaagaccatatttttatttctatacaaatgatgattttaagagaagtatcaggagagagaatgtatatgaaagcatcgcgtccacgcctggctttgcaataagtgttcatttaaaagaaagacatttacaaaggtaaaacataagagtttagactatagcgataaatc

SEQ ID NO: 397006 - DNA, 976 bp, Homo sapiens
ctgccaagtcttttttaaagaatctttagatgtcctatctcatgtatcagtgatgactaactgctctcatacagctttgccaccaagcccaaccgtgccacaagcaaaggaagaaacctcaaaagaagtttattaactaagctgaacatcacttccattgaaaacactgtagaatctttagcttctccgcaaagtagacttattatttactttaaaatactttaatgatatcctattccaatcaaagtaagtaaaaggtttaaaggatgggtcagccccactgggatccaacctacatatgtagatatttaccttttcccacagaatctaacaggattgctatgttagatactttgttaaacagataaactgtggtcttccgtatctagaaggccttcttctttcttcttccactatgaaaggatctaagaaaatagttttcgatgtaagatatctcaaatatattcacttgaacaggactggatgaggcaaggttaatgtattaccatccatatgcattagtgcattcctgctgatacctaaaggcaataaattcccccaatctgcccatccttttccaccctgaagccactaaagatgatatattagagggcagctgactccgatactaatttagaagcagctttcatgcctagctgagatcaaaatgaataattgtgataaaatagagcagtgacatcgtaaatataactgatacaaattggaatttgtttttgaaaaagtttccaaaacagatacttttactatagaacattataaaaatagaaaatgagaatgaaatctaagaagttatttttaatacaatctttaaaactcttattttgccagtggcataaaggcagtaagtggctggtatggtttggatctgcatccccgcccaaatctcatgttgaaaggtaatctccagtgttcgaggtggggcatggtgggaggtgattggatcatgggggcagtt

SEQ ID NO: 397007 - DNA, 251 bp, Homo sapiens
gcatttatttatttttattgggacagttgtcctttcttattgatgtcttcatgacttttagatatgtaaacatggaccattattgtatcatatataagaaatattttctctgtttggtaatttttctttttaactttgtttctggttctagtcttatttttagtgactcactcttgaatataaagagagaaccaagaatcatcagacatgtggagaaatgatgtaacatgaaaagtaatatcaaaacaaag

SEQ ID NO: 397008 - DNA, 259 bp, Homo sapiens
ttggagcaggattgagagtgcctggtatgtggagagacctggctgttgtggcatgagtccgagggctcaggggccggctgcttcccggcctttgtcttccttgcaggaaacaggccaggagttacaaggggccagaggatgctgctgtggttatggtggaagttaacagctttgggaagtgtgcatgtgtgtgagtgtgtgtgtgtgtgcacttgtgctcattgtaaagagagacggtaaagaaatgaggagagactgc

SEQ ID NO: 397009 - DNA, 263 bp, Homo sapiens
ttgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttg

SEQ ID NO: 397010 - DNA, 1357 bp, Homo sapiens
tagtaaccaaacaatagttttaaaacaattacatatgatttctgatccattaaattaaaaaaattaaagtataacatcaatgctaatactccattgttggctggaaagtagtttggcaatatgtaccaaaagctttcaaaatgtttattccctttaatgtggagtccctatactcacacagatcccagagtccaagggcctggattcaaatccagactcctccatttatcaacgatgtaaacaggggtaatgtaaaccagcacatctcgatttcctcatctctaaaatgagaataatcataatagtacttacattattggattactgtgatgattaaatgaataataggacttttgggaacagtgcctagcaaacagtggtacaatataagtttgctaaatgaatagatttatctattttaaaaatttacttgaggaagctaccaactgagaaaaggatttatgcagaaaattgtgtattatagtactatttataatatttataatagcaaaaaattaagagctataatagagaatgattagctatttcatagaaaatgaaattaatgaaatgtgatgcagtcattaaaattatgtttatgaactttgtgtaataatgttgaaatcataattttaagtgaaataaaaagcaaaatatataccagcatatttggcatattacaataattaaattacaataattaaatttttatttaaattacaatagatttagattacaataattaaaaagaaattttctttgctttggaaggaagattagataaaggattggaaggaagtcagccaaaatgttaagagtagctgcttacagatagtggagctataaacgatttattttttaatgttcttctctattttctatttgtttttaaactcagcattctttagttttgtatattttttaattcacatttttaaggtagaaagtgatactttgtgtaaggatttggaaggcttaaactcatggtataattaaccaaaatacatcaaatttaataattcttagatatacaaacttcagaagtcatattctgagataatttctttaaatattaaaattaagagaaaaaaagacaggctcttaagcagatgcaaaaatacctatgttacaagcctgcacattctgcacatgtatcccagaacttaaagtaaaataaaaaaaataataataagatcatgccagtggtttttaaacatactttatgtatttaattgaaaatcacatctcctttaccttctttcagcatatattgtacttaaaactctgaacattagccctcagaataaggaaatgaataataaaaaaagcaaaaatagaaaactctaaaataactgaa

SEQ ID NO: 397011 - DNA, 202 bp, Homo sapiens
acgcatgtacacagaggcctacatacacacaggggaagaggacatgaatcgctgacccccagtgagctcactgcctagcacggagcccgtagcaacagtgtagtgagaacagcacccatgaagagatgcggaagctactgtaggaatgggagtgagctagccatgctggggcagggagccacagccgcgctcagcctggagg

SEQ ID NO: 397012 - DNA, 410 bp, Homo sapiens
taatggtagaacagttgagaaggtgattattgtagggagtggaccattgcgcttcttttatggggtggtgagggaaggaatcttctaataagaacttatgtctttggtcccaagtagctgatgagaagaggactagttctgtttgagtctcattgagtgtaaaaaagctaggaaaaacgttaaaaaaaacacgacttgaaaaaaatttgtattacagcacctctttttgaagtgccatctcatttatcgtgtattgttggaatacatagttaactggtgttttgaagtgcttttgccatcagagctcctagagcaaatggataaggataaaatctgacttctctttctctttaataggcaccgtttttgttcaccattttctgagttctggttaggatttggcgacagta

SEQ ID NO: 397013 - DNA, 380 bp, Homo sapiens
aatttaatatactttctgatgaattctgtcacctaaaagccaccacatagttccatttctgaggcatattttatctaattctcctacctggattagtcctttctgttggtacctatattcaatctataaccagtgatattgtaactggcaagactgaaactcattttgaaatgtaaaaaacactggaaggagcccacaaggataatttagtgagagttctctcatcattttatctgctgtagttctaagaagtgatatggtcttagcaactctggcaagcaatttctggtttgattaagatttaagtcacatatagactgggcgtggtgtctcacgcctgtaatgccagcactttgggaggccgaggtaggcaggaggct

SEQ ID NO: 397014 - DNA, 306 bp, Homo sapiens
gtgctattattatcctaactttgcagaagagcaaagctgaggtttaggatggctaggtaatgtatccatggtcactattagtaagggtcaaagccagggtttaaacacagacctgtccaatcacaaagcctatgctttaactagtatgttacactactaggtagttacttcagtgaagttaatgtatgagaatatttgagtagctcttcctactaaccaatagattaacatacaaataacagacatacacacacacatacacattttgaaatgcaatacattactatggcggttatatcttatttg

SEQ ID NO: 397015 - DNA, 400 bp, Homo sapiens
gcagtggcaccatatggttggacgaccaaactcaaactccttcttcagcctcccaagtagctgaaattaaaggcacccaccaccatgcccatatatatatatttaattttgtacagatggggtcttgctatgttgcccagcatggtcttgaactcctgacctgaagtgattctgctgcctcgaccttgcaacgtgttgggattataggcatgagccactgtgcccagcttcatccactattttaaagacaaaatacaagtgagatcatcaggcaagaaagagcataactttcagactttcttcttttgtgccacatacacatatattcttgcatctcttcctgccttaggggaacaggtgtttcttctcctgcctaatacttaccccatcctctccaatc

SEQ ID NO: 397016 - DNA, 492 bp, Homo sapiens
gaatgttcatgagtcacaggctgggtttctgattggcattgagatcaagcaagaatttcttaaaaaccaaaatggctcataagagcagatgtgtattgattctgctatggaaagaatggcccagtgtttaatgacacagtgcctaaccttgtttataagaaaatcatcaccaaagctgctagactgattttattttagtaatctgagttggtttataactcattaacacttatgagacacttattatgtagatggtactgtactatttgggggtggagggggaaaggaaagaaaaatagctttcaaatagtttcctatcacatagtaatcataacttttagtaaggcaagacaaagataaatcaagcaattaaagggaaagaacttttctgggaacaataaggtcaaactaaatggggatttcattcattctgtgcctttctgaatgcccttccctgattattgacctagaaataaaattgaaattgggcta

SEQ ID NO: 397017 - DNA, 485 bp, Homo sapiens
agcaatgagccgcaagccttggactcgcagagctgccggtgcccgtccgagagccccaccagcgcggctcacgcctcagtctcgccgccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctccccgaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcag

SEQ ID NO: 397018 - DNA, 593 bp, Homo sapiens
agaactatgtaccacctaagacaatggccacttgacactcagttttgtatccccagcacctgcttagccttatgtaaacacttcatacatgttagttgaataagtttccggagatgaggaaaggctttttggaaagaggttgtttgtgctagatgttgacagatggactggatttagatccatatctttctttccacccaagggcttatacgaccaccaacatgattaactttaacactgcttaactttgatacctccaagcattcactgctgtttcttttacataaactcttattttgtactaaaagtcttactctacatttgcaatgagtattaatttgtaagttccatccaatctttttagaaaaaagttgcagtaaaacttataaaaacacaagtctattaccctagattatgttttccttacttttgtgagcaacaatgtattaaaatcaaactttatttcacttttgagatacatatgattatctccaatcaaattatcttcatcttgaccacttatacatttattttgccccctatgatataaaacaatttgctggcctgttctcatgagactacattaaggaaaa

SEQ ID NO: 397019 - DNA, 474 bp, Homo sapiens
agcagaaaagtgatattgttctcaacatgacagatatttgagttcctacaatgggaaaggcacattaatgatgtttttctttattgcctataattatggttcgatatactcaggaaatctcttgagagagatatctaacccttctcaaagatggcttgaaatgttcagcacttgggagaggttgtcatagttaaaattaattaggaacaagttcatccaatagcaagtctctcaggaataatctaagagtgcattcctttgttttcactctatttgcagacagaatgctagtaacagactaacgtgtaatagaaaaagattgagtatcattagcaacgaatcatagttcagaatctctgcaatctctaatagtgtgattttaaaggcctaatctaagatattttacttgttctttagggaattacaaaaagcactttatatacttgtttgtgagtttggggcttaataaaattg

SEQ ID NO: 397020 - DNA, 301 bp, Homo sapiens
attggccatttagtgccccctaccacacctttatatgccaggccagagaagcctgttttggtgtatttgggaattcaaattctacaaaattcttggttaggtgtttctaggctgttagtctgaggatgcctgaaatgcttggttaggagcattgaagttgatagtggagtgccttgaaatcgaaaggcacaatcctgttcagctcttgtctttaccacgtcttagctgtgtgaccactgagcctcagtttcctcatctgtgagatgggcatgacactaacttcaagaatgagagatggggg

SEQ ID NO: 397021 - DNA, 557 bp, Homo sapiens
tgtttcaaataagcatggatatagtgggcaagattgactatggaaggctgtattgagctcttagaaaatggtagagggagaaagtttgatttatacattgtacataattttagggggcaagaaaggaaatatggaatgatattgctgtagatgtttcttcattttggccactagatggtgacattgtataaaaacagcttggttgtagaaggtaagatactcaaaatttggtgtgggattggatagctgtatttaacaagtaagcccaagagtgtcacttaatttttttatattcgtcattcagccttgtagcatttttggcgaatttattgaacttctctttttggtatttaatttatatgtgtatactatcctgaagtattttgttaatatctctgtgcctagcatatttggtgatgataaactatatacgataaacaaatacttaaacaaatgctacctgccctccaaaaaattcacatagcaaaaaaaactagttgatatatttgatgtgtctaagaaacatatttaagatacattaaacaaaatagaaattt

SEQ ID NO: 397022 - DNA, 264 bp, Homo sapiens
ataaagtcactggagcaccccaaccttgtttgcccagctaagattggaaagacccatgcctggcctaagtttatacgcaaggacaaaaacttcttcattaatcatgtggattaaagatgccgattaaaggatccatcccctcattctctaatcctgtctggctcagaaaggaccatctggtcacaattataatttcagatacatttattttgtaactatcaaagttattaaataatattaaagaagttttactaaacagagaaa

SEQ ID NO: 397023 - DNA, 122 bp, Homo sapiens
tccctggatctgatcattgcacagttctgtgtctgctgtctgacagacactgtgctaagtggtggggacatagcattgaagacaaatgttttccaaaccttacatagcattggctttgcatt

SEQ ID NO: 397024 - DNA, 185 bp, Homo sapiens
gtgctccccaccttcctctcttgattgagtcatgctcctagattcagtcattgagaggcttctcttaaacactgcagcatgggaccattcatctaccaaccttccccttccttgaacaataactagtgctgcaggctggttggactctggggagtgtggccctgcgtatctggcagtttggttat

SEQ ID NO: 397025 - DNA, 483 bp, Homo sapiens
cagttggaggtgtgtccagccgagattataccactgcagggaacttgacgcatttcaaattgcgttatgtctgttatcctctaacaacctgggcaagataatggatatgtgtggttaactccaatttcatgataagaaacatataagtctcagagtgcataatttcttgctacaaaatttggtgatggaagcaagccttgctgctttttccagttagccatgactgcttttcagcagtactccagtggcatgtgaggggaaccttggaaaccataatgttggcatttactcatgatagtttttgggatagccagtgtgtctgctgtcatttaaaatactgctcttgggtagtttacttggtttttctatcctctggaatgttagggaaaccattccaaggtcctggaaatacaacatttctcccaaatagtccatttatctggcagaataaaatttccagtgactcttcaggatgatatctga

SEQ ID NO: 397026 - DNA, 375 bp, Homo sapiens
attgtttgttttgtctttcccatgagaatgtaaactatacaggagcaaagacacagtgttatttattgttgtgccccagcacctatgacaaagtcaggaacatgataggtggccaataaatggtttgtgagtgaattaatttacattaaaaatgtcagtctgaatttacccagatcctctttcagttccaaaatataagccatggcagccatcacaagaatgtacctcatatacctgtaagacataactgttcttcttaatgcaggccagaaatgaagccagaatccaaagctaaaccaataagaatgagagcaaatactgctatcacccagaggggtgttgaatctggatacagctgcttaggggtttagggct

SEQ ID NO: 397027 - DNA, 455 bp, Homo sapiens
ggttccttgggaatatttatgcttttggtatgttgaagatactaaagacataatttaggtgttacaaaatgatgaaagcgaggggaaagaaggaaagtatgattttgggagatagtttgaagtaatagttttatgcagcaaaatatttgagaaataaaaactgtattcagaagattgagaccagaccacaaaaaatcagagaaatctctgggtttctgtaatctaaccattacacttacagaaaaactagatgatatagtgatagatgtttgatatgaagtcgtgctgtataatacaactctacagattattatatcaagtcatttatgaattttactccttatgttaaaagctgaataaaaagtagctgtaggataaaaggaacatttcctctgtaaatcttttccttacattattctcgttagcatggaggacatggttcgtgaatgttctat

SEQ ID NO: 397028 - DNA, 501 bp, Homo sapiens
gcaatcctaaattaaataagttactcatagtcgaataatttgaaaaactgaattataaaggaagaaaaaaagttttcaatttttaacagcaaaaattctacttaatatgggattatggtttggggtaaatgaaatctacaaatgttcaaaaccaaaagcctaaaaagatctaaaatagtctcatttctctgcttcaaagatcagtgaaattgctacctgagttcatccatttcacagttgatctgcatgggaaattatatgtgcttctctgatttttctttggatgtgtcgcttttattctaactgctggaactatttgttgtacctctttctgaagatcagtttggggctaaattacaagctccatcagcgcaggggccatggctgcctcctgactgctgtaggctgagcacttggtagagcatcagcccacagatagcagcccagtgaaccaatgaacaggtggaagcaagaatcaaagtgttaaatgagagttaacct

SEQ ID NO: 397029 - DNA, 549 bp, Homo sapiens
cacatgaatgaatgcatacacacaaaggaattaatgcacacaccaagggatgaatgaatgcatacaccaaggaatgaatgagtgttcacaccaaggaatgagtgagtgaatgaatgcacacgaaagaaagaatgaatgtgcacaccaagtaattagtgaatgaatgaatgcacacaaaggaatgaatgagtgaatgtacacaccaaggaattagtcaatgaatgcacacacacaggaatgagtgaatgaatacacacaaaggaatgaatgtacacatcaaggaattagtgaatgaatgcacacacagaggaatgagtgaatgaacctgccacttgtggagagtgaaaaaagcctgagagatccccagatgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctcc

SEQ ID NO: 397030 - DNA, 336 bp, Homo sapiens
catatcatccccattgtgcagaaggcagtgtcgtgcaacttaactaccccatcctcacgtgggaagtggcatcatctcagctcaccgcaacctctgcctcccgggttcatgcgattctctagcctcagcctcccgagtagctgggattacaggcgcccgccaccacgcctggcaaagttttttatttttagtagagacggggtttcatcatgttggtcagactggtctcgaactcctgacctcaggtgatccgcttgccttggcatcccaaagtgctgggattacaggcgtgagccaccatacttggcctcatctggcttttcttagatttccctt

SEQ ID NO: 397031 - DNA, 200 bp, Homo sapiens
cccatttccttatggattcatagccaatcagctttccagaatccccccaggaacagctggcacaggggaacacactccagggggaaggtggaagttggccaagccaaagagacccctagaaagacacctccctgcaggaggagggaagagctgtctgggaagctgagactccccgtccgggagaccccgttgttgactgg

SEQ ID NO: 397032 - DNA, 606 bp, Homo sapiens
tccctccatccgcccctcccccccacctgtccccaccttcccttcacacccatctaggcggagtgaagacttgccctctgcgatgggcagcactgccagggcgccctagccgtcgccatggtgacgcgcatcccaccctaggtcagagctgattggtcactctatccaggctggcggagggggcagccaaagtcagagcgggatggggggagctggggacacccagccacaccatacacgacagatgccaagggggaaggaaggccactaaaatggcgccgcggcctccaaaggccgctgctgtgggtgcgcatacccgggttggagaaatcccggcggttctgcaccgcgcggcctcgcctgggccctggagggcgcatccgtcccgcctgggctgtcccgcggctcatggccaagcgctccttgcccagcccggaaccgggcgcccgagccagcgaacaggccggctcgccccagctggccgagcccgacccgccgcgcgctcgggccaggcgagcgcggcgcggcggattagccctgagcccgcagcctcgagggcgcggggcgggcgcgtttggggtatgagggcggggcgggcggcggccg

SEQ ID NO: 397033 - DNA, 498 bp, Homo sapiens
ttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcggcccgtcccctgcggccg

SEQ ID NO: 397034 - DNA, 538 bp, Homo sapiens
ctatataaattgaaaatacttgtctatagaaaagtagaaaatgtcatgtcatatgtgaaaatgctgtatgtaagaaaataagttatcaatactatattaatccactttatgacataatgtaaaagcatagacttaatacacattttaagtctatttttaagtttgattatgtttcaaaaaaactcaattaaaattcccagtcccagtgtaataattgattcaggcaagggtcagcactggatattacaattattggataatttttagagaacagaatattcatgtggtaccaaagtattactccagaaattgcttagtaattataaagagaaaaatatatgttttccatagagagaaactagcagtcacctcttaaccaagtgatgaaatgtagcatgcctaggagtaagaaatcttgacattatgtgtctatcgatggactatataaagtttatatcacctatgacatttaactcaatgtaatcacatccctaggtctaacctccagtttactggaaatacagggaatagagagaat

SEQ ID NO: 397035 - DNA, 132 bp, Homo sapiens
gccttggcaataccaccttctaagctttcctcatggatgtcatttaccaatcccctatcaatgaccaatcacagctccacattcgttatatagtttggctcttgattcacaaagttcctccatcgttatggg

SEQ ID NO: 397036 - DNA, 570 bp, Homo sapiens
agttcaagaccagcctggcaaacatggtgaaacccgtttctactaaaaaaaaaacaaaaatacgaaaactagccaggtgtggtggcacatgcctgtaatcccagcttcttgggaggctgaggcacaagaattgcttgaacccaggaggtggatattgcagtgagctgagatcgtgccactgcactccagcctgggccactgagcaagactctgtctcaaaaataaaaatgaaataaagagaaaagaatcaagtcataccactataaaaatacaacaaattgcaaagaaagtgattggaagtgaggaataagagaaatataaactagctagtaaaaaattaacaaaatgccagtagcaagttcttacctatcaataaccactttatatgtaaataggttaaattctccaattaaaagacacagagtggccggatgaattaagatccaataatatgctgcctgtaagagattcattttaatcttaaagacacacatagtttgagagtgaaaggatgacaaaagatagttcagtcaaatggtaaccaaaaaagagcaggggtggctatatttg

SEQ ID NO: 397037 - DNA, 358 bp, Homo sapiens
gtctgaggagcacgggcttattctacaaaggcataaagatgcactggagggtcttaagcaggggaatcctgtgtcccggattgtgctctgtgaggacccatctgtctgcttcgtggagaaggcgtagagccgggtgagggccaggacagaggcagcgcacacactgggctgtgtgacatcctggtgcctgcactggggaaggctgggtgtcacctgcagagggctgattcgagagatgctttgagagtggccctggtgagacttgctgatggatctgaggtgactctcaaaggtgagagaggaggcagtgatggcagctgggtctgtttcctgagatggggaggccagagctttaaga

SEQ ID NO: 397038 - DNA, 171 bp, Homo sapiens
ctgctaacatcacaaaaagagatctgtatcacctatgaagtagtttaaaaaaatatcaagcctgagtctgatcaaacttgtagatccaaatactattttataggaaacacagaagatgggggcaatgtttaactataccataaggatgtaactagcaacatgggaggaatt

SEQ ID NO: 397039 - DNA, 163 bp, Homo sapiens
ttactacccgtatcccactgcccaaggaaaccaccagtttctgacagaatatattctttttgtctgcttttgtactttatataaatggaatttataatatgtagtcttttatatctgtcttctatacccaacctgtgtttgtgacagtcatctttgttattgt

SEQ ID NO: 397040 - DNA, 461 bp, Homo sapiens
caggatccacctcaggaccagcctgtcctagcagttttgggggtagctgcctgaccaagcatggagggcaggggcctgtgcacacaaggggaacccagacccacaacttcagccctctgcctccagtgatgccctgaccctgacctcacaggtccacagggcccacccagggcccagacacccccgaccaggacacctggaggcctggtgtagggtggagaaagccggccacactggcgggcccccccagaggatgtggctgcaacaggactgggtcctctgtggctcaagccacttgcccaaaaggcagccaggctgctggggctgcagagcctgggggacccgcaagcgatgtccacatggtttcccaaaagaggtcctggtgatgacacaaggccgggtccacctctacccacagacactgtcacggtgctcatggaccagactcgtgggctcgcgga

SEQ ID NO: 397041 - DNA, 1049 bp, Homo sapiens
actgcgggctgggcatccaaaaaaagtttttttttctgttttataagtgcttcttgcagagcagggctaacccataatagtacacccagagtagccagcatccaaacttttaaaagttcccctggtagccctcgtgtgtcaccaagtttgagagccactcttccttaccctttctctaggtaatttcatccctcgtatggcttcagttacagtctgtatgttaacagttcccaaactaaattactgtcctggtcgctgatccttatatccaactgattaattagcatttacactagaatattgtacaggcaactcaaactcagcatgtttaaatctgtcctcaaaatcgtacccctcacccccggctttttcagtactttatctctggttcaccgaatgataccaatgccctggttgtggaaactggagactcgagtcctgtagggaacctgcctctcactcttctatatctagtcaccacatcttgcctctttgaccttctcaacgtcactgccgcactccggttcagcctctgtcatctccagcccagtatccttggttacagatctctccgtaactgttcatgctcccttctaatttttcttcgtattgcagtcttggtgatctttgaaaaatcccaagctaattgtgttcctctcctacttaaaaccctttaatggtttcccattgctcttaggacaaagaccagaacccttgaccctggacaacaagaccctgtgtgtggctgttctccatctctctatagggtcaccttgtggtgtgcttttctttgctcattgcactgcagcctcacagattcttcagttggttgtattccttcctcttagagggcttttgcatatgtggttcacttgtctaggaggctctttgctttgctccctggcttttggctggttgctttaagtttcagtctgaaagtcacttccttggaaaagccttttctgatcccttcaaactaggccatgtctcctcattaaactctcatagccttatgtgttttccctgtgagcacttaaagcagtaaacac

SEQ ID NO: 397042 - DNA, 202 bp, Homo sapiens
caatatcttccctaaccaatgccatcaacctgctatcttctgaattccaatggattaaaccataggcctgccaaaaagtagtgaaagataatcaccaaaataatttcattgctatgacagagccttatggcgacaacctccattctttaccaacattttctctatccctaactttcctcttgcagtcccctaacccccctcc

SEQ ID NO: 397043 - DNA, 368 bp, Homo sapiens
cacgtacttgtcccccagcttcaacagttacccacgtttgcccatcttgtttgatgtactgccaccccctgccctgtagcaaatcccagtcttcgtgtctcctctgtaaaagcatcagtgtgtatctttaacacataaggatataagtgctgccatcacatccaacaaaattcacaaaaattccaggatgtcatctgaaacccactgcgtatgcgttcacacttacacttctctgatcacctctcaaatgtcttttttgcaagtggtttgaattcgtcctgtatctaaatacggctgcacattgcagtttgtcgaggtctttcttttcttttctttctttctttttttttttttcagtcttgctctgt

SEQ ID NO: 397044 - DNA, 664 bp, Homo sapiens
agattaaataaactagataaaagccattagaacggggcctggctcagttagcactcaatacattagatagtattttactaaaagtgaaaattaccaaatactctaatccaatgtgaactatttagagccatgcttgaagggtcaactttggaaacagtagctgagataatacatatgaagagccatttgaaaaggtaaaagcagttaagaaaaaaattacattacttttgaactgtgatacatacaacacagctaactgaaggcagctgtagtatcttttgactgagaattttattttgaaaaaccgttattcacacttgtcactatctttcaacaaaacaatgagttctatcatttccaccaaacacaaacatttctctgtacttcaatagggctaatctgttgtttttgaatcaaaaatacagagttaaataactaaaagtataactggattgtttgtaacacaaaggataagtgcctgaagggatggataccccattttccatgtgattcttacatattgcatgcctgtatcaaaacatctcgtgtaccccataaatatatacacctatgtacccacaaaatttttaaatttaattttttaaaaaatcacggttaagtcttggttcagtccaccatcagacagtcctaataggttaataag

SEQ ID NO: 397045 - DNA, 664 bp, Homo sapiens
gtccttccttgcctcttccagcttctggtggccccagatgtcccctggcatgtggcagcatccactttccatgtggcgttctctgtgtgtcactttgcatagtcttccctctacgtgtgtctgtctctgggtccaattttccccctttcataaggataccctaatgacctcatttcaacttgactacctctgcaaagaccctctttccaaataagatcacattctgagatactgggcgttaggagttcaacataccattttttggaggaacacaattcaatccttaacaataacattttcaaattgacaaaagtgtagagatagcaaattagtggttagggatggtgggtgttaggggttgttgtgactataaaagggtagcacgaaggagatctttgtgatgacagaatatttctacatctcaagtgctgtgacagttacatacatgtacaataaaatggcacagacctatatacacattagactcatgtcaatgtgctgattttgatattgtgctatagttatgaaacacctaattactgaggaaattggacaaaggatacatgggacctctctgtactgtctttgcaactttccgtgaatctatattttaaagtatgacatatgtatatggacatactcacactaagacacacaagcagtt

SEQ ID NO: 397046 - DNA, 362 bp, Homo sapiens
tgccatagagtccctgtcctggattccatgcctgagggtgtcccattctggctttctttcagccttgcccttccatgtgggttgaggatttcatagggccaaggggatgtgcacaccctgccctctaccctctagtcttatgcactagctacacaagaccccagaaataggccttacaacaagcctgtttcccaggcctgctcttccaagagtaggctgcatccctgctgtgtacttcctaggcctaagggatagctaaggggcagctgtttggaggggatagttggagcttagatggagttggaccttcagctccacatgcatatatgcaaagccctgatatataggccagggccagaggt

SEQ ID NO: 397047 - DNA, 677 bp, Homo sapiens
ggacagagcctaaagcgtattactttaacacactacgtgtacaagcaaagctacaaacacctatggagtaaagctggtcaactgggctgaggccagtccatttttcaagcttttataaagattacttcaggtgacaatttttactgaaaacttgttttgttttggttaacagtagtgatagatttgtagataaactgaaattcaaatgcttattcatgcttcaataaaaccccttgataggttacgagtttcttcttgagaatagatttccttactgtgaactactgagtatttcctgttttaggtcagattgtaactaccgcgaaatgatctattagaaaaatttgggtccttctagtgccagaggaaagaaatgcacaattaaatacactcagatacaaaaagcaactgaaagacaaaggagaagagaatagagaagagccttatggtcctgacattttatttttgaagtgtaagaaaatgacatttgagattttaatgtggttttgtctgagctcaatctaagattttacttatttctacgtaacacgtcatcattagtttcagctgacctcattgccacatgcatagctgagggcttgtggaaagaaatcacagggatttccagaaaaggtgacctcaccacagaagcacaggagcaaggagaccgaggaagg

SEQ ID NO: 397048 - DNA, 484 bp, Homo sapiens
ctaattttctgcaccacctcaaaatatcaaagaaaactggggtgtggtagccaccgcaaggacctccagtgcacatgtagctaaacatacacaagtgagaccatgcttctgcgattagaggcttcttccttcactgtcatgagcataacatggtcacttatgcatagtccttagatcgtaatcagaaccccaagaaatgtttgctgactgaataatctttcatttgttcaactgaaggcagtgtcatagtggccagccatgcagcctgtcacttgaagaaaagtgcttgaggaagaatgaacatttcgacattacttcttgctgatctacaattttaactctatttgtacagccagataactgagtacatgatttacaggaataaatgagagtcacctgtggctgtacgtttgtgtaagtccacatactttttacgtaggttgttatatttatgaattgggtgatgctcacagatcttggttac

SEQ ID NO: 397049 - DNA, 165 bp, Homo sapiens
tgaaaatcattccatgtgagtagaagtagaactgcctcattgtttctaatgaccgccacatattttgctctgcagatgtagtataatttagctaactggtatttttctgactgtagtcttttttctgactgtaaacccaataagaggttatatattaatattgac

SEQ ID NO: 397050 - DNA, 486 bp, Homo sapiens
tgggagctattattattaataataatttcaaatcagaatcgggtttttctaagaaaaaaatagatgcctcagggaagaagtcaagattcattaacaaaataaatagccaagattactctttaattcatattaggttggattctgtgatgctgtttagtgtctgtatattcccatcctggaaatctcttatagtcagcattccttggaattgtggtatagattttaccatctcaaattttcatggtttggctggcccacagtggagtaaagacacagatcttgctctgtggaggtgtagagtaatcactaaagagcagatcagccaggcgcagtggctcatgcctgtaattccaacactttgggaagctgaggtgggaggattgcttgagcccaagagttcgaggctgcagtgagctacagttgcatcactgcactccagcttgggtggcagagccaaacactgtctcaaaaacataaaaaataaaa

SEQ ID NO: 397051 - DNA, 198 bp, Homo sapiens
catcaatgagagcggatggatcagacctgagcggggcatatgcacttctgctggggaactcagcctgaacttttggtactgtttctgatggtgaggatactgttactatggacaaggataaacttgaaaagctctcctacaatgtagagaaaaaaagccaaagggatgaaagcaacacacgagaacataatagatact

SEQ ID NO: 397052 - DNA, 152 bp, Homo sapiens
attacaactgttagagtactcaaaacaaatttagagtacaaagtatcatcacaggttaaacagctgtatgaatgtgcaggagattttactactgtactacacagactgggaggtgggggctctagggaaatacggtgtatgctgtataaact

SEQ ID NO: 397053 - DNA, 801 bp, Homo sapiens
ctatgtgtgagttgtattactggagaaagtttttttgttgttgttttttatttgtttatttttttatgagacagagtctctgtctgttgccaggctggagtgcagtggcgtgaccttggctcactgcaacctctgcctccctggttcaagtgattctcctgcctcagcctcccaagtagctgggattacaggctctcatttcttgatacttgggtgaagaacaagtaggaggtctggaggctcaaactgatatgtaaacaaattgcttttattattattatttgccattagaaaaacaggtgaaacagtcatggactctactattcaggaattattattctagagccagtaaatacatggttgaattaagagtaatgtgatcagaatgaagaagggagttgcacagaagacttgggctttatttgggacactgctcttatgttgttgtgagttctgatgtcaccacctgaagggacatcatagacagaagagttgttacaattatttctgttgcttttcccttgttaagaatcgtttctaatatagtttttctagaaagtactacatgttttggttaagtcggttgttagtgtgtcatgcaaaatagagaagaggcttaaaccattaaaatcagaaaaattctgggagtcaagttcttgttggtccagcttagaaaagatagaacacaaaataagccagcagcacagagaagagaagctgagggccaactccctgccccagccctatccagacctatgctctatgagccttgtccaggtctggccccaccctgaaatctcc

SEQ ID NO: 397054 - DNA, 617 bp, Homo sapiens
tctgtgcaaacggttgaatgaatggtaaaaataataacaataataaaaataataaatcagtgtgtatctcctctgtaaagttttgattaatatgaaaaagaattctaagctagtcaaactggtgtattttgtgctgtgaatttgtttttctgtaggatgaaacatgggcttagaacacctgtgagcccacttttcaacatgacccagcaaactggtcagtaacaaacagctgcaggtccctgaaacaaacaaacaggatgaagtctccccttgttttatgtccttgggagcctgaccttttaaccatgtggcagtaccttctcttggtctccacctactagggaaaaggaattttagggttcatgtcatagtcagctctaaaaatcatataaaatagttaaaagcctttgcaagctcaaaattaactactctaggcttctgtgaaaggaagtaggcaccgtcccacactgtagctcagtaactaaggtttctgcactttcacagtggcagtttgggtttgataccccacctaggaagtaagtcatttctggtttaatatctgcgtgaccttgtctagtctcttctcctccgcagactgtcttaaattttcctttctc

SEQ ID NO: 397055 - DNA, 444 bp, Homo sapiens
taccaattctgaatatattgttctgcttgttgaagtcctgtaagctatctttttcattctttttacttctaggattggattatttccaatgacatgtctttaatctcactggttctctctttcacttaatctggtctgctgttgaacacctctactgaatttttcagttcagttattatattcttcagttttataatttctattggccgcttttgaaatactttctatctcttttttgaaattatttgtttatgcatttttctcctgaccttagtgaacatctttatgaccattattttgaattcctcattgggtagatcatacatctccacttcactagggttggtttctgcagatttatcttgatcttttatttggaacccatttccctgtttttctatttcctttgtttctctgtattagtgtccgtgcattacataagac

SEQ ID NO: 397056 - DNA, 342 bp, Homo sapiens
agattgtttcaaataaattatttctgttattcctgggaaaggggtaataatattctatcaggtataaaaattcacactttgtatttttgtctttggaaaaatgatcataagaagccaataaaatattaaaaccaataaaagacaaaggaaagttgctttaaaggagaggagttcataaaagcagtagaggtattgtttattctgttgaaatgtttatgatttttaaattactattaagttttgccatggggaggccaggtgcggtggctcaaccctgtaatcccagaactttgggaggctgaagtgggcagatcacttgaggtcaggagtttgagactagtc

SEQ ID NO: 397057 - DNA, 294 bp, Homo sapiens
aagggtggagttctaaaatgaagaaaggtaagttgccaggagatatgagaaagtcccaaagaagtttcatctgtctttgcccaggcagcaccctggggctcagttttctatgtgattctggatgcttcaaccctacagtagtttgcatgaaatttctaggagcccagccagggacaaatatacagatcccaagtctagactgcacaacttaattaacttgtcccttaaagcagtctcccagacaccgtttggtatatgtgcagtcgcttactgacttgaggtgcaacaccatcc

SEQ ID NO: 397058 - DNA, 440 bp, Homo sapiens
tgggactacaggtgcatgccaccatgccccgctaatttttgtgtttttagtagagacagggtttcaccacgttggccaggatggtctcaaactcctgagcacaggtgatctgtctgccttggcctcccaaagtactgggattacaggcatgagccaccctgcccggcccacacttctcattttgagtagctggggtctggactgtgcattttgactgtactctcttaccctttcagtctatttagtggattgtgtctcacactggctggaatttgtggcttccaacaacctactggaggtaattgcccacaggataaagtgagaaaaaggagcaaaatgggaagatactgaaagagaaactgtctcaatttgggaaggacttgttaaaaagacaagcattgctaattagtagcttagtatctaatctttgtcactgaagg

SEQ ID NO: 397059 - DNA, 366 bp, Homo sapiens
cctggctcggcctccctggctgctctgagaggcctggcccgggctctgcaggcgctggagccagcggaggcatctggatcccataagcttgtcatgagctggtttgagcagaatggcctcaacagcccccagagagcccccctcacccctggctgcactgatgcaactcccatctgtccccagcccacagcagctcccagggatggagagtgtgaatcctcagggagggttgtctagaggccctgggctggacggggatcccatgctgaccggtggacacggccccgaatccccctgcactgcacttgctgctctgttttgcctgtaagcatctcccccatcagaccgagctcctccaggataaga

SEQ ID NO: 397060 - DNA, 215 bp, Homo sapiens
aatcaattcacattaaaaagacttacgtatctctacttagcttgcttaatatatccatctactgctttgaacataagaactacagttataactgatttagtattcttatctagtgactgtcatgtacagttctttttctgtcgattgctttttctcattttaagtgatattttcctgcttctttatatgattttttttttttttttttttttgag

SEQ ID NO: 397061 - DNA, 755 bp, Homo sapiens
gcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtg

SEQ ID NO: 397062 - DNA, 327 bp, Homo sapiens
caggttatcttgaactgcctgacttaggccagccctacagaagtgctgtttactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggaggtgagt

SEQ ID NO: 397063 - DNA, 245 bp, Homo sapiens
gataccttgcacctcacagacacaatggatgatttcttactcattggtagatgtcaagactagacctatcacattactaacaatttggaagtctcttacacttaaatcaatgagtcccaaagtgcacactacttggatgctttcttagacagtttagccagccaattctaggatttctagacaaagtatgaatttccattaggtcttcatgctttagtagactagtattgataggtatacactgg

SEQ ID NO: 397064 - DNA, 566 bp, Homo sapiens
tgaggcaaaacaaaccctggggaacttgctgctccattttccttatgtcctgaaatccttatccagtcatcttgcttttatctgcctttcagagtcttctggtagttgttctatgtgttttagttataggtttttagttgtagttaatgggagaggtgggaggtgattaatccgtcttatctgaaaatggaagtctcatctgtctatctttttattgaaacatggtcttcgggtcgtttaaacgacccgaagacatcaatacctcatgccctgcaggtcacacagtgtaaggaggtgcgaggaaaacagagaacacttggccaggagccaccccagggtccccattgttggggcctggcggcgcagccactgacggatcctggagctgtccggggctgggctgcagtgcaggcatagcgggtgcgtggcttgaggaccaggacagaccctggtgtgggcaagcagggtgtggcccacctgataggacaggtggggtaatactgacagaacgtgcgtgctcctaggggctgcctcctagaggtggctcttcaggactctgacccaca

SEQ ID NO: 397065 - DNA, 224 bp, Homo sapiens
agcctcctttgctggtttaggaacatttctattgagagagagaaaagtaacaacactctaatgtgttcttttttttgctttttaaggaccaggattatggaaaaattaccattaagcttcaacaaaacagtcatctttcatgctgtctagtacagtggctctcgaacattttctgccttagcaaacctgattggctcactgtgtcagggaatctcaccatgaag

SEQ ID NO: 397066 - DNA, 566 bp, Homo sapiens
caaatgttgtctccgtcttctattaattaatcacaatgtccccatggcgaagtgtcctatgactaatgcaaactgtaactgtgtggcatgaggccaacttgctcatcttcctttctgaacaagcctccccagatccacgggggaggctgggtgagtggggagccacttcctctgggtatcagatcaaaccatgaaatctgtttctgggttgggcctcagaaaagaatttctcctggggacatccaaaccctttagttatttttgacacttagtccagccagaggtttggagagttgctggggctaagctcggggtttctcccaactccgcatcaacggtgctgtggaaaaggcaagccagattttccagactggggaaggcagcgcggctgatgcattttcttctcacaggaaaagccaactagctgtcccaaagatgagatcttcaatgcactgcaaatccagacagcacctcctgcaaaaagggactcaaatcctccacatgacaccatctccactgttatcatcccagactgagtgacccctcgcatctgtccgtctgcctca

SEQ ID NO: 397067 - DNA, 372 bp, Homo sapiens
atgtgagttggggtttcaaaatactctgatttaaagaaaaaaaagagggcaagcaaggtggctcacacctgtaatcccagcactttgagaggctgagtggagaggattgtttgaggccaggagtttgagacagcctgggcaacatagccagatcctatttctacaaacagaaaataatttattaaagaaaaataagatgggccaggcacagtgattcatgcctgtaatcccagcactttgggaggccaaggcaggaggatcgcttgattccaggagctcaggaccaacctgggcaacatggtgaaaccctgtctctacaaaaaatacacaaaattagctggacatggtgatgtacgcctgtagtcccagcta

SEQ ID NO: 397068 - DNA, 325 bp, Homo sapiens
ctgacttaatgtttggccagtcagcattcattgtgaatgtatatgcttatctgtgatagggacaatgaaaatccaaatagccaatgaaagaaaaacaagcaaatctgtaccccatgattaatgaaaatctgaccttgatttgcgaacactaaaggttatccaaaaaggaaagataacactacgtactggaatagtcaaaacctcaaaagttgatgcaaaacgcttaatttggcagggcgcagtggctcacgcctgtaatcccagcactttgggaggccgaggtgggcggatcatgaggtcaggagatgagaccatcctggctagc

SEQ ID NO: 397069 - DNA, 208 bp, Homo sapiens
ccctgtgatttggggccacgattcctggcagcgagcagagatttcaatggaaacttcttactcggaagcaggctggaaggggatattgaatgagagacgtagttgagaccagcggaggggctggcttcaatggctcctctgctcttccttgtaaagagaacagcaagcttgctgcctgagaggggacaagatgggaagtgcaggttgc

SEQ ID NO: 397070 - DNA, 626 bp, Homo sapiens
tcccagtgacgtacccaaagcccgaactagagaaattgagacagatccactcagccaggctttgggtcttacccagttttcctcgtgtcacgaaccctcagtttctccctggagagcgtttgtctaatgtggctcagtatcatttgtgaaagggtctagctaagcgtggcttccatgtaagtgatctaagggacggagagtcctcaacataaaactaaatagccatgcttacagcctctctgttctgcttctctttcctcctcccattctccatttcctgcagaagatgaacaagtatttcagtctgttcaggctgctagagcagagtactgtagacagggtgacttataaacaacagaaatttacttctcacagttctggagactgggatgtccaagatcaaggcgccagtagattcagcgtctgcttgaggccccattcttcatagatggcaccttctcactgtcttcacatgctgaaaggatgaataagctcgattgggcctcttatcagggcactcatcctattcataagggctctaaccccatgacagccacctcccaaaggccccacctcctaacaccatcaccttgggtgttaggatttcaacatacacattttgagga

SEQ ID NO: 397071 - DNA, 438 bp, Homo sapiens
agcagcccaaaaccggtaacaacccaaaggtctactgaccgatgaatggataaataaaatgtgatctatccatacaatggaatattattcagcataacaaggaatgcagtactgatccatgctatagtgtggatgaacttcaaaaacatgacagccaatgaaagaaaccagcaaaaagaccacaaactatgattccaggtacatgaaatgtccacaacagggaaatctatgtagacacaaagcagatttgtggctgtcttgggcttggggtttgggaagtgactgctgatgggtattggtttctttttggggtgataaaaatgttctggaattagatagtggtagtggctgcacaactttgtggattcataaccttgtgaatatattaaacactgaattgcatactttgtgtggtatgtaaattataactcagagagg

SEQ ID NO: 397072 - DNA, 373 bp, Homo sapiens
attttctggagaggttcaaacacaggctatttggactagggaaaaatactaggtacagtgaaagtcagggtgtcacactgaaaacaggatctcctgctctcttccctaacatggctcccataacacaagcaatcaggccttcacacttcagccaggagactggaagtcttccctaggtataccccaagagaagtgggaatgacactgaaatggtttccccaactaaatagcctactgagaacaactatagtgacgttcatattccgtaagcccctctaccacccagagcttccaatatactttttagtcttccactctgaaatatgactagacagccaagggttaccagacaacaaaggaaaaaggaaataga

SEQ ID NO: 397073 - DNA, 636 bp, Homo sapiens
ctttactctttagattcctgtctctcatggcttaaatgcttatctgaattttgaagaagacaagattattttctgctaggcgaggtcagaaataactttaacatttaatttaactcctttatcatgtttaattgcatagtaatagatattttggttgaaggtttatacattaaaaaaatacataactgagacatgaaacactttaagtgctcatacctcaaatggtcttagctgtgctctttactaagttgtgataaaatctgtgtcctgacaagtattcatctactcaaccagagcccttaactccctaaagttagtgtggataactgaagtgaattttgtacttagctaggaagatttgtttggctaaccaaggactgtcaacacaaatttgatgttttttggtgtgtgaattagccaaaggagtaccctttctttcctatcctctggactatggccattttagaagcatcttaagtatatttacctaggggaaggataaagaaaaacagaaaataaaagaacttatagtggttaattttttgtgtgtagctctgtattttatttctttccaacatcacaacgatgatgtgaaataaaaactctttaccaaaatatattctcccctccactcag

SEQ ID NO: 397074 - DNA, 587 bp, Homo sapiens
ggagctctgtgtcaggaaccgggttcaaagaccacgtattagtgcaaaagattgtataccccaatctacaagagttttaggtgccccgtgtctggaatcatgggcagagaccaagtatgtatttcttatcgtgggctactatgacagtaatgccacagactgggtggagaaatttatttctcccagttccggcggctagaagtccagggtcaatatgtttgatttctgttctcttgaagcttctctctcagtggcttgcaggtgactgtcttcttgctgtgtcctaacgtggtccttcctctgtgggccgacatcgctggtgtccctcttcctatgggggatactagtcggattagagccccactctaatgacctcacttaaccaattatctccttaaaggccctatctccaaatacactgagggtcagggctttcacttatgaattttggggagggtacaattcagttcatgagactctctcctccaagttgacgtaaaagccaggggacagtgagggggacgggcagttatgaagcatcattaattctccttagaagtgctgcttttcttctgtcagtgaacact

SEQ ID NO: 397075 - DNA, 773 bp, Homo sapiens
acaaagtgcattagtagatctcccatggcctgtgtgtatttgttcctaattgttatctttattttctgggcctgactggagcaaatgtgagtggaactaacggagggggcagaaggaaggtcagaggttggagatctgccgatcagcactgagcccagaggcagcagctgtctggactgactcagtacctgctatgagagagcaggaaaggatggcagacactgcagttagcacagagacagaaacattctcagtctgagtgtgtgttacatgccagacacacagttggttgacagtagggaaaagagaggctgagggtgtggctgggtagctaccaagccgtgagccagtgatgggcagcgacacagtgagtcagaggaagagcaggtctgcaggacacgtcagccctgctgccaggtgtggtgtcagcccaaacagctgcacctgtgggtccagaggtggtcagcggatatctagtttcggtcggccttcattcagcctctggctgtcatggccactgggttactgaaatcatggcttgtttccttctgtatctctccatcttcgtgtacagcttccctttatccaacacgaagtcaggcagattgtccttgtaaggcaaactaaacattagcagaggcaagtacacacacaacaacactcaggaagttagagaacattctttagtcgcttgaagcaaaagggcttttcctggctaggaagcaaaaagaaaacattgtttctaaacttgaagctaatgccatctaccattt

SEQ ID NO: 397076 - DNA, 197 bp, Homo sapiens
gctgagatcatgccactgcactccagcctaggcaacagagtgagactctgtctaaaaaacaaaccaaaaaaagtgtgttctttaaagtagaatatttgctttttacaatatagttctcagaatgatccagttccatttattattctagaatgtggtgcaaactcaatgacattggaagagactctttttgttgggca

SEQ ID NO: 397077 - DNA, 212 bp, Homo sapiens
ctagagcctcagtgttttaatgagctccccagactagtggttgcaaggaggccagtcctgcagcacagcgatcggccttcagaaacacagggagggagttgtgtggtcagctgcattcaggagacgggagttacacaggattgaaccatgttctgcagcaggacttctaggagccttttaaggcgctgagcatcgtctcccaaatttagctg

SEQ ID NO: 397078 - DNA, 524 bp, Homo sapiens
gactcgatttacttcccctagattgtctcgcacaaatcccctgatgaacattctgctctagccatggcagtctattcatgtcatagagatgccttgggccgtctttccttgggtcttttttaatgctcttcccctcctcagatgcttgtctgaattctttgcattcttcaagttcttatgtagcttttcctggctgttaaagcctgaagtgatctttgtattttgtacagtaaataatgacgtgtatttgattctgtaaatatacattaaatattaaatactctaaatattagagttacataaaatttaaagttcctagaatgtgtgaaattactatatcctgcatttctgacaggtagtcatttactctctccttacccattaccctagagcacagcacttcccaagccaacacattgatccatttagtaaaaccttgaccccgtttgtccttttgtcgtagtgtttcttttttctgttttgtttgtttgttttgagacaggatctcgctttgtcacccatgc

SEQ ID NO: 397079 - DNA, 496 bp, Homo sapiens
ccacagagtactacagcagaccccttgctccctgatttcattacataaacagagattgactttatcagtccccaagagagtgctttagaagtaactctagctgctctgttttcaaaaactgtgtttggattgtgccatgctcagttggcgaggtgagctgagaccagtaaagacaaaggacctaaacatctgaatccatttgtgttccccaaattctgaaagccaacagatgtactccatgtgctgctaggctaagctttgaaaatttaaaaatacatattttttccactgacaaacagaaagtgacggtattctgtatttctttaattaaaatccaagcgttctcaaaggctccgggacttactttaaagcttctttaagactgagctatttattttactattagcaaataacagagaatcaagattctaattcagttttaatcacaatctttgcttttattttggaaaccctgagttaatcttttttcttctaa

SEQ ID NO: 397080 - DNA, 504 bp, Homo sapiens
  misc_feature (341)..(341): n is a, c, g, or t
gtcccaaaagcaagtaggagtagctattcttatattagacaaaacagactttaacaacaattgaaaaagacaaagaaggacattatgtaatgataaaaggactaatcaaacaggaaaatatcacagtactaaatctatatgcacctaacactagagctcccaaatgtaaaaaacaattaccactagacctaacaaatgagatagacagcaatacaattaatagtgggggacttcaatactccattgacagcactagacgggtcagaaagtcaacaaagaaacaatggatttaaattataccctagaacaaatggactcaacagatatttatagaacattcnacccaacaactgcagaatatacattctgttcatcagcacatgggacgtcctgcaagacagaccatatgataggccacaaaacaagtctcaataaatttaagaaaatcaaaattatatcaagtattctcagaccacagtggaataaaactggaaatcaactccc

SEQ ID NO: 397081 - DNA, 421 bp, Homo sapiens
ggtagcgtgcctgttccctttcagttgagactgttgaagccaaatttctgggtgtttaagtccctaccatgtgccccctgggcccagcctcagagggttcactcttagtaagaagctcacgtatggggcactgctggccatggagtgcccgcgtgggccttgagcctgggctccatctctcttcatcttgcacgtgtggaaactgaagctcagagcagtgaagcgcccgggtcacttagctagttgtgaagagctgaaactggaatccgggattcccgatacctagcccaagagtctgggaactgggagaaggcagaagctttggattccttcagtcctgggttcaggttctaaccctgacgctttctagctgagtatcttcagtcaagtcggtttccccttctgagccttaatttcttca

SEQ ID NO: 397082 - DNA, 308 bp, Homo sapiens
gtcagctgctatttgtgctgttacgtgttcatcaccagctttctggagacacaaactcagtattcaattatacacttttttttttttgagcttccagagtgcttattgcaaaataacaaaaagattttaactacctgtaccatggcagacctgtgcagaccatctctctgttctgtcagcaccactcagccacttcatgtcactgaacctgcagttttccaccagctgcgggaggcccagcggtgtcttgcgtccggcaggccatggcttggaccacagcacagctctctggcacactgaggggctgg

SEQ ID NO: 397083 - DNA, 450 bp, Homo sapiens
gttaatttcttgggaaatataaatcatcatagctagtcattctttcatcgtgggaagctaacagtcctgattgttcaggattataattatagtaaattctgaatttgtgacgtgtgaattttagaaggttacaaaacaacttccagacaactgagtcataaagtttttgagagaagtatgtggcacacgtctaattcattgtcctttctctccagtggtatagttatgatattaacctaaattgcaaaaggaatcgttttagttgactgctgcttgaaattgtgtcacttttccaaatttaggtaatgtctgttacaaggagtatattttggaaacattaacttgactgatacttatttccctggttaagtgaccttcctgccatgtgctgagtgccaggacttactgcccctcagtaatttggaaggggatcctgggccctgcctggaa

SEQ ID NO: 397084 - DNA, 418 bp, Homo sapiens
agctcggtaccccaccactcctatagatcagtgtaggtgtttgagtgttatataataaagaatttgtctggtccacgtcccaggctcctgagatctactaagtccttggaattcctcaagtgacagggatgtctttgttattcattatgagctcctgggaccgtgcctgaatttatgctaatgaagtaactcctagatactttctggatgggtgctggctgtgctgtaaaggtcaaccatgtggccgggcatggtggctcacacatgtaatcccagcactttggcaggccaaggcaggcggatcacgaggtcaagagatcgagatcatcctggccaacatggtggaaccccatctctactaaaaatacaaaaattagctgggcatgactgatctataggattaatcggtagcgagcct

SEQ ID NO: 397085 - DNA, 235 bp, Homo sapiens
ctgagcataccactttctttcaggtgaagttataggactgttaggacacaatggagctggtaaaagtacaactattaagatgataactggagacacaaaaccaactgcaggacaggaggaggattcccctggctgagaaccactgccttattgcaagataaatcctataattataactatcactggcgaaacagaattctcaacaagtatctattcctttgaatgtttggatcaa

SEQ ID NO: 397086 - DNA, 195 bp, Homo sapiens
acacagttagcatatcccaaactttattacccctctgtcttttgtcccccaacttcaaaacccatctcctatttcatttttgtatttttcttatattttaaaaactttatttttgaaataatttaacaatgacagagaagttgcaataattcagagttcaacactaattcagcagttattaacattttcccacat

SEQ ID NO: 397087 - DNA, 362 bp, Homo sapiens
ccaggaacatgttaaaagtagatgagatcctgaacggagggcatcacctccaaagcccgtgtcccagttgacagtggaaaggactcagagagatgcctctagctcaggtgaggagtggatgtgattttaagccaaggtggaaaacaagtggggaaactggttctgctgttaagagcccaacagctgtggctatgtgtttggattttgcgactcgaatcaggttcattaattatggccaaatgttagcaagagtttataatgataagctgtgcaaagagtttcaaaaattacaagtatttctgaattgcttacacggacattggtagggaaagagaagagaagatggaaaacaaggaatatac

SEQ ID NO: 397088 - DNA, 333 bp, Homo sapiens
aacagttcaaatggctctcttactaacaaatgtcaacgtccttatgtgaccattctgttccagtctctgtaccatccattcaagcctgctagctttatcctgccaaagaaccacgacgctccaaactcacaaaccattatacaagcccaacatatactctatgccgttctcgttaccaacacgctccaacccaacgtaaaaccttcctagtatcaactcttcctttatgagcttttcccatattcctactccctcaacatctaccggcccatactcccaagtctctctgctaaacgcaattctagcccggagtcacaccctctacagcctaat

SEQ ID NO: 397089 - DNA, 373 bp, Homo sapiens
caacacacaatagatttactggtaatcgtttgattttttcaaaagtactacattcctgtataatttgcatgattaaaatgtatttaatataatttccacctgtgataattttcttgtgtataaataggacattgctcttgctattagcagctatatactgtaatatttatagttgaaccacagggtttagcagacttcagcccatacactgaacctgtcctattgcctgtttttgtacaacctgcagctaagaatgtttttatattttttgaataatacaaaaatatcaacagaataatagttcgtaaaacaaaattaacaaaatttaacatttgtgtctatgaataaagttgataatattgtaaccacagcc

SEQ ID NO: 397090 - DNA, 321 bp, Homo sapiens
cgggtggatcacctgaggtcgggagttcgagaccagcctgaccaacatggagaaaccccgtctctactaaaaatacaaaattagccgggcatgatggcgcatgcctgtaatcccagctactcgggaggctgaggcaggagaatcacttgaacccggaaggcggaggttgtggtgagccaagatagcgccattgcactctagcctgggcaataagagtgaaactctgtcttaaaaaaaaaaaaagatatttggagggaaagtcgccccccgtccacttcccttttatagcctggctagttgctgccctgctaatagaaccat

SEQ ID NO: 397091 - DNA, 820 bp, Homo sapiens
ctttgagcacacactattaaatatttttatgctgcctgcccttggcttatgtcaaagcatcagcatgtaactttatctaggtaccacagggaaagctactttaaatatgaagacttctggagaaaatttcttctgcagttcctgaaattcacatctagacattgaaagcgggatgtgcttgtgctgatcttaaggaagctattctctttttttttttcattgagatgaagttctgttcttcttgcccagggtggagggcaatggcatgatctcagctcactgcaacctccgcctccagggttcaagcaattctcctgcctcagcctcctgagtagctgggattacaggcgtccgccactacaactggctaatttttgtatttttagtagagacggggtttcagtatgttgaccaggctggtcttgaactcctaacctcaggtgatccacctacctcagcctcccaaagtgctgggattacaggcgtgagccactgtgcccggcagaagctattcttttaaacagaagaaaaatctataaattcatcaggtgtaataaaatcaaatccttaactctaaatgacagtgaaaccagatgataaagtttgttgcttataaagaatctaggaataaaaggcccttttgacttcagtttttcatataaaaaatggagataatagtacttccctcatatgggaaaggttatacagcacaagctacagggcctggcacatagaagtacttgacagtagttgctagttatggtggtgatgataggtacttaacaatctgctatagatttcagcagtagctcttctcatg

SEQ ID NO: 397092 - DNA, 429 bp, Homo sapiens
tctggaaagcagggtcatctaattctcaccaaagttaatctagggcaccctagaatattcctgtcagaatccttattcttgcactgagaatagttatgtccttgtgctatgactggacagtgatttgttcatatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgtcatttgtggcacttgtgttggttttaatttcatagtcctctcaagataggaa

SEQ ID NO: 397093 - DNA, 447 bp, Homo sapiens
cctcaccttatggacaaatttgactttgcttcagaaatgtctcgtgattataattttgtgtctgtttcctactccatgaaaatttgcagttgcaatatagggagctatttaaggagttgcttctgttcgtttaggagtaactaattatccatccatccatccatccatccatttgtccatccagccatccgtctatccatccatccatttgtccatccatccatccatccgttcatccatccatttatccatgcatcctctgttcatctatccatatgtgcacttgtctatccattcattcatccatccatctgcccatctatcttccatttgtctgtccatccatccatttatccatccatccatctgtccatttaatcatctgtctgtccatccatccatctccatattcatagccctgtatcccttaatatgtttggcaggagg

SEQ ID NO: 397094 - DNA, 347 bp, Homo sapiens
agcagcttggtgcaaacatatcatcctctctcactaactgatcaccctgccttaggacacagaaaaggaacatcccttgaaggcaaaatgaaactgttccttcttagaactgctaaagctgttggccagaaagtgactttgagaggtcataaagtttatatctctatcttcaagcaaaatcacacctacatggaactttcccagcctaaagacctccaaggaaggaaggcgacaactcccccgtcttccttgtgagttgctggtgttctagggtgtgtaactttctggtcttactgtaagagcttgaccctgaggcacttataaacacatggttcttaccgttccta

SEQ ID NO: 397095 - DNA, 509 bp, Homo sapiens
tccaagtcatgaaattatctactatcgttgttatcacattctggaagtgcaggtcttgtttcctgcacttctatttctttgctgaaacttactttttctaatggttttaagagtatttgggattgcctgtggagtgttttcagttgccggttgaatatttcagtcttttgtcaaataattgcaacatctatgtcatctcagcactgctgtcttttcctataagagttgagattttcctacccctttatatgccaattttgaattatatccattttgaacaatgcaaaattacgttttgaaaccttcaatcttgtttaaatcttacaaatactgaaacttttgttttagcagatagttgacgtaattagattcaggctgcaagctgcaacctgtcttctgagctgtggttccaatatcagttcagttttcaaagccctgcaatgctattatttaatttttatttttgagacagggtcttgctcttgtcacctaggctggagtgcagtggt

SEQ ID NO: 397096 - DNA, 291 bp, Homo sapiens
atgcccagctgagaaatcatcttttctaactgcactttagaagttaagctgcatcacttcctctgcattttatttgttgaggggcccagtttcaagatgaagggacatagactctgcctcttgatggcaagtgtatcaaagaatatcaggtttataaaaaccgtaagttttccaacagtccagagaggaggtgatgacagcctagattgaggtgtgagcagtagaaggggagaagcagttgaattctggatagattttaaaggtggaggccaggtgcggtggctcacatct

SEQ ID NO: 397097 - DNA, 416 bp, Homo sapiens
tttttttgtagagaaagggtctcactgtgaatgtcacccaggctagctattttcaaacatttattgctttggaaccagagcccatatgtggataaaggtaggtagcattactcttgatgatgcaggcatgagtgatgtcctctccattccccaatcctcgagccccttgaaatgctatttgaggaatgctatcaaaacaccagtgctctttgagagaatggtgcaaaaatttaaaaaaacagcctttggctgggaatggttgttcacgcctataatccaagcattctgggaggctgaggcaggaggatcgcctgaagccagctggagaacagcccagacaacatagcaagacctcatctctattttaaagttataaaataaaataactgtggccgggcacggtggctcacgcctat

SEQ ID NO: 397098 - DNA, 557 bp, Homo sapiens
aaactatcggctaggtacgaggccctgggttttacacatccacagtggttaggagtagaggactggatttggtgagagaagtggggacttaaagagtataagtaagggactttgagcagagagtggggaggctgtgggtactagttgaaataaaatggccaatgggcatgttcggggtgagcagctggtccactcactacactctaactggaatccatgtctatgtatgagctcacggttttgcattttctttcacagtaaaacattttctgtgatgagcttctattgtgagtgcagcactttccctatggtcagttctctttaaacactgtacctcctcccaggcagtgcttctctttatcttatcctcaggctgtgtttcctgttgtttcctatttacagaagttagaagaagagagatggagacttggacctcataaatgggtgtgggctgcccaccaggtcttagaccaggttggcaggaggagccaaaactgcttcacttcttcttacttagtgcatgaatgtggtagggctggattcacttataccaccgc

SEQ ID NO: 397099 - DNA, 395 bp, Homo sapiens
aagctgatattaaatccgggtctcagcaggagaattaaggtatttaggatcagaggagaaaagatgtaaggagaatagcattaggtgaaaactggacaattacaacttagaaaccattggtagataatctccttaggtacattatcttaactttccaaaacaatgctgcagtgtttagtttgtagcaatttgttggaaggtagaaataaaccttgcagtaatttctttattgttaacttctccttgttatagactatgaaccttgtaaccatgagaggtatagaagaataatagatcatgtatttttagatacgtagctgttaagatccttaagggaaagaaacaagcccagttagtattctgtatcgcaccttgcatatgctgagtgttcaata

SEQ ID NO: 397100 - DNA, 255 bp, Homo sapiens
cctggaaggcagaggttgcatgcagtgagccgagatcgtgccattgcattccagcctgggggacagagtgagattctgtctacaaagtaaataaataaataaaaattaaaaagccctacatgatctgattctcactaactgacctcttctcccgcttgtctcccactcggcactttccattccagccttccttacctccttgctaatccttgaacgtggcaggcacatttccattttaggtctttgcactggact

SEQ ID NO: 397101 - DNA, 574 bp, Homo sapiens
ctgtccctgtgcagatgttggtcacatctgcctctgtcctgacactggactcccaggctgtaactactcagctccttcagccccctgggcttgatctccttgaaggcagggatgcagggaacaaggccgggagtgggagcagcctgtgtgaattctcaatccctgggggaagggggagggttgggccccagggacagcagggactggagctgggtgctagagagcagagcctgttgggctgcatgcagggagcttgcgaattttggggcggggacagggcctggagcaggtataaagggctctggcatcattgtgctacttctttctgtgagtccacgttcactgaccatttggggtgtacccagcatctggcggatcactgggccttctgggagtacaccatcaggcgggagagacagtggacacagaccgttaccatgccctgtgcccattttgctgcttctctggggcccagaaggatggatgctgagttaggagttagaactccttcatttgcttagactctgaggaacaaatgagatgacgtgggtataaaaactccttgtaaagcatt

SEQ ID NO: 397102 - DNA, 553 bp, Homo sapiens
atctgacaatacatgagaaatgtttcataattcaacaaaaatttattaataaagtttatattttccatgcagacttttgtcctatatttcactaaacgtatgcagttagaatactgtactcaaaattattttaattaattattttgtgtaatatattacatacacatccatgttaggtttatttgttcatttgtcttcaattttcaggtttgcttatctctccctcatccttttcatttattattttgactatatgtaaaacatttcatggttcaaaatcaaagctataggctgggctaggtggctcatgcctgcaatcccagcactttaggaggttgaggtgggtggatcatgaggtcaggagatcgagaccatcctggctaacacagtgagaccctgtctctactaaaaatacaaaaaattagccgggcatggtggcacctacctgtagtcctaactactcgggaggctgaggcaggagaatcgctgctacctgggaggcggaggcagtgagctgagatcacgccactgcactccagccttggtaacagag

SEQ ID NO: 397103 - DNA, 641 bp, Homo sapiens
tggcaaaaccccgcctctactaaaaatacaaaaattagccaggcatggtggtgggcacctgtaatcccagctactcgggaggctgaggcaggagaatcgcttgaacccaggaggcagaggttgcagtgagccgagatcgcgccactgcaatccaacctgggcaacagagtgagaccccatctcaaaaacaaaacaaacaaaacaaaacaaaaaagaaaagaaaagaaagaaaaagaaagaaagcctatacctggaatgggctctctctggatttgggctgaactggctaggatgtctacccaaaattagcataaatcatcaagtcatttagtcatcaaatatttattgagggcctattatgtgtcaagaactatcctaggtgccagggatacagacatgcacaaaagagacaaaaatccctgcagtgatgggggcctttattctaaggatgcagggacaggaaagagtgcgtctgcgggagggcctccagcatttctctacagagagttcccataggagaccgcacggcagtctagagctcttctctggcccacccaggcaacagcctaggttcggggaaacaagaccacagcgggttatagccctcacatccgaatcttgtaacagtcccaaagacacag

SEQ ID NO: 397104 - DNA, 344 bp, Homo sapiens
aatgttaggagaattaagcatgtgcatgagactccactgtaagaggatgcctggaaactctattcctttgctgaaataattcctattcctttgctgtaataaactgtaactgtaagtataatagcttttctgaatcttgtaggtctttccaatatatcatagaagctgaggatggtcttgtgaccccctaacacagagagggagaagtcaacaggtgcaggataacagcttaaggaaaagaaaacagggaaaggccgattcctgcaaatcctatggggtaactgtaaagagaaatgatttccactgtctggaagtttaagtctttattttccaaaataaaaatg

SEQ ID NO: 397105 - DNA, 305 bp, Homo sapiens
tctgcacccaagtagctgggactacaggcatatgctaccacacccagctttttaaatttttgattttatttatttttgagacagggtctcactctgttgcttatttagtctcacccaggctggaggctctactgctcatcatagtaacacaattacagttcactgtggtcttgacttcccaagctcaagtgatcctcccaccttagcctctagagtagctgggactacaggtacacaccatcagacctagctaattttggtattttttttgtagtgacgggatctagccatgttgcccaggctgg

SEQ ID NO: 397106 - DNA, 136 bp, Homo sapiens
atttcaggatggactgtgacttggaccagtctggttccaagtacccctcacccaagccagaagaataaaagatgcaggcttccattggcaggtgctgtgttcacccctgaaacgggggacccatgggtcagatcaa

SEQ ID NO: 397107 - DNA, 504 bp, Homo sapiens
agtgttgggattacaggcatgagccaccgcacctggcctcaatttggtacttattatttcagtacatgtttttatacgtgtagctctagttattcattttaattgctttatggtatttccttatgaatatatagtaaatacctaaactcttaaagatggatatgttggttattttcagtttttcaccctaacattttccattttgtttggtacacatttccttgtttacttgtataagaatttttttaggaaatacatctaaaagccattttcaacatggctatgtccattttcaacattaagggttgttgcccagttgcagttcagcaactggtatatagtttaaaccctcatgaaccagcagtgtatgagaatggctgttgcactatattttcctctatagttggtcttacaagatttaatttcagtaatttacagcatgcaaaatgtcatctcattgtctaaatatgtgtcttccagatttctagtgagattgagcatcat

SEQ ID NO: 397108 - DNA, 445 bp, Homo sapiens
ctccatcttgacacctcattcctaaaacttctcagctttggatctcatgtccctgaaataatcttctcttataagcttgtcctcctaccttctcttgcaatcatccatctcatggtcatatctgagaaaggaaaaagcagctctcaataactgatgggtaggagcttgtctggatctaaaagtgaggaatagtattctcttgtcaaatataaagtttcacgatacactaatgtcagacaaggtcactctatgactgtgatggagcttaacaataacaagtccactccacaatcacatttgagcacatacattaccaaaaacacagtttttcttacccaacatctccctctgccagccattatgaggaaagctgcttttccaccaattacagccctacccccactttgtttctctttgctcctagatagaaagtcctaagataccc

SEQ ID NO: 397109 - DNA, 140 bp, Homo sapiens
aaaacacaggcaaagagatgtggcatccaacacatggtagaacaaagccttgaatttaaggaaaattaacaactgcaagtctaggaagccatgaggacatcagtgagtggaatccgcaaagaatgtcttcaaaaagaatg

SEQ ID NO: 397110 - DNA, 384 bp, Homo sapiens
gctgctgttgaaatttttcctcctctagacttgtgccatggatttttctggaccattttaatgtctaaaattagtcacccttaaatttcaccatatgtggctgggcttggcagttcacatctgttatcctagcactttgagaggccaaggtggaaggatcacttgaggccaggagttcaagaccagcctggaacatagtgagagcctgtttctacaaaaagtttaaaaatatccaggtgtggtggtttgcacctgtagtcctagctactggggaggctgaggtgggaggattgcctgagcccaggagttcgaggctgcagtgagctatgatcatgccactgcactccaggctgggtgacaaagcaagaccttgtctctctatta

SEQ ID NO: 397111 - DNA, 548 bp, Homo sapiens
ggtatgcatgtactttatattgacaagactaagaaggttcacccaatacagggagactcccatgtgaagacaaatcctaatcactcctctgtcatgcagaaatgtcttgtaaatccttgaattacagctcctttgcttcaaggatttaaagctctatattctcccctgtctctggcagcagcccgagtgctcaatgggaagacctaagcctgaggttcaagccccaggtctgtcagttgccatccgtgactttgggtaagtcatgaattccccaggtctcggatttcttagctaaaaaacgaggataataccacttcttccaacctgtcagggttgttgagaggatgaatgcaagcaaacttttgttaagtacacttgcctaggcatggtaggatccaaaaattagtaagacactggccttatcagactcatgcgcttttagggtgtttagacttcaataggtaacttcattatgatatgagaagaaacagcttagatctaaagtgttctgtaaactctaaagtgttatatacttgtgaaaaaagaaa

SEQ ID NO: 397112 - DNA, 665 bp, Homo sapiens
attgtctaactcaaggtcaataatgcattttcttgcataattgttaaaattttaacaacatttggatttttatctgtatttttccatttagtatgtgctagcagctaattttgttttgctatccagtactatttgttggatagcagtattgtgtccattcaattataattcttcttcttttatataccacatacctataaatgcttgaatctatttctgggtttgttatactgttgtgtttgttactgtacctatagcatactgtttaaattgctatagcattgtggtgttttgctatgtagtaaccaagttcttccctctttcttttttcttttcctttttttttttttggggggaaattatcttggctaatttttcatacttattcatggaactttaggatttatttaagatcaagttttataaataattctattggaacttcatttttgagtgcaatgaagttgtagtgaattttagagagctgacattctcaaaatattgaccattccacacatacattaatgttatagtaccatgtttgtttagatttccttttatatcctttagtaaagctaattttctcaataagctcctgtaccattttttgtttgctttattcccagatattgtttatcatagtagtgaataggattttttttggt

SEQ ID NO: 397113 - DNA, 410 bp, Homo sapiens
tgaagccatcttttcctattagacatcaccttggggtcagagaaggaacacaccactccaggcctgtctcccaggatcctaggactctgtggaatgcatccctttccctagaaaaagaagacaaacttttgctttggttaactttgttaattttatgtgtcaacttgactgggccatgggctgcctggacatctggttaaacattatttctgggttgggctgtgagggcgtttctggaagagattagcatttgaatcaagttaaacagttaacttgattggactcacttaagcagtttgcccttcccaaagtgagggtctgaatatttattgacaaaaaggcagaagaaggttgaattctgtctctctgcctgacttgagttgggacatcagtcttctcttggtcttgga

SEQ ID NO: 397114 - DNA, 333 bp, Homo sapiens
gagtaactttagggcatattttggagatggattcccaggacttgttgatagacatgtatgtggagtggagagtcatgctttggcttaacagagtagtgacgtttactgaaactggtaagattgggagaggattaacagctctttgatgggcttgagatgcccactagagacacaagtggagattaagttaggcagctggggctcctgggaaaacactgagatgaacatataaattaggcaattatctgtgcctagatgatcttcaaagccatgggcattcccagccttgagatggttatttttcactgtaaattaataaattgggtaacttat

SEQ ID NO: 397115 - DNA, 408 bp, Homo sapiens
tcattccctgataacaccaaaatgaccttccctggttatataccacaatgtaaatactttattttttttttttacatatacttgattgctccttgtctataggttacaggagacttgtcactcctgttctccaccctatctccagtatcttgccaagtgccaatcatgtagaaagaactaaagcaatgtgttttaaatcaattaatggactgactgttacagaaaacaaaaatttgagagcatgcttcagaagaagaataagaaggaactggattgtgggtgtgtataatttgagacaaaagcatccaaactaagtgaagataccccgcaagttgctgtgagatttgttctcaaaccaaaaaggggtcagggttggagtcgtgggtgtatagaactgggtgtcatctc

SEQ ID NO: 397116 - DNA, 939 bp, Homo sapiens
atcgcgtctgccagggctgtagagctctaagcctactcctcagaggcctccgtgaactccctcagaggcggtgactttggtattgaaatcagtgcttcaagaagcctttttgtagcctctcattttgggactttcccggagctctgggacattctaccctccctgtagtctccctccccgacaaagcagaccagatctgcctgcagagggtggggctgaaccaagtagtgtctgagtttgagcccttggcatctagcgtccatgtagacaagaggctctcctcagctgcaggttcatcttcaggacctttctgttaccccccccagacaatccagacactgatgcgtccaaagcaaaaaaccccaggcctattagttaaacacgattgtgtcgtctccccacctcaccttggaggttcggggaacatattagcatattagcatattaaagactacaaagtctgtagtgaaaacacctgtttaatcttaagtaacacaacattttcatactgacccgacctgggcagccctctccttgtggggggcagctccttgcctgggcacacagagataagaaactgacagggctcgtgggatgccaagtagggatttctctgagagaggggctcatgggccaggcctttgggaatcaccacagaaatggaagcctggtgtgtgcttcctggaggcccctgggcgaggcactggctggaagggagaagataatttgctcatggaggtgggggtgtggctggggtcaggagcctcctgcctgtgcccacctcaagcttaagacctgaccctcacagctcctcagcaagggaggctctaggccagacagtggctgcccacacccgcagttctgaaccagtattttgggatgcctcccctaaaaatgtgattcctttcctttccattatgttcctgctttgtccattat

SEQ ID NO: 397117 - DNA, 289 bp, Homo sapiens
tttaaatgggaaaggcagcttttagaaaacgtgggagaatatctttgtgaccttgggatacacaaagattgtttaaacaatatacaaaaagtacggccgggtgcggtggatcacctgaggtcagaagtttgagaccagtctgtccaacatagtgaaaccccgtctctactaaaaatacaaacaaacaaacaaacaaacaaaatagccaggtatggtcacacacgcctgtagccccagctactcaggaggccgaggaaggagaatcgcttgaacccgggaggcagaggtt

SEQ ID NO: 397118 - DNA, 983 bp, Homo sapiens
tctcgcttaccggtcctcctttaccttctcttagcttctctttaggtcctagggaaaaatggagatggcagtatctttattttagggtcgtttgaaggattagcaataatatgtatcaaatgcttggccaaagtgtggggcacatggtaggaatgcagtggcagcgattattatcatcactttaattgcaaaactggaagttcagattccaggaggaggatgtagttgctgtggactggccttctcaggcaaaacttcacttggaataggcttggaagactgtataggagttacatgaagtggaatggtttgactcaaagtgcagaaatgggactacataaatctgttaggtttcttgaggaagtaggggagatcaggtaggggaagggcaagaaatcctacttactaggaaagatggcttcctagctagtttggggcacaaatactcaacagaccattgctatggtgaaaatggtagaaatgagaagagcaatggagggaggaagacctgtgtcatgaaaatacttatctgactgttcagcattattgatattgtggtctggatgactctgtgtcatggagacttgccctgtacattataggatgtttaacagcatccctggcctccacccactggatgccagtaggtagcattcttcacccccatacacatgacagtcaaaaatatctcctgactgccagatgtgccttggtggggtcactgaagaccactgctttagtaattagactaagcatcagtgaagatgagattttcatttcagtgttggaagggagaaaggagtggagttcatttaaaataatagaatgaactgctctaattatagaggtgtagcagaagtaacatggttcagagcattgacagcaaggccacttataagctgtatggtctttggcaaataacctgttgtacttcagctccctcatgtgtaaaatgggggcaataattgcacctaccttaaatc

SEQ ID NO: 397119 - DNA, 519 bp, Homo sapiens
caaaaacaacaacaacaacaaaaacggtatttcttcaagaaaaggtatgaacgttcacaataactgggtaaggattgaaaagtgttcctcggctgggcgcagtggctcatgccagtaatcccaacactctgggagcctcaggtgggaggatcgcttgagcccaagagttggagatcaacctcggcaacacagtgagacctcatctctacaaataattttaaaaattagcccaggcggccggacgcggtggctcaagcctataatcccagcagtttgggaggccgaggtgggcagatcacgaggtcaggagttcgagaccagcctgtccaacatggtgaaaccccgtctctactaaaaatacacaaaaaatgaaccgggtgtggtggcgctcgcctataatcccagctagtcaggaggctgaggcaggagaatcgcttgaacctgggaggtggaggttgtagtgagccaagattgcgccactgcactccagcctgggcgacagagcaagactccgtctca

SEQ ID NO: 397120 - DNA, 372 bp, Homo sapiens
atcccccccccggaatcgcacggagtcctcggaggaggagcagcgacctatgcgtgccgcctgctcctcactggaggagcaggggccttctgtgactggacagctttgctccgctcccaccgcccccgcccctcccaggcccggggactctagaggccagcacgtctgcgacacccagccagagtccccacaaggagaacagggctctcctgagaatcagggcggtgcctgacggcgcaggcacagaatagggaccacagttctgggctctcctgagaatcagggcagtgcctcacggcacaggcacagaatcctgagaatcagggtggtgcctgacaggcacagaataaggaccacagctctgggtgtttc

SEQ ID NO: 397121 - DNA, 405 bp, Homo sapiens
tcgtactgaagttatgaaaagtctgtgcagttcttcatgcacatctctcagagaagcaaacggaagaccaaggacacttctgggacagcagagtgataaggagacaagaggagaaagcaggccagctccatcccactcagtccctcccacacaaacagatacccctcccaggcccggggactctagaggccagcacgtctgcgacacccagccagagtccccacaaggagaacagggctctcctgagaatcagggcggtgcctgacggcgcaggcacagaatagggaccacagttctgggctctcctgagaatcagggcagtgcctcacggcacaggcacagaatcctgagaatcagggtggtgcctgacaggcacagaataaggaccacagctctgggtgtttc

SEQ ID NO: 397122 - DNA, 473 bp, Homo sapiens
caaatagcacaattctaggatgatatactaaccaagagcactacggagcataaatgtttaagcaactgcagaaatggaagctgtaaaaacaaatgattttgctattgctaaatcatgactaaaataactcctaatgttaaaaagctaaatatcaggtcttatacaatcttatctatatcctattgtaatgttttacacaacttttgttttagcactttttaaccaaaaaatagttattattaataataaaattatgggccaggctcagtggctcagtcctgtaatcccagcactttgggaggtcgaggcaggtggatcacctgaggtcaagagttcgagaccagcctggccaacatggcaaaaccctgtctctactacaaatacaaaaattagctgggtgtggtggcacatgcctgtagtcccagctactcgggaagctgaggcaggagaatcgcttgaacccaggaggcaaa

SEQ ID NO: 397123 - DNA, 475 bp, Homo sapiens
tgtgaatactgaattaaataattcacaggagtagtttagcacagtggctgaagctctcaatcaataacagctacctcagtcaataaccatctactagtagctatctgattgctactctagagggtatgctccattcaccctatttcaaggttagagaaaacaaggcggtttgccgaggtcacatagctcacagtgacagagccagaattggaacccaggcctgagttggctctgctcatgagctctgacgtgtccttcaacagggaacgcccacggtgcccctttattggagccgcagcagtgctggagggaagcagcgtgtgcagccaggagaggacttgctctttcctttgaatgccaaaatctcaaggaatgggcctgggcatggcctgagcctgggcaaaggtgactcttcacagatttcctttttgttctaagcagcaggcataggaggagtctgcattcccggagcgtg

SEQ ID NO: 397124 - DNA, 232 bp, Homo sapiens
ccaagatttcgtccctgccctccagcctgggcaacagagcaagactccatctcaaaaaaataaataaataaaggaaagaacattacattttctcttccactgtggaataaatacgaatcttgaaagcatggatatatttttccattgcaaatagcttgggttggaaatgacaagccctatttcttattccatccttgtcagggtggtaataggccagtgactgaatcaatta

SEQ ID NO: 397125 - DNA, 389 bp, Homo sapiens
gttttttgttttctaaccccctgcattcataattctctttttttaaaaaacaaaacaaaaaacatcacttcaacctctttttctactgattcctttccagaagcctctaactaggttcaatctccctcatgcccaatacatacatgctgccttgatcccaagctttcgctagctatcacaacctctccatcactccctttccatccaccactcttaaaggacactactctagttaccaatacattcccactttcccttcatcctgctgcctcttgaattctggcttttgctcgcaccactccacagtaactattccgacaaagctgtttcaaacttcctattggattgcttgccctcctccgttgcttatgggcttcttctcttttatg

SEQ ID NO: 397126 - DNA, 199 bp, Homo sapiens
gttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaa

SEQ ID NO: 397127 - DNA, 430 bp, Homo sapiens
gtcatatctgttcgggttaaacgaggctcatcgcaaaataccaggacacaagtgaacagaattatgtaagagaaactaataaaatttacaattaactatacattaactaatcgatttaatttgctgtgaagtggactagtaatgtactcccatttaattgtcactccctagaaatttcatggaactttgaaagtgtgataatcctccagaggtatactcaaactaaaaaacaaatacgtaacacaagaatgactgtggaaccaccaaaacatatcatgtatatggaaatacccaaagaaacatttttcaagataaagatttaaaaactcagaaccatatatatatgtgtgtgggtgcatatgcacgtgtgtgtgtgcacgcacgcgtgcacatgcgtacgtatcagaaagtcctgaaatacaggcagaat

SEQ ID NO: 397128 - DNA, 441 bp, Homo sapiens
tgagacggagtctcgctctgtcgcccaggctggagtgcaatggcgcgatcttggctcactgcaacctctgcctcccaggttcaagcaattctcctgcctcagcctcctgagtagctgggattacaggcgcccccccaccacgcctagctaatttttgtatttttagtagagatggggtttcaccatgttggtcaggctggtctcgaaaccctgcccttgtgatccacccgcttgggcctcccaaagtgctgggattacaggcgtgagccaccgcgccaggccgcctctgaggttttaaaatctctaagcttctcctgtttcaagtttctttgtaacagcgcttgtcaaccttggttgcactatccaaatgtccagcctgtaccccagaccaattacatcagaaactctagggggcgacccagatattggtaatttttaaaa

SEQ ID NO: 397129 - DNA, 209 bp, Homo sapiens
agtttcttcaaggtaaaaatcataaaaagaaaatttaaattactggtcttccttaaggactggcaaaattcttggagaaggaggctttttcacctttaacccaattttcttcagaagttactctgagtgatcttttagatactttagcacagtcagttttcttcaaaagttaatcattgtaatattttagataagaggaaccaagaagc

SEQ ID NO: 397130 - DNA, 434 bp, Homo sapiens
atactttaaaatggaggaaataaaaatgatttatataagaatgatgtttctatgtattactaaaagtttaatagtataaattggaagatgatttgaataattaattttccatacacctatatggtaaacttacaacaacaataaaaagtctcaaaaatatataataaaataattcattagtaatctaaagttccctattttaaaaaatattcttgcattgcaaaataaagcaataaagaaaaatatttggaaatatataaaacaaacggtaaaatggcagacataaatagaattataccaattataatcttaaatgtgagcagattaaaatccattccagaggcagagattgtcagaccggattaaaacaagtgatcccaatatacgctgagatgcaaggatactaacggattgaaagtaaaaagatgacaaaa

SEQ ID NO: 397131 - DNA, 246 bp, Homo sapiens
tatttcaaataaaaaagaaggcagagaaagacccagaggaaatctatcaatcaaccacaagctatatcagcaaaactcatcaacttcattcctaaaactatgtcgatccttgagcaatgtaggggttaggggtgctgaccacccactcatttttctatgaggagaattctttctactctcttagcaattttcaagtatataaatccatgtatactttttttttttttgagacagagtctctccctg

SEQ ID NO: 397132 - DNA, 610 bp, Homo sapiens
cttgatggcctgcagactctgagagccaccccggcttcccagtgacctccttccactcagcacccccttcccctgggagaccggaacgaaccacactgaaatgagcacgtcgaggtcactgtcgaacccaccgagggaggccaggacagcctcatggccaggctgagccaggagcccagaccagttcctgccagggagaggagccaccaacttcccctagtatctccctgctgtctcagaggctcatgttctggaaactatcattgtctttaaggtgattttatgtatattaaagtcacgtacagtagtgcccttatccacaccttcgcttgctggagtttcagttacccatggtcaaccaaaggccaataataggtgagtacagtacagtaaaatattttgaggacaggcatcgtggctcgtgcctataatcccaggactttgggaggctgagccagcagaattgctggaagccaggagttctagaccagcctgggcaacatagtgagaactcatttctatcaagaaaaaaaaaaaaaaaacaattagctgggcatagtggtgcatgcctctggtcccaggaggctgaggtggaaggatcacttgagcc

SEQ ID NO: 397133 - DNA, 533 bp, Homo sapiens
cattgtacaatattcatctttatccctcttaatattcctttttcaaaagcctatttcattgatgtcaatatagctactgtagctttcttatgatttattgcttacatggtataatttttacctgcctttgacttttaatctatttgtgttttcatatctaaagtagatttcttgtacataatacataattggttcttgctttctaaaaaaattagcttaacagtctctgccatttaaatgtaatgtttggatcacttacatttgatgtatttattatatgtgtgtgctgaagtctattattttgctatgtgttttctgtttgctccatctgtttttttccctttttttctcccttctttcagaatatttgagtatttctgagggttctgtctttttctccatcttcattattgacctattagctatacagtgagtcttcttttaatgtcatcaatgaattcttggaaatggcaaatttaagtgaaacaacacacagcaggtccttgaataacattgtttcattataacattga

SEQ ID NO: 397134 - DNA, 753 bp, Homo sapiens
tgcaaaatcatgaataatacaaaaggatgttaaacttttcaacaaatccagatgggtaccaatgtcattgagaattcctgagaatcaccttgattgctgcttcagacctaggagcctgaattgaatatcacttaccagttggaagctattggcttaagtgacaacagtttctacaataacattggtatctatattgtttacttttaaaattgtacagacactaagtttgtgcaaataaaaaacatccaaactttaacattcagtcacttcccttgctagccttctatttcttctcccttatcatttagacgttggtgcaaatagaaagagtgatggattgtgaaatgtaggccagttttttcttttgagacggagtttcgatcttgttgcccaggctggagtgcagtggcacaatctcggctcactgcaacctccacctcctgggttcaagcgattctcctgccttagcctccccagtagctgggattacaggcgtgtgccaccacacctggctaatttttgtgtttttagtagagacagggtttcaccttgttgggcaggctggtctcaaactcctgatctcaggtgatccaccctcctaggcctcccaaagtgctgggattataggtgtgagccaccacacccggcctgcaggccagttttaacactaacctttgctggggccttgcaaatctcttcattttgcatcttagttgtcccttctgcaaaatgagagagttggactagatgtcc

SEQ ID NO: 397135 - DNA, 449 bp, Homo sapiens
ccaatttttaaatttataagcatctgtgttgtagcttaatgactttaacagttttttcctcaatcatatcagaatgtagtttgatgattatctgggtgaagagttttggtggtcaacgtatggctaagaaagttatatattaaagatgaagggttttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagccgagattgtgccactgcagtccgcagtccagcctgggcgacagagcgagactccgtctcaaca

SEQ ID NO: 397136 - DNA, 406 bp, Homo sapiens
ctcgtgatgagccggacccaggctgggcccagattagatgtcaaccgctcaaaagtcttcaacagctctcattactttgagggatattagaaattctttgctttgaaaagcaattttccaactgtgttccctattctgctgacatttatctggggcatcaaagcataccttctaagcctttacctcttcctcctcaaaatatttctcatcatcccattccaaatagaatattccagggggaacagggaagaggagaacttgaggggggttagggggttaagagggagaaggagagaaagaacagaaccaaaccactagcttcctatctcattttccatcacttgctcattccttttctacggtagggtcatactgaacaacctcaacttcccttaatgtgccatgc

SEQ ID NO: 397137 - DNA, 133 bp, Homo sapiens
tgggaaagactttaaccagtcctttagccttactaaactcatgagaattcatactggaaagaagtcatacaaattggaagactgtggcaaaatcttttaagtattgctcaaatatatccagccataattcata

SEQ ID NO: 397138 - DNA, 369 bp, Homo sapiens
aagccagaggactatttactgtaggccctattcagggacttgaacttggagataagaacgtagttatacacctcgggtcatccattgctaagcgatcaaccttaaaggactgctcctgtggagataaaagctgtgaacctgcaactggagaatgaacgtcgtgatggctgagggggaagagcttttgcatcactaactttcagagctgaacgagctccagagggaggtcactgggaatctgacgatatccctgtggtcagtgggtacctgactactttcagaaaggtgattgttgactgtttctttgaaggtccttggggatacagacccaaatccctgtctcctccactcttggtttgctgtgccatg

SEQ ID NO: 397139 - DNA, 464 bp, Homo sapiens
ccccttgatgtgacctgtgagcagcttcccaaggcaggaaattccagaagtgagtcagggccagggccctggagccacttccctgggtccccagaagcagcctttctgtggctgtcagaggggcatagctgggtgcacaccagggtggggccagtccagaagctggcagtattgatggagacccctctgtgtcccactccctgcttgggggagccattgaggcatagtggccagtgtgggaccctgcatctttagcatttgtatctgcagtgttgtgcacatacaagtgactctttttgttttaatctgttagcctagaggggcagagtagcagactgagtctccacggctttccactaccccagccttcagcattccatctccagcttctctagggacactcccactccatgaccacctattctgtggacttacagtgaggagcaattagctgtgtcagtcag

SEQ ID NO: 397140 - DNA, 720 bp, Homo sapiens
gaatacacttgataaccactgaatagaacactttaaggcaatgaatattatggtaaattttatctcaataaaaatataaaaaacccactaacattcatgggggaaaggcataattatttataattatataaataagggaatcttgaatcatgaagtattatataaatgagggaatcttgaattgtgaagtattaaaatgtgcttcagaaatgatcaataagtcaaccagtaatctaaatctcaggtatgaaccacagtttaatatgtttttattatggggtattgatgaattttaaaattaatttgggaaagtcatattgattatttaataaatatgcttatatataattggctagttttgtggttaaaaattaaggtggaatcttaactctcaccatacaaaaagtaatttccatatacattaaatgatatcatatgagttttattcaactttaaaggaacacagaggctaggtccttgcctggatcagtggtgaatttatcctgtgaaccaaggattatggtggagcatccacctcttcacctctagcccttcttctagtcttcattcgcttttcatttttccaattctttaaatttcctgtgttctgtgtgcatcctctcaccatcttttgatcaaacacaactctcaagtaagtttatttttttttatgattattttttgagacagggtctcactctgttgcccaggctggtgtgc

SEQ ID NO: 397141 - DNA, 775 bp, Homo sapiens
caactgaaacatctcacctctggaaaaactgtaaaaattgcaaataaaggaatttgggataagagggcatatgctgtatacaggcatcctcacaaaccgctgattataaagaaaggaccctgacagaatgtcaaaaatagtccacaaattggaaggcgtgcactgaggctccaggtggccatgatgcagcagactctgaactcctgtcactgcagagtcacagcatttggccgcagtagaagccagaacctagcaccacaaccaacatagtcacagcatggccaaggccccagggatgtggggaagcccaggaaggcgccctctcagcaccactggggccaaagtgaaagctggacaggacaaagctcccaccaaaaccaccatggccttaccctactctcactggggttcctggagcaccagatcatggatgctgcatcaaccagccccagcaaaggcgcctttggcacacaattcctcagtgctacagctgggctctgtgctgagagaaacgcaacagccagacctacccagtggcttttccaagttctcaggattgctggggtctagccaagtgaccaaaggcaaggaagcaacagacaggctccgccacaccatgggagcaatccggtggcctggcacagagtgagcactccacacatgcccagcccttccctgtgctcctcctccaggatgtcctctctcacgcagtgtcgctgccgtccttccactcacgtccatgctggacactggaccatcacctctgacccacccg

SEQ ID NO: 397142 - DNA, 426 bp, Homo sapiens
ttaagtgattcttctgtctctgcctctcaaaatgctgggatttataggcatgagctactgtgcccagcctctattttgttttatagcagcatcactgtgaagtggataataggacacatattatggctatttcactgtagaggaaacagtcggaagcactgactctcctaaagtcatcccatagctagtctctttaacagtgacaactgttaactaatccatagcagatgtcactaatccatagcctgtgacagcaacgtggaactctagatgtggcaaaacactgtgcctttttataatctgtgccattttcattttctgttaatattagtttcttttatgataacactctgaagataactgtattgtttatcacctttaactcttgtagttattggaaccagtttatatactagcattaaaaaa

SEQ ID NO: 397143 - DNA, 189 bp, Homo sapiens
aagagaaagcagcagaaactgaactgactaaacaactgcaaataagaaagcctcaggctgggcgcggtggttcatgcctgtaatcccagcactctgcgaggccaacgcgggcggatcacgaggtcaggagattgagaccatcctggccaacatggtgaaaccccgtctctgctaaaatacaaaaaaaaa

SEQ ID NO: 397144 - DNA, 251 bp, Homo sapiens
cgtgacaaaattgctgccaacaggccccctttgtctgcatcagcatgaatgcaaataaagtcagtgagcaaaggtacttcaagtccaagaaatcagccaacacccaagcaaaaatatgttaataggcctatttgaatcatgccagacatcaagacccctctttatactggagtcaaactctctgttttctttatactgtgtatgcaataaacagaactaggaaaagaccattcatgcaatagacaaagaag

SEQ ID NO: 397145 - DNA, 371 bp, Homo sapiens
ctgagacagtggctcacaagtgactaatgggcaggtgtggtctacagtgtggatacaccggacagagggatgattcaccccccaggcaagatggagcaggatggcacaagagttcatcatgctactcagaatggtgtgcgatttcaaacttagggagtttttcatttaatattcttggaccatggttgactatgggtgatggaaaccttggaaagtgaaactggataagacaggactgctgtgtatgtaaatccacgaaagaatgttattcagccataaaaagggagaaatcctgccatttgtaacaatatagatgaacttggaagacaatattgtaagttggtgtgagagggttggtgtgagagcgttgg

SEQ ID NO: 397146 - DNA, 499 bp, Homo sapiens
gtgtcttcaaacatccctttagtgtgctaccatagcaatagagaacagactattttaaaacgtttgagtactatgaaagcaaagcatgctttataatcaattgctttcctctagacaaaaagagcacaagagtagtcacacattcagactgtactatatttctaagtctaatttgtcctgtaagcataaatatttagatagaagaacacagaccaccattcctaactgagccatcaaagggtacaaactgaaatgagaagaaacggccttcaatatggcaatattttagttttactatttcactgaaaccccacaaggaagaatagagatgtagaattcaaacagcctagcctacatttcatctatcagtaatttaagattctgcagtgaaacctggcaggagtatttcttgaccatgttttgtgtaattataaaacaatcttaaacgcagcaatcaagttactgatgcaccatttcaaacccacaacactatgaaata

SEQ ID NO: 397147 - DNA, 377 bp, Homo sapiens
agcctccatgtaactgggactacaggtgcctgtcaccagaccaggctaatgttttacatttttgtagagacagcgtcttgctatgttgcccaggctggtctcaaactcctggcctcaagtgatgctcctgccttggcctctcaaagcactgggcaatgtccctggtcttcaataaatatttgatttatttaagcaaatcttttttctgagcacctactatgtgctaggcaccattctaagtacttaggatacatagataaataaaataaaggttcttcccttcaaagagcttacatgtcagcaagtaaaggaaaagatgagagaaaatataataaatcagtaaattatatatcatgtcaaaaggtgataggtgttat

SEQ ID NO: 397148 - DNA, 515 bp, Homo sapiens
acaaatgaagaggggcaggcgcaggatgtggtagcagcggaccataggcatgggactcaacctgtgcggagccccaggggtagagaaaggatggctattcgggatctataaatacccacaagagccaggcaggtgacgcatgtcagacactttggtgtattattcatttctatttttaaaaatgtcctccttcctgcttttcttgacttatacccacttatcctttatttttccatctttgattgaaacttaaatctttccctactcgaagaaaactagcagtccaaatccaattactgtatcagttcataagtgctacatggctcctgctgggaagtcaggtgggagtggcaaggactggggcaaactggagagcaaattcttctgctgaagaggacagccattcttcaactccagttgttcagaagctccaaatcttgcaatttctcagaaaaagcaagcaagcaacctgaattttgatacatgagtcaaatttttaaacagtgccttaatgg

SEQ ID NO: 397149 - DNA, 523 bp, Homo sapiens
attatatcaattatatctacttggtgtagacagcccagcctgtctttcagcataggaaaattggtcatgggtagatttttcagggtgacttagtttgagaccaagaaatagtcattgctgtttttgtcaagtataaaatagattccagaatgcattccttcatcctcgaaggcccttctcattagcattggacctaattatctagatataatttgttaaaggttttacacttctttaaagaaggctactgagtcaccagcatttaatattcattcattcattcattcattcattcatttaacaactattcactgagcacctactatctgctaggcactgaagatacaccaggaaccaatatagattaggtccaagctctatggatctcacagattataaccacagcaacatttgctatgtgtcattaagagtttgaaactttaatatcttaacctaatatttatatttttcttatcactaaagaaaaaactattatcaataaatttgataactgataaactca

SEQ ID NO: 397150 - DNA, 273 bp, Homo sapiens
tcagagcagatttaagtgaagttacagaaataggaatgtgacatttcctacaacgggtgtgctggagcaaaatgtattccctctctggtttgtggggaaggagaatgctaacagacaagactccaggttttcgctcttaaacctggtgcctagaaatgcattttctactggatgcagacagaagctccatatagacatatccatcgctgcatcgctcatgccttgtgttctccctaattttccctttttaaaccacagaggaagaaaattcca

SEQ ID NO: 397151 - DNA, 699 bp, Homo sapiens
atcttcagatctagttttttattacaaaagacaactatgcttacaaggtgaattgaattacaagccttttactactttttggtgagttaagaaaaagctatttaatctaacaaagtttcactttagcactcagctaaatagaaatttcgaaattttatttaaagatatgataaaataccatatggccctggtttcaagagaaattcatttaataagttgtgtaaatgagtttattagttaaagtgaacttacaaaatctctgttggttttataaaccaaagcaaactagttcatttgaattgctatgtgcccccctagcatttttaaatgcaagacaatgtatttgtagaaatgatcattctttctcagggaatgctaatttaccatgctcccatggtaaattctacaggaaactttcatggaaaatgtcaaagttaaggaaagtttagactcaaaaataataaatttttggtaatgatagtttttggaacacgtataattccatttacattctcagcttttcaattgtatttatctgaaaattagtttcataaaatgttacatggttataactcaatattactgtataaagtatttgagaaatgtctggtaactctcttgtgattaggtaacttcatgactcaaacctcctgttactgttttgatgctagctagcacttattaagctaccttttaatg

SEQ ID NO: 397152 - DNA, 202 bp, Homo sapiens
ggtcagtgatgttacagtaggacttccttgcttttcttcatggcggggcttgggcgtggttgttggctaagctccccgagactccttttttctacatcatgctattcctgtggccaggggctctgtcccctgctcagcagtgttccagggagggtgttggtcagttttggtcatcccagcacttaggtgggatgcagggtgg

SEQ ID NO: 397153 - DNA, 415 bp, Homo sapiens
aggtggtcccccagctacaagctaagtcctttatcttatttaactcctgcaacaagacatttactgggtgtctgttatgtgccattcactgttttcattgctggggatgcaaagcttaataagacagagcagtttacatctgggcctgtacttgtgctacttacctcactggcctcatccaatcccagccctaacagatcctgtgtatttaaaattttgatattttgttcatcacagattttttttcattaattttgaattttttaaatattgtattaaaatattacttatcttgattactgagctttttggctcccgtaaattttgtacctgaggtgaatgccttatttgtcgtggttttaaaatatgtttgtaaacaactaaattaataaatagcaaataattattgaataaa

SEQ ID NO: 397154 - DNA, 493 bp, Homo sapiens
caaagaggttggggaaattgaaaatgtttatgtcctaaaagtggtcacggaagtttcagctgagcactggctatattctttttggatgcctggaattcttaagacttcactttagcttcaaggagcttacagtctagttggaaagagagatcagatacataaattaacaatgccagacagccatggggagtacccatgggaatgggcatctcagggagtaggagtttggaaaggaagcaggaaaggtggtagtgagatgggaagagttatgggggtgaagaaagggggaagagaacccatggtctggaatgctgaataaactgaaatttgcagaaaatagtcaagacctgtgctgttgggcataatcatcatcaggaataaatggcacccaggcagaacacactttcattctgtaaatatttaagtgccttccaagtgcaagacactgtggcagacactgggagttaatattcaagattgaatgcaagccaaa

SEQ ID NO: 397155 - DNA, 330 bp, Homo sapiens
tagccactgaggcagaattgatactgctgtgaacagctgaccattaaagtttcatgtgaactgccatgtgatctgcacagtttgtgcgcctttccggatagtgaaacacagggagagaaacatgttcccagtgttgatatttgaaagctgatctgttttgtcatgtgctctgggtagaaggttgctgtgtgacgtgctaccaagatcatgtgctctgtcctatcagaaagcttttcaaggtgagtgaagtgtgttcagggggcacagaaataaagcagagttgccaggcgtagtaactatttgctgattgtgtaacaaaaaacataagtg

SEQ ID NO: 397156 - DNA, 318 bp, Homo sapiens
aagttatcctggcctatccatcaagtgccacccttcaaagctcacagcatgcctggataatcctgccagactcagaccacactctagccatatttccctgacaggtgtaacgatgtgctctacaggtccacaatccaagccataagcaacccccaaatgaagaccatcgatccaatctatacagtctcccaagagcatccaaatacagggcaggcaggcagcaggtgcacaatctcaggatggaaatactccgtcaatcattcattattctttgattgagttgacttggtgctcagtgctgtgctagatgctgtggga

SEQ ID NO: 397157 - DNA, 410 bp, Homo sapiens
agaaaggaaaaggatgacaagatacttctataaaaactttatgctaataaattagacaacttggacaaaatgggcaaatttgtaaaagtgcaccaattatcaaaactgactcaagaagtcatagaaaatatgaatagagccaggcacggtggctcatgcctgtaatcccagcactttgggaggctgaggtgggcagatcacaaggtcaggagattgaaaccatcctggccaacatggtgaaaccccgtctctactaaaaattagctgggcgtggtggtgggcgcctgtaatccccactactcgggaggctgaggcaggagaatcgcttgaacctgggaggcagaggttgcagtgagccgagatctcgccactgcacaccagcctagcaacagagcgagactccatctcag

SEQ ID NO: 397158 - DNA, 604 bp, Homo sapiens
aaaattgtccctaaatactgaactttacatattaactcccttttatcttgcaattataaaaatattttcacaaatattagaaatatatttaagctagaagattgctttaaaggacagggctatagctataagtactaattcatgaaaactatttagtttcaaatataaagctgctttttaattatatgaaaatgaagtaccacatctactcctacaaattaaaaaattgtcctttccttatttatttatttttgagacaaagtttcactctgctgcccagtgcactgacatgatcacagcttactgcatccttgacctcctgggctcaagtgatcttcctgcctcagcctcccgagtagcactgactacaggtgtgcaccactacgcccagataattttttatttttttctggagacaggtgtcgccatgttgcttaggctggtcttgaactcctgggctcaagcagtcctcccactcagcctcccaaagtgctgcgattacaagcatgagccaccacacccaggtctaagtgatactttaatcaagggtagctctcttgctcctgtttttgccatgtgacatgcctgtgccccctgtgtcttc

SEQ ID NO: 397159 - DNA, 409 bp, Homo sapiens
cacacacacacacacacacacacacacacacccatcaacaaatagtttttcctggaaggaacttccagtagtgtatgagaaagcctattgcaccacaccatccccagcaatgagaattactactgtaaaaaaatctttgttacattaaatttttggaggacatctcattttcttgattgcatttgattaactcaaaatgtatttctacagggtggggaacatcacacactggggcctgtcgtggggtggggggatgggggagggatagcattaggagaaatacctaatgtaaatgacgagttaatgggtgcagcaaaccaacatggcacatgtatacatatgtaacaagcctgcatgttgtgcacgtgtaccctataacttaaagtatataaaaaaaataaaataaaac

SEQ ID NO: 397160 - DNA, 479 bp, Homo sapiens
cctgtccttcctccttgttaacaaccctgggcactgtcaagccagaaatctgagagtccccttagactccctcactgcttcttgtccaaaccctcatcatccatgcttggatgccagcaacagcctcctcactggcccgagcctcacggtggtcctgggccagtccattctcttccctgggccagacagagcttttccaaagtatagaactgcccatgtcacttcctgcttcacaaccttccgcgctccccagcgcttgcaggacagagcccaaacttcttagtgatggtcaccccagggctgtgcacgttgctggccttcacctcacctgcaacaccccaattcctcctcttgggagacccctccttaaggactgccccctgtactctatacacgtctgtggctctaaggagcctgttttctctgtcctctgtccactgcgaacattcttgtccttgtccttgctcctggcttggtgc

SEQ ID NO: 397161 - DNA, 278 bp, Homo sapiens
aatcagcagtaataagacagtcaagacagtcaggcaagagggctgctttaaggagccacatttaaacatcaaaggcattcctatttagcaggagcatgcaatttttaaaaaatggaattatcccattcacagtatctagaaataaccccagcaagaaatatatgggacccaggctgggcacagtgtctcttgcatgtaatcccagcattttgggaggccgaggcaggcagatctcttgatgcgaggagtcggagaccaacctgggcaacatggtgaaa

SEQ ID NO: 397162 - DNA, 200 bp, Homo sapiens
aaacagtagcaaaagtcccaactccggatcagaggatgatcatctcatgtaataactccagtctatttccgtcagcctgtgtgaatctaagaaccaacccaactacatccatgcagtcagggggtttcacctgcccagtgtgggcagatgggggccaggggttggggcctggtcatggccttggcagctcactctgtctt

SEQ ID NO: 397163 - DNA, 738 bp, Homo sapiens
taatctacttcttcacaaaggaaaagatttgtcatgcttctttggaaatgggactgaattctgatgtattagcttttacatatgaaaatttgtattttaattccttgagtttgaataacagataatatgggaaatctaatatcatacaggctcagaatatctgctctgttcagtatcaaacttatcctttgcaaactctcttcttcctgttggtttgtttttaattttgaccaataataccactggttcttggcccccatgtccagcccagctagtcaggaaatccagtcatttccacctttttagtattgtatgtctcatctttagtatatcgtctgtgctataagtcttataccactatcctgtttaaaattcttctggaaagccaagtaaactagaaaggataaagttgaaacttgttagcatggcacatgtggtccttcctgatgtggccgtagcctgccttttcagacccatctctttctacttcctactcaagtgaatttgattcctgcttcaagcaacaggaacagctcctttttcttaacctctgcatttactttttcctgtatctggatttttctttttcctggaaaatttttatttgttctttagggttcaactcaagggaatcacttgtatgaaacttttccttttgtcttcaggtagaggtaagcatacattgctctgtaattccatcatgcctttatttattcacactgtgagagatggtattgt

SEQ ID NO: 397164 - DNA, 433 bp, Homo sapiens
tgacatctattaacttctaagtggcaagagtgattcttgtggttagacctgaatgggaacttgtaagtctaaagtgaaaatctaattagatttttcccacaaaacaattttccgcaacgcattgtggacataaaggtttgatgaatgtatagccaggcacagtggctcacatctgtattcccaacactttgggaggccaaggcaggaggattgcttgagcacaggatttgagaccagcctgggcaacatagtgagactctgtctctataaaaaaataaattagcagggcatgacggtgtacacctgtagccccagctactcgggaggctgaggcaggaggatcacttgagctcaggagttcgaggttgcaccatgattacacctgtgagtagccatgcactccagcctggacaacacagcaagaccctgtctc

SEQ ID NO: 397165 - DNA, 455 bp, Homo sapiens
agtgcctagaatagtgtttatcaaatagtatgtccttatgatccccattttttttctatattctccagaacaatcaagctgtattctccaggacagctttacagagcaactaaaatgttgtctgtaggcaaaagatttgcataatttgtttttaatatttgaatgttgtgatatttcacatgtgaaataacctagaaagagaaaaaaatcttcatttttcttttctctttcttgagacagggtattactttgccacccaggctggaatgcagtggcattatcttagctcactgcagccgcaaactcctgggcacaagtgatcctcccagctatggtggggaggatgaagtgggaggaccacatgagcccgggtggttgaggctgcagtgagctgtgactgcaccactgcacttcagcctgtgcaacagagcaagaccctgcctggaaaaaaaaaa

SEQ ID NO: 397166 - DNA, 533 bp, Homo sapiens
catgctgtgaggaggaagaactgactttgccccagaaactgtcatgggcatacttgatttgttagtttccttgggggataaagaatccacagcacagcacctgctgagtggttgttggctcagagaaagcaattgaagcctcatgctgatagcaagagatgtatcagatacaggaggatgcctcaatcagcattctcagctgcagtcaagaaaaatgaattgtggcctatgtaaacagaaaaggttggcgggcatggccagtgcatggcccaatcacaccactagcctgggctggtggtgacagttctgttgccatctccatcactggacaccatgccagtccttctcatgtcagaactacatactgctgccatccaacaccaagatgtgtgctttccatttgctgtgaggccttgagccagggccggggctgcgagggtagctggggtggagggaacactcagcacctagaaaacgagtgcttggcgttctgcttggtgggaagctgggaatggcacccaccgagactcata

SEQ ID NO: 397167 - DNA, 509 bp, Homo sapiens
cccatagttagcaataatagagtagatttcatcttgtatgttttatcacaataaaaaagaacattcatgcctttttaaaaacattattttgagtacccagtatgtgcaaaggagcctcttattacaaatcatcgttagattaagggagttgatgcttttagtcaaccatgctggagaaagaacaacactttctaaagaggcaaataaactatatgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacactcacacacgagcaattatccttaagaaaaataatatttatagcacttaaagtgttatttaagcaacttttcctgcttaattccaaagaatgacaatacatccaaaaaa

SEQ ID NO: 397168 - DNA, 212 bp, Homo sapiens
gcggccgcctactactactactactgctcgaattcaagcttctaacgatgtacggggacatgagccaatgcccatcacacacacacacacacacacacacacactcacacacgagcaattatccttaagaaaaataatatttatagcacttaaagtgttatttaagcaacttttcctgcttaattccaaagaatgacaatacatccaaaaaa

SEQ ID NO: 397169 - DNA, 431 bp, Homo sapiens
accccaaatttataacagatacattaagatattccagagttgtgactagagggctagatgtgaaagacatacttttcactgatcctgaaatatattcagcaattctgtacttactgatatttatttcatatcaaaaacataaaagtctggccaggtgtggtggcgggtgcctgtaatcccagctattccagaggctaaggcaggagaatcgcttgaacctgggaggcggaggttgcagtgagctgagatctcgctgttgcactccagcctgggcaacaagagcgaaactccatctcaaaaaaagaaaagaaaatgcagattcttatgtttcaccttagaaccattaaatcacactctggggagggagccagagaatctgcaacttaaacaagcactcctggtaactctttcataatcaatctggaataaaa

SEQ ID NO: 397170 - DNA, 561 bp, Homo sapiens
acatgatacaatcgagctctgtacccaggctgcaagcttgggggcatggtgatgaaagcggcgtgagctcagcagtgcactggatgggcagaagaaatagccagcagtccacagtagttaactaagcacttcgctttccttttgatcacctcactctttgaatgggatttgtggacagggtggctaactagtttccccttagggttcattccagatcattagggtttagtagaaaccactcatggttagctacccacctttgattttagaggtggagatttatacattcagttaactacagctattcaaaagctcaggaattttctacttaaagagatgttattggggaacaaatgggcagaaaaaaattcctttagcttatattatataatgagaatggctttccttttaaaactgcttcacctgaagtgaattctggataacatacattcatggtatccaagtgtatagttttcccttcttgcttattgatccagtgctttcttgtgtttcttatgctggtaatttcccagttgatattgggggaagaacagcaaggca

SEQ ID NO: 397171 - DNA, 325 bp, Homo sapiens
attctgtggctgatttcctcctattttgttttttgttggttggttggtttttgctttttcagtagctacccaggtatacaaatagcttctttgcagttctgatcatctttaggggccgcattgggcataattggaataataatactagctaacctgcttgcagggcttgctctgtgctgtgcactttgtgagcactttaaatataggagccaaacctctctttccaaaagcctgaagggcaggtgtcctcgcagttcccattccatagatcaccatccttccatggaaagtactctgtggactgtaacttgccatctagactttt

SEQ ID NO: 397172 - DNA, 503 bp, Homo sapiens
cgggtgatctaaggatccctcataggtcgcaagtcaggcatggtggctcacgcctgtaatcccagtaccttgggaggccgtggcaggcggactgcttgagctcaggagttcaaaaccagcctgggcaatatggtgaaaccctgtctctaccaaaaatacaaaaaaactagccattttgtaattacattacaaactgaaaaaccgtgaaacatgaaaaaataaagtctgcccttttcaaacagaaaattaataaacaacaggctttacagttttaacaccagtgttcaaatccatctggataatttcataacctgtgacctcaagcaagttagttatggagactgagctccacttccacatgtataaaattgcaaaatgaaaatacaggccaggggctcacacctataatcccagcactttgggaggtggaggtgggagaatcacttgaggcaaggagtttaaagaccagcctgggcaacatactgagaccccatctctatttt

SEQ ID NO: 397173 - DNA, 701 bp, Homo sapiens
gaactatgtcacagatgacacacaatggaattgggccttgaaagattgagtagaagctcattgcaggaatggcttttcttttgtccctttctctcctgtttttttcatatattctaaatctgataatcatactcaagcccaaccctctactccccaacctccttggagctgatctcaggtgattgggaaatatgaacaccggagagaggcttcctctctgtagccatccttccctctttcctactgttcctcttagtcctgcttgaagcttattcttgtgctcttagcctgtttctctggttatccattctctcttctgccctggcttggtttctgctcaagtagtcaggtcaggagttagggtaggggctttggagcaaaacatgagtttaattcctgaccttgtcccttggagactggtttcgtccacttcttaatcgtttttaccttcaacccctccctgtcttctggcatttctctttcaaactctaacttgcttgtgtacccataaaaataagtcacttccctcctctggcccttacatcctctctgctttccttcttaaccaagcttctttaaaaggctagactaccctgctgacactccatattcttcaatctattgctatctgtatgcctgtcacatacctcaagcccatcacattcagaacaaaattcttcttcctcaagccagcctttctg

SEQ ID NO: 397174 - DNA, 528 bp, Homo sapiens
acagccccattttctggcctgctatgcctccaggaagactgactggccttagtgcaggcctaggggatgcctcttggaggtggcatcagccctacctggatgacagagactgagagtggcagagaggtggttcctacggaaaactggagtatagcgaccaaaagaagggagctggaatgcgaaggagtcaaattcacttgctgtccatgacctctgcgtatatggcaatacaacacacagagagccggcagtctatttatcgtgctgttttgcacctgaatattttttccctagctgaacatacacacccgggtttcagaaatttgggcgagaagggaaggagagaaattgctttctttcctaaggtctaagggaatgtgacatcaaaaagaagctccaaatctgtgacagggctttgggcagttataaagtgctgaacagtctgtccgttaatgcacgcgacaaacattttattgggttcctactttgctccagaaacaatgttgggtttttaatttaatttaattt

SEQ ID NO: 397175 - DNA, 364 bp, Homo sapiens
ctagtctctttattagtaaataataaatgtaatataaagttatagttctacatttaatccacttctcttccttccttttgaagagtgtaaactcaagatgggaaaggaggacaaagccagaagtgtgaaagatatttaagcagttttagttgacagtgagtttagtttcaattaacagtgtgatgtggttgctaaaaaagctagtatgattttgggatgcaataaggtaagcacagaatctatgaagacctcctggtgtgttgtattccatgtcggcttcccctgctaacactgataaagaaggtctaggatgtgctcagaagggagtaggcagaataggggattgaagccaaacaataataaa

SEQ ID NO: 397176 - DNA, 156 bp, Homo sapiens
agatgcaaaactagtgtcttgaaactcaggggccagcatcgcttcacttggaaacagtggccatcattagtctttactaagccctgtgcatcaggtggcagcagggacattacttatttaggactttcgtaggagctggtactttgtaacacttaa

SEQ ID NO: 397177 - DNA, 285 bp, Homo sapiens
tggaatgggtcgggggtgtcggttcctttactgggtcatctggtaaactgcagggtttctgatgtgacattgaaggaagacatcaatcctctaagacatttttttcctcttcccctgggaatattactttttggactgtcttggtctgttggtaagctcaagggaatttgtcagagtttttttggtttttgtttcttttggctcatgtttaagcatcgattggcagagtttttgaagtcatcctcagagaggaattacagtggttcggaggtgttttctatagtg

SEQ ID NO: 397178 - DNA, 281 bp, Homo sapiens
tcaaggcgaggctaccccattcacacccacacacccaaacagggagacgcatcccaaaagaaagctccatcttctcagtgtgtgtccccagcccatttcactaggagttctctctgcttcccattcttaggaatgaactgtctctcctgaatccctcctagagtcccccaatttggcctaggctggatgaggctaccatcagctgccctggagatggaatagggatctcctcagaccccagagcggctcccagcacctgctaaggctggaaggcctcctgt

SEQ ID NO: 397179 - DNA, 500 bp, Homo sapiens
ccctcatctcctcctgcaagtctgccattgtggagccacgtggaaagactcaggagtggtcagcattagaagcctggctgagccagaggacaggaaagcagccggcacccagggcctgatgtgccactcgtcagcaaggtggacatgaagacaagactgggaaggagcaggccccaggccctcaggaggacccccttcacaagcgccactgctcactagctatgtgaactgggaaaagtttccaacccctttgtgccttggttcccttacccattaataggacagtaatagtccccacctcatgggcttgctatacaagatgagttaatagatgtgcatgatgtaaataactaagaataacgcttggcacgtaataagtactgcatccgtgtttgctattattattctgctccccactccccatgtgttggagtcccactggggggggcaactgggattccattacacccatttcaatgaaggtgttattaatagctctg

SEQ ID NO: 397180 - DNA, 405 bp, Homo sapiens
ctgtccgtttcgagggctggtcatcttggagcctttggggagagaagaaagagatgcaagaaggacagtgaccaatttgtttttccttttttaaaaaatgtcaagtaccctgttttgggaatcccctcatccctgggcaaaccaagatgcttggtcaccatagcaagaagagagctggagtctaggtgaacagtccaaggtctaggctccattcttcctgagtggtttgggtaatcctcgtttccctctctcaagagagaggtcagatcatagagtgtccaagggtgctcccagcctgagactctggggaatgctgggcccctcaggcctggagacatcctctgtcctccttccagccccggtctgggctgttcacagacaaggtaccctggagggccttgcagc

SEQ ID NO: 397181 - DNA, 474 bp, Homo sapiens
atctcagctcaccgcaacctccgcctcccgggttcaagcgattctcctgcctcagcctcccgagtagctaggattacaggcatgtgccaccatgcccggctaattttgtatttttagtagagacggggtttctccatgttggtcaggctggtcttcgaactcccgacctcaggtggtccgcccgcctctacctcccaaagtgctgggattgcagatgtgagccaccgcgcccggccaaacctgggtaattttgaaattttgttgttgttgttggttgtcacaacttgtaggtaacatcaagtgggtagaggccagggatgctgctaaacgtcctacgatgcacaggacggtgccacaacaaagaattatatggcctccagtgtcacttgtgccacagttgagaaactgaaactggatatgattttcacaacattaaagtcctttctgaccttgcatgtagttgcctcttccaag

SEQ ID NO: 397182 - DNA, 340 bp, Homo sapiens
caaaaaagctggatgttgtggagaggaatagagaaaattagaggttgaacatgtagtaagagtgagtgaatattttttagaatggggagataagtgtgtttgtttgctgtctaggagtgagctatagaattgtccaggtgagatggaaagataacagagagaagatatgagaacaaaatcctgtaggaaattagataatatcaagaacataaatagaaggcctggcacaaagtctcatgcctatgatcccagcactttgggaggctgaggcaggcagattgcttgagcccaggagtttgagaccagcctgtaacatagcgagaccacatctctacaaaac

SEQ ID NO: 397183 - DNA, 486 bp, Homo sapiens
gtcaggtttagacaccctctgagacaccaatgctcctcaaaggagtcttcaggttacctctaagagaattatttaggaaccctgctgctgaaaatgaagattcctggaccctaccccagaccttccaggatttaaaaatccagggggtgaacctacatttcacaagcttcccagatgattagaatacacaccaaggtgtataccatacacagagttgtccctgagtatccacggtagactggtgcaaggaatccgtgtggataccaaaatccaccaatgctcaagtctcttacgtaaaatggtataatatttgcatataacctacccatacctctaatactctttatttaaataatttatttattttctgagacagagtctcgcactgttgcccagactggagtgcagttgagcaatctcgactcattgcaaccaccacctcccgggttcaagcgattctcccgcctcagcctcctgaatagctgg

SEQ ID NO: 397184 - DNA, 341 bp, Homo sapiens
  misc_feature (273)..(273): n is a, c, g, or t
  misc_feature (291)..(291): n is a, c, g, or t
  misc_feature (336)..(336): n is a, c, g, or t
tactaatctgatttttggcaactgcaaaccttcctttccctcttcaaaccattccatccggctgctgcaatgacccaccatatcaaaatggttcttgtaaatcacactcaggtcaccaatacaaccaagtctcttcagaaatcttttttgtttttttttttttttcgacacacattggattttaatgagaaaataactgtatacttgcattgaatgcctcacaatcactctaaaaccaaagcaggataataacatttaagtggttaacatacncaggtaaaaccagatacngagtataatttccaaacacggtatttgctgcttttttcccctccnccccc

SEQ ID NO: 397185 - DNA, 424 bp, Homo sapiens
cagcagagtcagtagaaaggtcgtgatcccatgcccttttaaaggaaagcagcccctaggaatactctggtgcctggatgggtgagaatgtgcttgaaagatggattaagaagccaggacactttgggcttaaaactcagctctgccacttacattcctcatttctttctatcctgggtctgccaaaatgtaagaaaagttttcacatttttttaccagtttttctcacccatgaccaccctgtctcaaaatgattatgcaacagcccagagtcccccattccaaaattctttgcaaagagcaagatttccctcgctatttctgaattcatccacacctctatttctctctctttctctaattctcccttctccctacttcttttttttctccctttcctccctcagtggttttctttattctt

SEQ ID NO: 397186 - DNA, 197 bp, Homo sapiens
tcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctgg

SEQ ID NO: 397187 - DNA, 246 bp, Homo sapiens
gtgggtcattggcagagaaagataatactaaaatcttagagactgtgaaaagagattatattaagcaacttgagtgattacttttttgccagttaaaagaaatgagataatttatattgaagatgattgctatatacagtgctttgcacaaaaggccacatatctctttttaccttaggtaacatgatgtataagctactttcacatatatcttcttaggtcatcacaaggatttgagatcatcat

SEQ ID NO: 397188 - DNA, 154 bp, Homo sapiens
accgaattgacgcgtctcttcacagaactgataatatgcacaaaggcagaggtgtgaaaaaatcctttaagatttagaggggtggccgggcgcggtggcctcacgcctgtaatcccagcactttgggaggccgaggcgggcggatcacgaggtc

SEQ ID NO: 397189 - DNA, 440 bp, Homo sapiens
ttttttttttttagctacacctgctgaaatgggaggggttcattcttggctctactgttttctgagaacttgaacaaataaactgctcgatatcaatttgtttttattttcaatagcaaaataaagataggaacattacgtgcctgcgaggagatcctttacctaaagcgcttagcacagtgcctggttcatgctgttcacacagtgctgtgtgttcatgttattgacagcctcagtgacagcctcagtgagcttaggtcactatctttgggccttggctgtccccttctatcaaatgaagtgattgtttcacccctttataggtccgtgtttctgactcactttaataggactgaaactcgtgattgtctctcctccacgtgtagactagccgactaaaagaaggctatatgatatatatatacacgtagttgtccctt

SEQ ID NO: 397190 - DNA, 345 bp, Homo sapiens
cccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaa

SEQ ID NO: 397191 - DNA, 133 bp, Homo sapiens
aagcgacattttgtttgaaaagataatattagttaaaatgatattatgtacagctagccaatactctgaatacatacctaaagcaaagcatacatttgacctatagatccggatcttgtattgtcccatgccc

SEQ ID NO: 397192 - DNA, 705 bp, Homo sapiens
cgagcctctgcctcccgccgcctcctcgccctccattcctcgctccccgtcttctcccggccacaccgccactgctgccgcctccctgggaacagtagccgggggagggggactggcgcggtcagagcctgcgaggaggtgcggggcgccggggcgtaggggagcgcgccgggccctgcccgagatcagataacagccggcgggggagggggtgggccggccgtgctcacagccggaccgagggaccgacgccagccgccccggcccaagcgagcgcccagcggccgggggcgcggtccaggcgcgcgcccccgacccgtggctggaccagggcgatccgctttgcagagaagacgcgcccctcggcatggagcgcccccgggagctgccctgaggcggtggcggcagcggcggcgaagcagccagcgcggcagctgccggggccaggaacggccgcccggagcttggaggacgccgagcgcgccgcgcccgggccactgaccgaggatgttctagtgactggatcctttccagttggtgcctgggaaatggcagcactactaattcagccttgaagacagtaccgtgcccactcagcaccattacatagaaagatagaactcaagaggagccgcctgctggagctagcctgggggcgagccaagtccccaaccccgggatgaccggggcagccgggcaacccta

SEQ ID NO: 397193 - DNA, 331 bp, Homo sapiens
agtgactagaacaggcacaaggggacttctggggctctcgttccattctgacgatggacgggtttgtggatacacaggcgagattatgttgtgagaatccatcaggctgcatattatgacttgtgcatgtaaaacatgtatgctacacctattaaaacgtgtttgttttagaaatgccttcagtatgtacagctatgatagatcaacagaaaaaataaaacactttaaaatttctttaaaaatttttaaaaagcagtgccttcaaacacccaggctattgtgcagcgtgttgctactgtctgtgatgcctgcgaggcatgggtgagaggag

SEQ ID NO: 397194 - DNA, 617 bp, Homo sapiens
tttacctatataacaaacctgcacatgtcctcctgagcttaaaataaaagttttttttaaaaaaactgttgtcctttttgcttaaactatgttatgatcaaaggaaaaacaaaaggtagaaaggagaaaagggaagcaagtaaaagaaggaaagttgaaattgatcacctctttaccccctggcttgagatgagggtgggagggcaaattaggtggcaatatcaagttcaagagaaaggcagcaggacctttgcccagtccttgctgccagtagatccaagcagaagcctcagcacagtactctgaacactagatgatgctgacaaccaagttgcatgaagtggcaattggtcctagttgatcaatatggaaatagagagatatttccctgtatggtcaaaggaaaagcaaagttgggatcaccaactgtcaaaatgatggtcctcctaaggccttgtctccccagccaggtcacacttccccaacaacagttggcagtggaaggatctgcatcattttgattaagtattattattagccacaatgaggtctgtaataatcaatgttaatttatacacctccctttcccaaaagcctctgattgattgagagaagta

SEQ ID NO: 397195 - DNA, 521 bp, Homo sapiens
cggggccccctgatgccccctcaggctgggtaggctgacagggaggtgttccataagcctgtgccagcgtcgcctgtcagcggcagagcctgagatgcacagcctcctccttagaggttccgagtgtcgcccctctccggatgggccaataagtggctgctctggacaagtcccgcgttctttcactgcgctaccgagactaagtgcactgatcaagcccctaccccggggactgcccgggtggggaggcaaaagagaccctgcaaaaccaacacccgaggacgcacttgcgtctcggaagcccagcttgtgggaggcagagcccgtcctgaggggcgacgagggcagggggaccaggaggggctcgtccaggttctaaccagagcctggatggcaaggggcggagtcctggcagtcgggatgggcgtaacgcacaggctcaaggcataaggcacagcgcactcgggtcacaggcggaggagccagccaaaccctctccccgcgcccgtagccgcgtcccc

SEQ ID NO: 397196 - DNA, 309 bp, Homo sapiens
ctcaggtagacctaacagggctgcgcactacttaaagcaaacaagaaagagcctcactttaggcaagcctatggcaggaaagcctcattttaggtcttagtacattatacacaaatccaatctgataaaaccaaggcatacatttctttctcaatagaatgttgcaccttacaccaagattctcagagcctcgggctgcctgaggccaatctgggtactctcataatacctcacctggcctgggttctggtccagatgtgtcagcatggacacagggctggatggggcaggggggttaggtctacctgg

SEQ ID NO: 397197 - DNA, 1102 bp, Homo sapiens
gagatttctggataaatgaggccattctgttgagaaccaaatggctttcatgaataaaaatgttttaaagatattttacatattgcttacttttaattatattttatagtcagctctctaattgttcacaggttgatacccagatgtgagatgtcctagtcattgggttttcttctttcttttgatgcctttctttttttttactgctcatttgcatcttctttagttagccagcagaaatagaaaggtggttgaaacacattcagttttattatccatttttttaaaagatggggcataaatttgaaactctttgcaaaaatgaagttttgaatttaaaattgtttgattatctctattcatcttctacctctggttttcccagattcacttattcagagttaattgaacatctcacgaacccatatctcaagcctactaggcaaaatatactttatcctttaaagcttcttgccctattacgacagcaaggcaaaacttttatttggtagcaaatggttttaggcaaattgcagaattttagaagaaacgtctgagttgtttctctcatacagtgatttgtctggctatcttcgtatgtgtaacctaacggttgctctctgaaaggaaatgttggcgtgcgtctatagtcgcaggtactcaggaggctgaggctggagaatcgcttgaaccagggaggcggaggttgcagtgagccaagattgtgccatttcactccaggcggggcgacagtgagaatttgtttcaaaaaaaaaaaaaagaaagaaaaaaagaaaatatgagtcatatattttgttattaagtgtgttatttatttagaaagtcatttattgaatgactagtctttgccaggtatatctagctacttggtgtaggtgaaagggaattagaactaaattataccttgtgtctttatgtcttgataaatacaatgggggaaatgggcatgtaatgtatagttacaatataatgtactgagttttataatttcacaataagagagtatgtacagagcttttcatataagggagagcatccaagtttgtcttgggtgttcaaaggctttagagaagatgcaaag

SEQ ID NO: 397198 - DNA, 543 bp, Homo sapiens
caaaattggacatcatggaaaaaaaaaacattcagataaggttcccatctttctaccatcaactggtagatcctgggaggatgaggtgtaagagataaacgaggagagaagatactgatacccaacacaatttgatcttcagtgttgtctcatcttgaaatgacttaataacagagatttccataagaatcaggattcatttttgacccaaaaatggaagcttccactccaaagtcacaaataaggtttctggttttatttttagtgtgaggtaaacagtatattcaatattaaaccaaatggtaaaaacacatggatggtatattaatgcagaccttccattattaagtatattttggaacactcatggatttttcaaacatatgttggaattagaaacctgtaaaatctgctgcagtgtgtaatagctatttgtttgaatgtcttggcagtgcctttttagtagctaatgttcagtgtaatcttgtgcctttttagtaattaatatattaaatataatcttgtctgagtttttaaatggtc

SEQ ID NO: 397199 - DNA, 332 bp, Homo sapiens
ccatatatatttaactaagttccacgctaaggtctggaactattattgcaatgatgctatgttataattaggctactgtaatgtaataattgactttatccataaatatcatgccagtaacaaccaaatgtaccataaacaaagtcaagccatatatcttttctcttgtataataaacacacgttattttcatttaaaaacttgaaattattctgtatatattcattcgctcatttgcaaaaattatggtccagatctgatgtctgtcttttttctgcttttctcagagataaagaatgcttagtaccaagttacaggtgtaagacggacat

SEQ ID NO: 397200 - DNA, 435 bp, Homo sapiens
cttgaacttctagcctccagaactatatgaacagtagtttgttgtttaagccacccaatctatggtattttgttatggcagcttgagcagatgaataaaatacagccttttctcagtatctgcaacagactgatttcaggacccccctcccaatcccataccaaaatctgtggatcctcaagctccttgtatacaaaatgacgtagtatttgcatatatcctacgtatatcctcccgtatatttcaaatcatttctaggttacttacaataccatatgcaatgtaaatgctatgtaaatagctattataccatattgtttgtattagtttttactcttgtattattatttttgtgtgtgaattttttaaatctgtggttggttgaacctatggctgtagaacctgtggatatggaaggccaactgtatgtaaaaa

SEQ ID NO: 397201 - DNA, 163 bp, Homo sapiens
tgagatccatccattgtggatcaaacctaacagacaatggcagcaagaagtggggagagaagagaaactttctctgaagtcttgcctattctgtgcctccaacaatatgccccttccccataacttgcccaacgaatctcttcaactgtatcctttgtaatat

SEQ ID NO: 397202 - DNA, 505 bp, Homo sapiens
ttaagttgatttctttttctcattctctttcctccataccatatggaatctctaccttctgttttttaagtgattatccgaggcattttgacatgcatatttagctttaaaaagcccagtggcaggagcccctctctctcttacttgccccccatgccgtgcataagctgggatgagacaccaagctgggattcccatgctgtgtagactctagtacagattacccttaatggcaaaaaccgcaattacttttgcaccaacctaccacttgcagagattctagtaggtttaatcttctccaacccccttcacggtcccacggcccgtctttgccctgagccagaacactggaagctattttagcggatgttaacggggttctaggtgtgtataacgcgatatctgccgagcagtaagtgtttgtgagaaacacctcgttttcacatttccatcctcagttccccttctcatgctaacagcaccttgattcttcttcagaattcga

SEQ ID NO: 397203 - DNA, 395 bp, Homo sapiens
ctactactactactaaattcgcggccgcgtcgacacagccaattgtggtcctgctactttcagaaacaggtagacgtggattatataaagagcaagcaataaaaattcattttagccgggcgtggtggctcacacctgtaatctcagcactttgggaggctgaggcgggcagacatgagatcaggagttcaagaccagcctgaccaacatggtgaaaccctgtctctaccaaaaatacaaaaaaattagctgggcgtggtggcgcacacctgtaatcccagctactcaggaggctaaggcaggagaatcacttgaacccaggaggtggagtttgcagtgagctgagaccgtgccactgcactccagcctgggcaacagagcaagactccgtctca

SEQ ID NO: 397204 - DNA, 454 bp, Homo sapiens
ctgtattgcaagtaaaagacaagagtttggacttggtaagatggtggaagagttgggagatatgagtggatcaagacatatttggggagaaaagctgtaagacatgatgtgagtttgtaatggggcatggtgaaggagaagtcaagagtgatccacctttagaattatggcagggaacggtgtcatacaatgagatggagaaaaagtctactgtgggatctcatagtttagagatgtttttgagacaaaaaagtgccaacgggtatcaaaaaaaaaaaaaaaacaggcagatttactgatctcacaggagagagaaaagttgagcatgggtagggctacacagaaaaagaagacagactgattgagactaagccatgagaacattcaatatttatttactgactagaaatggatgagtttacagagacagagtgggagaggccagtgaggttta

SEQ ID NO: 397205 - DNA, 324 bp, Homo sapiens
aggctgggaagtccaaggtcagggtgtcagcagatttggtgtctggtgagggcagcttcctggttcataggtagccatctttttggtgtaacctcacatggtggaagggacaaggcagctctctgggacctttttaataagggcactaatcccattcctgagagttccacccccttaacctgattacctcccaaaagtcccaccttctcataccaccacattggtgattagtttcaatgtacaagttttggggaggacacaacattcagtccatagcatatgtcagtggttgttaacagagtcagaaggagttgagaagtcaaa

SEQ ID NO: 397206 - DNA, 291 bp, Homo sapiens
tgcggatgtgtagatttttcgggaaatgtgaaagcttagggaaaagggacgtttttcttccgggcagaggcagttccatatttcctatggggaaggagtttttagctccactctgactgaaaagtaggaaaaagagggaattcaagcgcttgaaaattcgcctgctttgcatttcccgaaagacagaaaacgtcagtgatccatttcacagatcaagggtacagaaaagtgtagagcagtttgagatgtttattgggcttggagaggtagcggacttttgccatcattccc

SEQ ID NO: 397207 - DNA, 514 bp, Homo sapiens
gtttgagaccagcctggccaacatggtgaaaccctgtctctgaaaatacaaaaattagctgggcatggtggcatgcgcctgtagtcccagctacttgggaggctgaggtgggaggatcacttgaacccagtaggtgtaggttgcagtgagctgagattctgccactgcattccagcctggtcaacagagcgagactctgtctcaaaaaacgaaacaaaacaagacaaagtccatgctcttatgcaactaacattctattgggagagataaacatgtatatatataaaacaatgtcaagtattagcaagaaaaactgaacaagatggagttgtagagagtaatagaaatgaaggacctattttagaccacaaagtccaaagtcaaatgtttttcaagtcaaagaggaagaaggcctctcctactggtgaatctaaaataactgaaagtaggatcttgaagagatagttgtacacccacgctcattgcaacattattcataattctttatctattc

SEQ ID NO: 397208 - DNA, 373 bp, Homo sapiens
ctagaaattgatccaaggaccagatgcttaaagttcacttcaattggtcactagaaagatcccagcaatccccagctggtttctcaggctgctgattccctttatttggtaatggggtgtgtgcagtacgttgattaaaaaatatgcatttccattccattgcttttgaaggggggcagttgtctttctcttattaaagagcttgtgatacacaggaaagtgatgtaattttatatattagtcaaacgtgaggattttagataagacagcaagggtttttttcccctagtttgtagaaatctagaaatttaagtgatgatttgaggatcgagaagggagaactgaatcaaaataaaatctactacacacattc

SEQ ID NO: 397209 - DNA, 404 bp, Homo sapiens
tgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcgg

SEQ ID NO: 397210 - DNA, 460 bp, Homo sapiens
attgatttggcagtaatacttgtaaatttgtatattccaactgttaacaaaaactctggcccagagcacctatgtcaagtcttggctctgcttgttagtggtgtgaccttagacaagttacttagccttattgtcttagtttccttattataaaaatggggcagtgatgatcataatacccacttgacagggttttaatgaggatttcgtgaattaatatctgtaatgtgccagaccagtgttttgcatggagtaagcacttcatttgtgattcctataatttctgttacttaattctcatgaggaaacactagtaaaatgaagtaaaacataaaccttcttattatatgactactgtgctttctctcattagaccagttaaaaatctaagcctttagctttaactatattacccttattcaaacacataaaagatttttcctacatgctaggttttttt

SEQ ID NO: 397211 - DNA, 595 bp, Homo sapiens
cacgtttaaacattttcatggatacatctggttgctctccagaaagcttatatcaatttctattcccaccagcagtgaatgaaatgtgcatttctttacacccttgttgacacttttggtgtgatcagccttcatcttttcttccattctgagagatgaaaatatgtgtttatttgactgttagctagggccaggatgcttttaaaggtgtttcagccatttgtatcttctgaattttgcttctgtcctctgcccggtttgattggttattgggtttttttctttcggatcttaacagagtttacttaggaaacttttctgtgaagcttaatgtctgtagctattgtgaatgcaatggttttcctaacttatttccgagttggtggttgttggtgtgtaacagcacctgctttttgggtgcatccttgcagttcttgaaaataacttgtgtgttgcacgtggctttctattgcagtgcctgtgagatctgtgaggtctcctgagggtgtaacacagtgacgtggcagaaacctcgtatctactgaatggtgctgctgcattgctatttgtggggaagttgagtcatacataaatc

SEQ ID NO: 397212 - DNA, 434 bp, Homo sapiens
gaggagctgggacaacaggtgtgtgccaccacatctggctaatttttttacttttattttttcatttttgtagagatggggtcttgctatgttgcccgggctaggctctcacctgaaatcacatggctggtctacttggtatggccattcctcaccctaaatcacattgttggtgtgcattaaagcttccagccaaacaaagacattcctatcaggtatggtatcttacagatcgccccctacgtgttaaggatgaaggccagatcttttggggacaagattaaattctttttgttgttattgttttgtagagatggggttttaccatgttgcccaggctgggctcaagaaatctgctagcctcagcctcccaaagtgctgggattacaggcgtgagacactgtgcttagccaagattaaattctttactacac

SEQ ID NO: 397213 - DNA, 426 bp, Homo sapiens
ttggaagagttgagttctggttctgttgtatctatcagtcataaaacatataaatcattttaatctttctgagtttattcttcagctgtaaaatggaggtgataatacttatcaaaactgctataccaggttgtaagggtcagtgagatattaaatgtgaaagtgaataatacaatatgtaatatatatgcatgttgagtatccctgatccaaaaatctaaaatcggaaatgctctaaaatctgaaactttttgagtaccaaaatgatattcaaaggaaatattcattagggcattttgcatttcatattttcagattaggggtactaaacccatatataaatacataacataggattataattaacattaaattcatgtggaaaatgagtttattccctccctaataggtagctcatgccgacga

SEQ ID NO: 397214 - DNA, 368 bp, Homo sapiens
gaatctgtcttctattaagctagacattaaagagatgcaaaaatgtgaaataatgacattcttcacactaaattgttttgtttgggaaaatatagttttgtcataaaagttattttaacatataatatttattactttttaaacaatttaaaaatgcttttagttttaatttttaataaggtagatattgataggtgtaacccatggaaataaacaaaagctccttgaaactctaataattttttttttttttgagacggagtttcactctttttgcccaggctggagtgcaatggcgtgctctcggctgattgcaacctccgcctcccgggttcaagcgattctcctgcttcagcctcccaagtagc

SEQ ID NO: 397215 - DNA, 163 bp, Homo sapiens
taaaaataatgatataagtaggtgttgttatttactgtttgcatttaagaaggaaaaacgcatgcatttactcagattattaaaaagcgaattttatttgtctgatccaaactttatatttattctctttattggaaagcaggaagaagggaagacaggcagg

SEQ ID NO: 397216 - DNA, 362 bp, Homo sapiens
aggagacctgggtgtggctctgacacctgagacataaggtcactttctgggccactctaatatattatagccttttcattaaaaggttagactagaggttaaattcacaagaacactgaaaatggtctctgtgggtgattcactgttattctataatgagcattaaactgtcattttctgtttccttctgtatcctagctctactgtgattccttctctttcctggtttctctcaataccatagttaattttctttctgaattccaagagcacttgttcttttcacttttttactttgcctaaaaggttactgggttttatgaatattcatatttcttgatttaagtctccataacttaatt

SEQ ID NO: 397217 - DNA, 183 bp, Homo sapiens
aatggtttgtgccaagacccatttagagttcccagctccaccttctcaagcttacctccaccaagtcaccttcacccatctcacagacatccagacctgcttgagatgcccggcacccaacagccagggattagagctttttattgaaatccctgctatcattttagaccaagttcctgaatg

SEQ ID NO: 397218 - DNA, 567 bp, Homo sapiens
tttcacattcttcaattatttgtgttgataaataattgaatagaagttttaaacctgtgactatcctagaagttttaagtttttacattaaaacctattagatatgtaaatgtatacatttttattcatttttgaatgtaattctgtttaaaatcttaacatgacgaaatttaggaaattgttcgaagtcttgtctagatgagcaattttgaacactttacataacattcagatttttattgcatttattttaaaaacatacataaaacctttttcatctgtagaaataaactagaaatgaaactacagggaatattgtccttgtaccaggaagtaaaatctaccaactgtaggtctctattggcacggaaatgggcatcattaggcaaaacccagaaacaggttccagtacatagtgaaccttactgaaatgaagaaatgacatttccattaaataggaaaagcatggattattcagtaaatattatggcgtggctctcaccaaagatagtactataaggaaattccaagtatagtaatagcacaaatagaatcaaaaaacaattt

SEQ ID NO: 397219 - DNA, 403 bp, Homo sapiens
cataatcctgagtctcaagagattgcacctcctttatcattcctgattttcaggcaacatgatatggcatccattctgcatcaataactctttacaaagtgtctgtattttcatcgtcggtaagagtcgcttctacaccatttataaatatggaatttgaaattttatataaaattatatatgactacctaaatacatattgggttagaaaatactgtggtggtgttggtgactgctattttatgttaccatcaaaagaaaaaaataattttcctgatatgagaacctgaggaaacatggaaatatcagaatatgctcatttagattaagaatgtggaaaaacccttttcatcccattgttctgctaccgtaagtttttaaaaaatcaaacagaattaaaatt

SEQ ID NO: 397220 - DNA, 155 bp, Homo sapiens
ctaaggttataaaaggttttttgagactagctgaataaaccatatcctgttccttccttgggaaaacttgtttatattctaactgtttttagaccttgtaaaatttggtgaactccttcctcattagcttaaattcttccacactcagcaaatat

SEQ ID NO: 397221 - DNA, 418 bp, Homo sapiens
tgaactactggacatctgacaactgaggggtggcgttgggcacactgtgtgcacataaaaaaagggtttgtgggggaactaaaaggcaaacgagggaaagttgctatctagaagccatgggtgggacagtgcagggttacggaaggactggttcatgctatagattgtgtcccaggagaggctatgctctgacttcttcctgtgtccatgcaggcagatgagactataatcaggtggcacagaagcctgggttggtgaaaaaaccaggttgccagtacagactacctttcaagctctactgataatttacacttaattaaaaactgaagttaaaataagcaaagaaatctttccaaggtgacaaactcaggaagcggcaatactgattggaacacagacatatctgactcagatgtca

SEQ ID NO: 397222 - DNA, 330 bp, Homo sapiens
tgagatacaccccacccccaccatatagctagggccctaaaagggttacatccgtagtgcagtatttggtgtgtacattatactgtaattgttttctgtaaaacttaattgctatcaaaagaaaaaaatgagttttaaaaaaattgtcctgggaatttgttaccacaggtctgtccctcatttagatttgggggttaaatatatacccatgtggtctgaaaaaccaagcctagaaattaacttgaaattaacttctgggtgatcatgccctgcaggaatgacagaagcaaatttatcctctcaggataaatacatccctaaattcagacc

SEQ ID NO: 397223 - DNA, 685 bp, Homo sapiens
atggaggcaggtaagtggctcactttatagcgtaattgccctcactcttcaggtcaggaaaccagtgtagggattctgctaattgttgagtatgtctattccaattattctgcagctacagagataacaagacgacccactgcaagacagacctaaactaaaactccattgatcacctaacctccctaagcccctactctcacttgtgaaccagagtgatgcattagttttcctggggtaccctgagtctgagttcagaaccaatgtccagtaattcccccaaagtctgattattcccttttccccaatgcacagtcaacttggcaaagtgctataggtccctttggggaaggctgagagaaaaatgaacagtatacaattttggtaatgcagtggggacacagcctcctcattatttaaggagatatgggtctgcaaactggcccaagtcttggaattgattcaggagctgtgactccgtttttttgattcgagttagacttttattcacttgattcttctttttatacagaacagataagaatttagtaggctttccatctcttttatttctatggatactatgaccagctagctaatgccataagtctctgtaaatcggactttctaactacagttttgactttactgtccattacagtaaccatgttcaccttgtctttgg

SEQ ID NO: 397224 - DNA, 549 bp, Homo sapiens
cagttagtaaccctgcaatgacctctaagcattcaagtgaaaggaagagtcccacatctctcctttcagtgaaaagctggaaatgattaaacttagtgaggagggcatgtctaaagccaagacaggccaaaagctaggcctcttgcaccaaacagttagccaagttgtgaattcaatggaaagattcttgaagaaaattaaaagtacttctctggtgaacacacaaatgataagcaaaacagccttattgctgatgagaaagttttagtgatctggatagacgattaaacatttccttaagccaaaacctggtccagagcaaatccctaagtttcttcaattctgtgaaggctgagaaacttcataaaggctaaaaggtgaagaagatgtaggagagaaatttggagctagcaatggttttatcatggggataaggaaataaacaatttctataacataaaagtgcaatataaagcagcagcagatgatggagaagctgtagcaagttatccagaagacctaagataattgattaaggtggctacacta

SEQ ID NO: 397225 - DNA, 296 bp, Homo sapiens
tcaaggctggaagaaattgaactaaaactcatagatagaaggagaccctctttcagtgtatagaaggaaaaaagaaaggtataatcacacctctagggagtggggcttggagggtgagatggtgctttttagaagctcatataaaagggccatatcacttgagatgcattagactgcaaataataaatgtcctaagtaaacaggttaaacaataaagatacttattatctcatttaagaagaaatatatccagatttatttaataataatgtgaaacagtgaatcaaattatctga

SEQ ID NO: 397226 - DNA, 463 bp, Homo sapiens
tgcagcttctgtctcctgggttcaagcggttcttgtgcctcagactcccaagtagctgggattacaggcgtgcgccaccacacctggctaatttttgtatttttagtagagatggggtttcaccatgttggtcaggctggtcttgaactcctgacctcaagcgatctgcctgcctcgggctcccaaagtgctgggattacaggtgtgagccactgtgcccggccattttttccatttaaaaccctttaaaaacacacctgaaggtgcagcttcctttcctgaagggaattaaaaccatgctattagtaggcatgggatacgggagtagatcatctttgggtgctggtccagaaagtagtgagtaagtgagacaagcaacgataatattgtttagcacaatgctttgtgacagggactatagtcgtccctattaagtcagaatctcttgggacaggtgactgag

SEQ ID NO: 397227 - DNA, 311 bp, Homo sapiens
tggttcttgtggctgctcccagtgcaattgctgtaagccctgttgttgctcctcaggctgtggatcctgctgccagtccagctgctgcaatccctgctgctgccagtccagctgctgtgtccccgtgtgctgccagtctagctgctgcaagccctgctgctgtcagtccagctgctgtgtccccgtgtgctgccagtgtaagatctgaggctctgaacccagaccttcaggtttcacctgtttggtgaaagcatttgttatgatttccctgaattaattcatcccacgcatcctccctgaggcacctgccc

SEQ ID NO: 397228 - DNA, 261 bp, Homo sapiens
gatgtgaggcagtgacagtagcaggtgtgggatgggccagactaccctccacatggattgaagacacacaagggcacctccatttcaaaggaccggaagtctggagtgagtggggatttagcttaacgtctgctcaggagaaaaagacgtgtaggttagaggggaccacaggctcaagctcagcatgttaaaaggtttttagcgtgtgtggcttttagcgtgtgtgtgtgtgtgtgtgtgtgtgtgtgtctgcgcgtgcag

SEQ ID NO: 397229 - DNA, 352 bp, Homo sapiens
gtctatttatagttatgtgtttatatatattttcctgagaagagggactcaaatgagtataactgtactatcaagtattttactgacctattagagcactaatccttttctgctttttataagttgtttgatagctgtatcattacttactgacttaggacaagatttaaattattatcacataaactataaatagcactatcaaatatgccgtgtaagcagcacatttcctctatccctggcagttcattccagtgccctcttgttcttttggatgaagggaaataatatgcccttcacatttagaagcagcgaaattagaatcctgcgaagagctaccctatactgctct

SEQ ID NO: 397230 - DNA, 485 bp, Homo sapiens
atgtatctaactatttatctatgtatccatcagcttacacatgtacctatctaatcatctgtctacctctatctgtctgctaatcatgtgtgctcagggtcttcagttggattaattatggataataaaggcaataagaagagggcatggtgtggactcagcacatttctttccttagaaacatggccaggctgagcacggtggctcacgcctgtaatcccaacactttaggaagctgaggttggtggatgacttgaggtcaggagtttgagaccaccctggccaaagtggtgaaacccatctttactaaaaatacaaaaattagccaggcgtggtggtgggcacctgtaatcccagctccttgggaggcttaggtaggagaattgcttgaacccaggaggcagaggttgcagtgagctgagaccactgactgcactccagcctttgcaacacagcaagactctgtctcccccaacccccccccc

SEQ ID NO: 397231 - DNA, 505 bp, Homo sapiens
actgatactcaaaggaagatagtaagagaggacggaaggaacaaagagtctataaaacaaccaaatggcagtagtaagttcttacctatcaataataaccttgaaagtaaagggtttaaattctccaatcaaaagacatagagtgcgtgaatgggttaaaaaaaaaaaccgatctcaatagtatgctgtctacaagagactcacctcacctgcaaggacatgcctagactgaaagtgaagggatggaaaaagatactccatgctaatggaaatctaaagagtggcaggagtagctatacttatgtcagataaaatagactttaagttcaaaacttttaatggagacaacaaacatcattttataatgataaagggatcaattcatcaagaggtcttaacaattataaatatatatgcacccagcattggaatgcctaaatatataaagcaaatattaatggatctgaatggacagattgactgcaatgcattcatagtagaggac

SEQ ID NO: 397232 - DNA, 221 bp, Homo sapiens
ttatatttctacatataattgaaggcacaatcatgaaaaacaaagtagctctatatgcattaagtccatgatctattcagtgaaaaacacaagttgcacatgtcttacagaaggaaaacttaacactgaacatagattctcaccatctgctctttgtcctgaggctccaatagaaatacagtgaagaataaacattgtataagcacacaattacaaaaaag

SEQ ID NO: 397233 - DNA, 266 bp, Homo sapiens
ggggagggatataaaggagatctagagccctatcttccatgtaagtatgccaataggaaatccttagaagtcaaagaccaaaaagtagtaatataagtatttatttagacatattatcaaaataattcattttaaaagtcgaaagagtttgcctctggggagtgataaacttaagtgggaattaagaaattgttgatttttgtcataagtcttatagtaccatttgatcctttaaacaatctgcaactattgcttagataaaaata

SEQ ID NO: 397234 - DNA, 874 bp, Homo sapiens
catttattaaatctcatctgtgtgccaagtattcataggtatcacctcatgtaattctcacagttattattgcggtattattatttcaattttcatgtaaagaaataaaagctcaaagaagaaaatgactcactgagttctgaacacacaattctctgagtccaaacctctagcactttctagaataccatgaagagtggaagtaatatgtaacattataattaatgttttattattttactctcttattgttaaatttcacacagtaaaatctacacataaacattcattttaatttaaaatcaaattatactgacatagtgccaaaataactgctctatgagatcaataaatccaatctattctgatatagaaaggcaaaacccgtgtgcattgctttgtaatagtaaccaaacagtcattatgtttcagccatttcaggaacttatttgtgattgttgtatattgattataattctggtcagttgtagttaacaagccttttttttccttatactttcttttttccaaagaacctattttgttttatagcatggttggacttttctctagaaaattacaaatgtattcaatataaccagtatttatcccaactttctgaagaagaaacttctcctacttaactccaaccttatgactcttctctgatatttttccagccataggtgttagcatctgctgttgtaaaatctttggtgttgattggtgtggactgagatgaggaccagagccaagatcactttttacaagaaatattatacaattctgccccttgtccaactctataaattactagaagtttctggaagtgtgtacatcttcaagctcatcttaatcatttccacactgtcat

SEQ ID NO: 397235 - DNA, 101 bp, Homo sapiens
taacatcaagatccaaacagctcacacattttgtcttttaataaggtcactctccttttctccccatgccatttatttgttgtcccttctgtcgtcttctc

SEQ ID NO: 397236 - DNA, 601 bp, Homo sapiens
cctcctagccctcttacccctcttagccctcttactcctcctcagcctcccaaagtgctgggattacaggtatgagccaccgcgcccagcctaatgaggtattttctacctaatgaggtagcaccttcagcttgccttcatctttgtatgtagtgtttcaattatataatatcccagctttaaaatttttaataattttgtgtttattttcatttgataaaggaacaaggttgacttaaaactctggtcttaatttatgttagtttttgtttagaatttagattacgtatctttttacacaattaattatgccaacacatttctctgtagggaaattcgtctgtaggaataacagttttaactgaagtgggctgacttgggagcctttgagagttagcgcagtggagtggaaaaaccgcttggaaaaaattagactaaagataccaacatcagaggttggtggagaaaaacaactgaaatccattcttggtagtgttcatagcaggctaaccttaacccccatgtgggctctggtgaccctctctactcaccacacccactcactgtgggggaagggcctgaaacttggtgaaagactaag

SEQ ID NO: 397237 - DNA, 294 bp, Homo sapiens
tgaattagaggacccgagtgtctcaagacgaggtcttgccctgttgcccaggctagagcgcagtgacacgatcatagctcactgcaaccttaactcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacat

SEQ ID NO: 397238 - DNA, 469 bp, Homo sapiens
cgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcaaaaaaa

SEQ ID NO: 397239 - DNA, 325 bp, Homo sapiens
  misc_feature (207)..(207): n is a, c, g, or t
tgacctgttggcggcggccgggcgggaggctgtgggccgcggcggtctcccggggttgaggggaggatgcaggagtcacacgcggaggccgggtgtaaatagattgttataatttttttcttaaagaaaacgtcgattcgcaccgtccaacctggccccgcccctcctacagctgtaactcccctcctgtcctctgcccccaaggtntactccctcctcaccccaccctggagggccaggggagtggagagagctcctgatgtcttagtttccacagtaaggtttgcctgtgtacagacctccgttcaataaattattggcctga

SEQ ID NO: 397240 - DNA, 470 bp, Homo sapiens
ggaactgcacaaacctgcaatatgtactgcataagtaatactgatttctctaaagcatactagatttcctattgcccaatatatgaaatacttattatacttattaacccccaatgcaatctacagaaatattctaataagcaaacagcatatattatgtgtctgaagaatttgtatttttgcttatctgcaaaaagtagtttgcacaccctggtggctccaagtgtttcttacaaataggtctaaagatagggacacagaaggatgctgacaagaccgtagtgaacaaagcacatcctgtgtggcttgagcctctttttacagagacaaaatgacacacacacacacacacacacacacacacacacacaaagttgagactcatacaatccttataaccattctatgagtaaggcactcgtgttacacatatttctcagacaaagggacacaccgggtactcctctaga

SEQ ID NO: 397241 - DNA, 613 bp, Homo sapiens
ggaaaagacaaaacttcagtcatggctcattcttaatctctttagtaatataatacagtctgtactataatagtatgagttaattttttctttaaatgatgggctgttattttacttaaagggcagtgagaggccaggcactgtggctcaagcccataatccagcactttgagaagcctaggagggaggatcctttgagcctaggagtttgagaaccaatctgaaagagatcctgtctctccaaaaaaaataaattagctgggtttggtggtgtgctcatgtagttgcagctactcaggctgaggcaggaggatcttgagattgactttttgaaaaaaaaggacaaaggcagtgagatgagaaaaactaaatattttatcctaaattcatttggtggtattataacaattatgaggatatcagtttttacatacttttcttttttttaagaagaaaagtccctctcttacccaggctgtaatgcagtggcattatagctcactgcagcctttaactcctgggctcaagccatcctcctccctaaccctccccggaactataggtgtatgctactatgactgtattagtccattttcacagttacgaagaaaca

SEQ ID NO: 397242 - DNA, 537 bp, Homo sapiens
tagagaatgtggaagaatagtgaatagtgtcagagatagttaaagtccatacaatagtagagaaggtaataagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaattattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctaggttgtgctacccacaggtaccgagctgc

SEQ ID NO: 397243 - DNA, 498 bp, Homo sapiens
tagagaatgtggaagaatagtgaatagtgtcagagatagttaaagtccatacaatagtagagaaggtaataagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaattattgtatgaacaattgttagaaacagctaatcacaaacaacctgcgggcacaatgacctcattccacacagggttctcactctcagagactcgtataaaagatctcctccagccacatgtgcctcatgtcgcagctagcccattctagggggtgctgccgcagggcgacacaacttcacaacttttttgctgatgcgtgcacagttatttacccacgatatatcgttggttaatgacg

SEQ ID NO: 397244 - DNA, 347 bp, Homo sapiens
catccaatgtaagacagtcataacagggaaattgagcgtggggtacattgacaactctgtactatctttgcgagaattctcttaatttaactgctttcaaataaacagtttaagaaatacatgaaaacccagtgtgctccctaaaaggtgagatcctcatgttctctaagaggagtggacatcccttcacagacccagacatccagattgatgtcattcactcccttttctttcatggtcccctcagatcacaatttttgaatctatacttatttgccttttttttttttttgagatggagtttttgctctgtcacccaggctggagggcaatggcgcgatctcagc

SEQ ID NO: 397245 - DNA, 828 bp, Homo sapiens
ttttctgagctcgttttgtaaatggctgctcttgaacgtaaggataaattgactgatgaggctgaggtttggagccaatccccgcacaaggcatttggcatcaaacacgagaaacccttggctattcaaatgaggaaactcaagtaactttcccagggtcactaaagtcggagacctcaaacgtggacccaggtcaggctccagaggtccaccaggacgacccatcatggctcatgaatgtatccgtaaaaatggcagaactgctctttccagctgccttcctacctatcatgggggtcctaaccgagctccccatcatgacattcaaggcctaccttataggatccctgccttacaggagcagtttcagtgcagcaggcacactgaccacctttctgccaagacctttttgccagagggcctttgcacttgaatttctttagacttttcgcctggcttagctcgtctgtcaccttggggaggcatttttctttctttctttgtttctttctcctttttttttttttgaaacggagtcttgccctgtcgcccaggctggagtgcaatggtgcgatttcagctcactgcaacctccgccttccaggtttaagcgattctcctgcctcagcctcctgagtagctgtgattacaggcacgtgccaccaaccctggctaatttttgtatttttagtagagatggggtttcacgatgttggccaggctggtctcaaactccttcacctcagcttacaggtgtgaaccactgggcccagcctctcctctcttccctgctcccctcccctccccttccctcttctctctcttttc

SEQ ID NO: 397246 - DNA, 454 bp, Homo sapiens
agtgtggagaggcgagcgtgtccactcaagactcagggtcctgccctcagcacccccacttccctgccctcgtctactctcgatgctcccacttgccctcccagtgctaagcaaccagaggaagcccatggccaccaaaaaggctttcctctccggctagatctccaggatcctgcttgtatgttacaaatcaaaaagtttggcctaggctggacacagtggctcacacctgtattcccagcactttgggagacctgaggtcaggcccacgtggtcaaaccccatctctatgaaaaataaaaattagctgggcgtggtggcacacacttgtcgtcccagctactcaggaggctgagtcaggagaattgcttgaacctggatgcggaggttgcagtgagctgagatcgcgccactgtgctccagcctgggcgacagaagaagaccttgtctcaag

SEQ ID NO: 397247 - DNA, 365 bp, Homo sapiens
ggaggaaaggtgcagaatgagagaggagagggagagagggcagtgggtgacaagcagagtagagggagaaccacagcagggaggaagcctagggagttgggggtgctagagagtgggaacaaaggaggtgtaacaggtaagagggaattttaacaaggagagcagagagggagctcagatggggaaaaagaggcggaaatacgtggagattggggacaatcagaaagattggggagaaagagctacgagaggtgaagtaagttgcagagcatcgggcagaacagacataaagaggagaaaaacagaaaaggggaggaaaggtgcagaatgagagagccttttctggggagttagggtaccgactt

SEQ ID NO: 397248 - DNA, 269 bp, Homo sapiens
ccagatgagcgatgagttgattggatatggatggtggttgtaatattctaatttgtgactttatactctaatttaaaattcatttctttaaattgtactcgtgaggatgaaaattaccactcttttctgtaaggcttgtgcattttgtatttatttgtatcaaaagatatttggaatttctgtttagccagagagcatttaaattaagtcattcgtggtaactcttttcttccctgggatggggtagaggatagagtaactgagaaatg

SEQ ID NO: 397249 - DNA, 516 bp, Homo sapiens
agccgacagagctacgtggtgctgggactgaaagagagggagagagggcagtgggtgacaagcagagtagagggagaaccacagcagggaggaagcctagggagttgggggtgctagagagtgggaacaaaggaggtgtaacaggtaagagggaattttaacaaggagagcagagagggagctcagatggggaaaaagaggcggaaatacgtggagattggggacaatcagaaagattggggagaaagagctacgagaggtgaagtaagttgcagagcatcgggcagaacagacataaagaggagaaaaacagaaaaggggaggaaaggtgcagaatgagagagggacacacacaatagtgaagaaagtgggagaggaccccatccagatgagcgatgagttgattggatatggatggtggttgtaatattctaatttgtgactttatactctaatttaaaattcatttctttaaattgtactcgtgaggatgaaaattaccactcttttctgtaa

SEQ ID NO: 397250 - DNA, 374 bp, Homo sapiens
tatcggttttcatgtctcagcttgagatccttgatttaaatccctgatttatttttactcgtgtccccagtgccaatgtgggagagttcagacatgttttcatattcactgagatgtcagagaaattaaagaagagacagatttttcatatcagtcagttaaagactaattacaactgtgctttccagcaaaccagtgattgtaggctaattttcggttatgaaacagaaactgaggttaatgaggctaattgtgtttaccagcatttttgaataaaagaaaagaagccaactcaattttgaagagacttctttgtcaggaacaaattggggaaaattgctacagtggtatcagcgtttcctaaaactgctaag

SEQ ID NO: 397251 - DNA, 393 bp, Homo sapiens
gggggcccgccttggctgaggcttggtttttaaagattttcgttagttaatcgatttaaaacaaagctgattcctggcatatgggaaatttcaaaggatagcaactgtgtggaaaaggtctattccactaaaacagcataaatgacgtataaacccaagaagctgatgactgcatatgaaacaaccaaaccaagaagcaaaatatggtctatggagcacagtactaacccgggaaaacaagctttactcctggctcgattatacacctgctgtattttaatttttaactcaatgttgagcttatttaaataaataaaacatgctacttaaccacaatttcaaaaggaaaacaaagtcacaaaagaatgcaataaattacacaattggactaac

SEQ ID NO: 397252 - DNA, 431 bp, Homo sapiens
  misc_feature (31)..(32): n is a, c, g, or t
gggtgggcatgttgggaaagaacagacagtnnccgcccggctttccgattgttttttataaaaacaaacaaagctgattcctggcatatgggaaatttcaaaggatagcaactgtgtggaaaaggtctattccactaaaacagcataaatgacgtataaacccaagaagctgatgactgcatatgaaacaaccaaaccaagaagcaaaatatggtctatggagcacagtactaacccgggaaaacaagctttactcctggctcgattatacacctgctgtattttaatttttaactcaatgttgagcttatttaaataaataaaacatgctacttaaccacaatttcaaaaggaaaacaaagtcacaaaagaatgcaataaattacacaattggactaacatattagataattaaaggtgattctattccc

SEQ ID NO: 397253 - DNA, 400 bp, Homo sapiens
  misc_feature (31)..(32): n is a, c, g, or t
gggtgggcatgttgggaaagaacagacagtnnccgcccggctttccgattgttttttataaaaacaaacaaagctgattcctggcatatgggaaatttcaaaggatagcaactgtgtggaaaaggtctattccactaaaacagcataaatgacgtataaacccaagaagctgatgactgcatatgaaacaaccaaaccaagaagcaaaatatggtctatggagcacagtactaacccgggaaaacaagctttactcctggctcgattatacacctgctgtattttaatttttaactcaatgttgagcttatttaaataaataaaacatgctacttaaccacaatttcaaaaggaaaacaaagtcacaaaagaatgcaataaattacacaattggactaac

SEQ ID NO: 397254 - DNA, 487 bp, Homo sapiens
ttgaatccgggaggcagaggttgcagtgagccgagatcgcaccactgccactccagcctaggggacagaacgagactccgtctcaaaaaaaaaaaaaggtctgggttaccctaacatatcaattcatcctcaatttattctctccgtagattgttttttataaaaacaaacaaagctgattcctggcatatgggaaatttcaaaggatagcaactgtgtggaaaaggtctattccactaaaacagcataaatgacgtataaacccaagaagctgatgactgcatatgaaacaaccaaaccaagaagcaaaatatggtctatggagcacagtactaacccgggaaaacaagctttactcctggctcgattatacacctgctgtattttaatttttaactcaatgttgagcttatttaaataaataaaacatgctacttaaccacaatttcaaaaggaaaacaaagtcacaaaagaatgcaataaatta

SEQ ID NO: 397255 - DNA, 418 bp, Homo sapiens
ctaagaaatgatcaatgatttgagatgatggatatgccagttactctgatttgatcactatacatgatatacatgtattcaaatatcaccctgtatcccataaatatgtatagttattatgtgtcagttaaaaattaaaaaagagctactgtttcattttaatatggaagttaaaccaactaaaaattctacttctgccaaaaaacggcataagcaaagtgaaaacagcaaaatgggagaaaatatgtttgcataaatgggtaatatttcttttccttttttactttaattttctggcaagggttaatataataaaaatacctttactctggaagcaaaaagagttccttcttgatagaaatgccaggtataaccataggcagatggtagaagacacaaatgacaactaagataacta

SEQ ID NO: 397256 - DNA, 470 bp, Homo sapiens
ctaagaaatgatcaatgatttgagatgatggatatgccagttactctgatttgatcactatacatgatatacatgtattcaaatatcaccctgtatcccataaatatgtatagttattatgtgtcagttaaaaattaaaaaagagctactgtttcattttaatattccacataacttaaaacatcctaatcaacagtttattctgtcacattctgaggagtttgtgaacaaaaattaaaacacagataatgtattcacatatataaagacatacatgtaacacataaccagtgtaaagctgtagtcaaaagctctcaagcaaaagaaaatactacttctcaaacagatggaaaaatcctgaatatcagctacaaaattaaattataaacactaaagtttaaaacttctgttaaagaataaactagagcattgttggccgggcgcagtggctcacgcctgtaattccagca

SEQ ID NO: 397257 - DNA, 660 bp, Homo sapiens
agaagcatgggcttctaaaacttgtagaaactaaagaaaacccaaatgcataacattttcccgaagggtaaccctctttccttcagctttatctctccaatgttgcagcctcagtcctctcacctgtagggcgacctgcttaatcctcttcagaggtcccacctctcaatacaaagtgttaatcattcccttggaaaaaggagcttagaactcaatcttcctatttgtaaatattggggtgagaagcagggtgttggatatttagggaaacattatctatttaatcttttaagagtcttctttagcaataagagcatgtaggaatcaatatgaaaataaatgatctgtttggtagctattcttgagtttcacagtgatcagaagctccaggaaagatggagagggcagactactcgcgtgtcctgtgtccttgggcagattacttctcctgtctctgccttccactatcttgggagatattgagatatagaacgagttgacgtatgcaaagtacttatatgcctaacacacagtaagtgctcaataaatgtgacccattattatcacaattgtttcgaacacaattatgaaaagacatctatttcttcaacgtcatctttgtatgaaccaagaatattcttttgggtagtctgtgcattt

SEQ ID NO: 397258 - DNA, 346 bp, Homo sapiens
aaatccaaaaaaacaacaaaaaaacacaaagattagctgggcgtggtggcgggcgcccctaatcccagctactcgggaggacgaggcaggagaatcgtttcaactaagcagcgggaggttgcagtgagccgagatcgctccattgcactccaacctgggtgacagagcgagactccgactcaaaaaaaccaaacaaacaaacgaaaactcagtgggagtgtcttcactatgcagtcgtctattcagcaaccttgacaacaagctctggcactcagtttctatttcccgggagttgcccagcgctccgcccacgcccgcttgcagaactcgccccgcctccgcccca

SEQ ID NO: 397259 - DNA, 2009 bp, Homo sapiens
  misc_feature (1257)..(1257): n is a, c, g, or t
  misc_feature (2005)..(2009): n is a, c, g, or t
agtcccttaaaattgtcctatatgctgtggctgctgctttgtatattcctatgactaagtctgaaattgaaatattctccagcacagtagttttgacccttgggtgcatattggaatcatctgagcagctttaaacatactgatgcctaagtctggaccacagagactctgatgaagttagtccacctggggtgcagactgagcactgagatttttcgaaactctccaagtgattctaatatgtgaccaagattgaaaaactctgccttggcaattggctctgacaggaaggacttccactgacaggggcacgatgggatgcaatcatcaggctgtatgaagttggagagagcctatttcaaagataccaaagatgaaaggtttacacacacactgcacacataaacacacacacacacacaaaagatatatatatatgtatatatatatattttttctttgcacatcttccgagagtaggattttgtgctcagcattgaggaatcaaagaagtacaattccatcatcccagtcaacaaactcgaattgttgggaacatcttcccttggatttcgggaaattttgttcgtcaccgactgggttagataaacatagtcttaacacctagtggaggtaaagacagatagatacatagttaagaatcacccgagactgtgtggcaaagggcatgtgacacagttacaaaggaaatgccatggaagtggttacttatggcagaggaagctttcttggatgaggtggcttttgagttgaaccttaaggaactgttgcattttgacagttggagaattaggagaggacttctaggttgaccaaaggcaagcagccttcaaagagcagggccatttggagactagcacatgtttgctcagacacagtagaaataggggatagtgtgtgaggatgggaagctggaaaagtcagtggaggatagattatagagacattgaacttgatgctatgaaggtggggtttaattccacaggcaatgtggatccatctatctttgtaagtccataagtgctgtgatgagatggatgtttctggagaatgataacttcagggttggtgtcaaaaaaagttggagatgaagaagctgaaaccaaaagggatgagtagggagtagggagacaagtgccatcactggaaccagagaggatggccacatttctaggacagtggcaagagaaatgggaaagaagggagtgctcatgtaggagaggcatttctgtggcngcacagatagaaatttataacacaacagatggttgtggaaggtaagttagaaggtgaaattggtgatgaccctgcagtttctaccttgggtggttgagcctccagaagtgcacagcttttaagttgtaggtgactggggcttttcgaggttccacaggtttcagacaagcatcatgaaaacacgtctgctccattcatcactatgtgcctggtccatcgtaggcacatgtatttgttaaaacaaacaggtatttgtaaaataaataaatgcaactctctgagaagggagtacctgagactgaacaagttttctgaggaggaagatagggtgtttcgtttttgctctgttgaatttggattctaataaggcagcaggtggttggaattgcaaatctgagatttaagggaaaggccaggagtgaacatgatgagattgtcctcaaggggctaaacatttaatcagggattcaagatgtatgcatgagaaagtagctaaagataaaattagcagtgtcagagggtggtccagccactgtgtgctataggagttcagaggaggaagcatttgtgatacagaaagccccatcctagaccacttcaaggagtagctactaaggcagggtttctaaggatgaatatgaaaatctaggaagaaagggaagaaattccaggttgaaggaagaatgtgaacaaagatataggaacaggaatacataggggagtttcctagatccttcccactcgaggnnnnn

SEQ ID NO: 397260 - DNA, 425 bp, Homo sapiens
tatttttttaaattatattcaagcctgaacatagaatctgagagctgtagacattaaggtagagaaggtctgatttatccaggtgggattgttggtgtgaatatgattttgtgtgacttttggtttcatctcagttttataagagcaggaacatctcctcagccttggtgtagaccaggtttggtgcagggaaaaataatgacagacattttcaagtgtgtgttataaacttctgaaatttgcatctgcatttatttcagggtcttttttttttttgagacagagtctcactctgtctcccaggttggagtgcaaccttatcttgactcactacaacctccaccttctgagttcaagcgattctcctgcctcagcctcccaagtagctgggattataggcgcctgccaccacgcctggctaagtt

SEQ ID NO: 397261 - DNA, 662 bp, Homo sapiens
gatatctggtttgagatataatcatctttagtatttgccactaccatcgaccacctgggaatgcagtaaaattaagaagtacattttgatgaacaaaataataactaatgagtaatttaaaaagtcaacgaacacatattatgtataagtatacaacattttgttcataagaccttttcaccaactccaaatttatatatattaagtaccatcatgtcactatttttgtgagtcatattcacctggaaaaaatataaattattagatattttatattttaccaatttggaaattaagatgagaatgtttttgtgcttaaattttatctttgtccaaaaagatatccatgaagattataggcgtgttacatttatctttgttgttttctactctttccctgcagtgagaggactagtcaaatgcttcttattgccaatcatgagaactacacatattaataatagatggaaaagcttacagaattaaatgaacacagtgacttagtgtaatacataggggctgtatctttgttgactagttgatgtttatctaagcgcaggaagattatctgaagaccattaccgaaagtatggaaaataggatcttttctagaagcaaagaattgctatcatatgaagtgcttgcatttatttgttaaagca

SEQ ID NO: 397262 - DNA, 473 bp, Homo sapiens
aaacaggacatggagtggaagagaagagagagtgggtaagaaagggggaaagaaaaaagaggcagccagcaagaagcaaagtataattttcatcaacattcattcattcatttgacaaacatttattgaatgtttaggagggaccaagaacattcaaagcccacctccatgctattcctcccttaaaatcctctgagtcttcattgacatggatccttttgaaatagctcgttccagtgaggacatagatcttgaggtttaccttttcatccttagggttgagacttcacttgataatatttggactggattttaccaaggcaaagaaaatgttacaggaaggcagagaaaccctatgaattgggatttgcccaagacctgcccttcatggttgaggcaggcatctggcatccaggcagcagtttgtttcccttggatgcccacaggccctgcgctgtgttctcacttcacca

SEQ ID NO: 397263 - DNA, 262 bp, Homo sapiens
actcctggcggtcgctcgtcggataacgcgatgatagatcttgaggtttaccttttcatccttagggttgagacttcacttgataatatttggactggattttaccaaggcaaagaaaatgttacaggaaggcagagaaaccctatgaattgggatttgcccaagacctgcccttcatggttgaggcaggcatctggcatccaggcagcagtttgtttcccttggatgcccacaggccctgcgctgtgttctcacttcacca

SEQ ID NO: 397264 - DNA, 115 bp, Homo sapiens
taccaggaaaagtaatctctgaaacaaacagtgctccctaaattccaccttattataatttttttatgtagtcatccacccattcatatttggaaaatgaaatgtaatattcact

SEQ ID NO: 397265 - DNA, 427 bp, Homo sapiens
gttacgggggctgggaggagggggaaatggggagttattaacaaacaggcctagagatctgctgcaccacatacgacccatcgtcagcaataacgtcttgttcacttgaaatttgttaacggaatagacctcatgttatttggagggcccggaggaagacaggaagagaagggaatgtttgaaacttcttagagatggattaaatggttgtgaccaaaatgctgatagtgatgtgaacagcgaagtccaggctgacaaggtctcagctggaaataaggatcttacttggaactagagcgaaagccacctttgttacgccttagcaaacaacgtggctgcattctgtccatgccctagagataccacgccagggtgtctggcggaagaaatttcttttctttttttttaaacggagtctcgctctgtt

SEQ ID NO: 397266 - DNA, 683 bp, Homo sapiens
ggtggtccctagtttcctggcactgggccctgggatgataaggcaaaagaagattgccttctgcgggggtatgggccaggtaggggaggtctggctctggctagatttagttcgcatgtcaaaggcaagctcctggctgggccctttgctagctgaaataattgctagccttgggagggacagtcactccccagccagaaagattttaagaggtcagaacatcataacatccagaaaatgttcagttgtttaaaatgcaggtacccagtctcactccagccttccaacaacctgcttgcctttccccttctcacccaggcctttacaccgtggcttactacttcaccacaggacggcttctgtgggggtggctggcccttgctgtcctcctgcccgggttcttggtccaggccctgagctacctgtggttccgagcagacgggcatccagggcattgctccttggtgatgctgcacctcctacagcttggtgtttggaagcggtaagaacagctgcctctttcacgtctggagcacaattgcacaagtgcagtgagaggaatcttctgtccatgtggattctgtcctcaagctcataaaagttcagcattgggaagaggttcaaagcggccacagcaaacccctgctctgatattggcatgcccgggtccagcctgcactttt

SEQ ID NO: 397267 - DNA, 894 bp, Homo sapiens
cacgcgaggctcctggggctctcggccctgctgcaggcggccgaacagagcgcgcgcctttacaccgtggcttactacttcaccacaggacggcttctgtgggggtggctggcccttgctgtcctcctgcccgggttcttggtccaggccctgagctacctgtggttccgagcagacgggcatccagggcattgctccttggtgatgctgcacctcctacagcttggtgtttggaagcgcccacaaatccacttgtaaatgcagcatgagatgacagaagaaggcctatctcatccttagcatgcaccttggtttagcaatttttctttagtgaaagttcaaggttgtcaaaaggaaagttaaggtaaactctaaaggcactgggacgctgcactgaccagtctgcagaaggaactggaggctccccaccgaggctggctgcagctgcaggaggccgacctgtcggcccttcgactcttggaggccctgctgcagactgggccccacctgctgcttcagacatatgtttttctagcctcagacttcacagatattgtgccaggggtgagcaccctgttttcctggtcctcactctcctgggcactggtgtcctacactcgcttcatgggcttcatgaagccaggccacctggccatgccatgggccgccctcttctgccagcagctctggaggatgggcatgttgggaacccgcgtgctgagtctggttctgttctacaaagcctaccacttttgggtttttgtggttgcaggtgcccactggctggtgatgacattctggcttgtcgcccagcagagtgacatcattgacagcacctgccactggaggctgttcaacctgctcgtgggggccgtgtacatcctctgctacctc

SEQ ID NO: 397268 - DNA, 210 bp, Homo sapiens
aacaatgaaaaagtaacacaatctctcaaatatttattgagtatctactatggctcctctggaatattacagaacaggtgattattcttgttttcattttatgtgtttagaaaggtatagtttggcaatttagaatgaaaacatattcctctttctcagttcattccttccacacccccaaagaattctccgaggaagggtgcgaggctc

SEQ ID NO: 397269 - DNA, 1097 bp, Homo sapiens
aattaaagtatggtgtaattaaatatataaattgataaaaacctgatatatataaaaatattaaaccatacttaaattttttttgtttaggaggataggggaagtcatccagaagattgattccattttattattatgtcttacaacagaaatatggcaaatcagaggctttataatgaaagttgcccagttttcaattaagtgtatgtattttatgtatgagtatccctacccctcaaatctatatagaatgtttttgttagttcatagcagctatatttaaaaaagatgtgtagcatttgttttaacaagtctttaacaaattgagacttggttgaagtggtctcattcttacatatagtcattgaatgaatgaacatgtgaatcatgtgactcacaatttgatgaagcatatgtcagatttccaacacaatggtgcagacaacctgtgctttagaatttcattgaaatagaccagacaattcagattggtgtcttcatggaagagatagaacttaagtgatctcaagagtgaatttgatttaggctttgtaatccatgtgttgcatgggagtcaagtgtcatcacaggaaccataggtagtaaagcaaaggtatgatggaagccaggaccagaaagaaaatctacagtgtactgaaggaagctgggaatcgttgggcaagaagaggtaaacagatactcagataatcgattcagaaacacacacagggtagcaagttaaaactgaggcagaccggcaaacacccagacagttgcagatgctggacaggaggccaagcagtgtgtcatatatcctggcttaaaagaaccagaaggaggcaggtacttcattgcagtttaaaaaaacctagcaattcctaagaattcatgattatcatagacctagtgatacttaagtaaatttattgagtacctgttctccaccaagcactgtaacccaatacataaattatctcactttatccacacagcagtcctgtgaggagggtactggtattcctgttttacagataaggttcaaaatgattaagtcacctccctcagtgcgtataactggtaaataacaatctagctct

SEQ ID NO: 397270 - DNA, 416 bp, Homo sapiens
aggattataagagattattgtgaataattgtctgctaaaaaaattgaataatctggatgaagtagacaaattcctagatataaacacactaccaaaactggcttaagaagaaatagaaaatctgaacagagctaaaaccagtaaagaaatagaattagtaataagaatcctcccataaaagaaaagtccaaggcaggacccagtggctcatgcctgtaatcctagcactttggcaggctgacgtgagaggatcacttgagccctggcgttcaagaccaccctgggcaatgtggtaagatctgatgtctacaaaacattttaaaattaaccgagtgtgatggcatccacctgcagtcctagctacttaggaggctgaggccagaggatcacatgagcctgggaggtcaaggctgcag

SEQ ID NO: 397271 - DNA, 557 bp, Homo sapiens
cacacacgcacacacacgcaccacgataatctggaggccagggccaggagacatagaaacaagtgatatgttagaagatgatgaatgctatcaaggaaaagtaaagcagagatgagacatagggaatacggttggctgtcggggggaggagcagatgacttactatttcatctaagggtttgtgggtgagatctgagtaagtgggattgtagactatgggtttatctgggggcagcatatctggggcaaagaccttgaattgagtgactgtttggtgtgcttggaaactgcaagaaggccactgtaactgtggtggtgtgaaagagctgggagtagattaggccagagaggcagtcgggggccaggtcaccaagagccttattttactggccattataaggactttagcttttgctctgaatgagatagaaagccatcatgtggtggggtagttacatagagaagtgacatgatttgacttcggttaaaaggtttactgagccaagactagactggacaaggcaaaggtagaagtaggggaagacaacttagaaagt

SEQ ID NO: 397272 - DNA, 578 bp, Homo sapiens
atggaaaaacatcccatgttaatggcttggaacactgaatattaacctggtagtactcccaaaattgacctacagattccatgcaatccctatcggaattacagctgactttgcagaaatcaacaaactggtcgtaaaactcatatggaaatgcaagggaaccaggatagccaaaacaattgagaaaaaacaaattggaggactcacactcctggtttcaagacttactacaaagctatagtaatcaagatggtgatgatggtataagaacagacatatatatcaatagaacagaattgagagtcaaaaaagccctcatatttatggtcagttgattttcctcaatggtgtcacaacaaatggggaaagaattgtcttttcagagatgatattgctggaacaatcaaacatctacatgcaaaagaatgaatttagacccctcacatgtacacaaaaattaaaatgaattaagtgtaagtgcaaaaactataaaactcttagaaaaaaacataggtttaaatatttgtgaccttgaattagtcaatggtttcttagatatgacagcagaagcagaagca

SEQ ID NO: 397273 - DNA, 801 bp, Homo sapiens
tctcagaggactgggatggggctcaaccaattcagaactatcacctgctcactcaccctccagaaatcatcgatgcaggtactgacactaatggatcttagctgcacttggctgagaaataaatcggttctatagatcggcaataaacacagctacagcagggaacgcagcttcagcagtccacctatgcctgcgagaagaaagggatgggctagacggggaatgggaatttgactgcagattcatgtgtgtatgatgtgtgatttggatggatggctaaactgagttttttctctttccacacgccaacgccagatacctggttgcaggcctctggctgcaggaaccatatgtgctgctggatggggtagtgcagcacagggacgtgggaagacccactgtccccagaggccttcccgaccagagtgcagagcgcctgtgtctccacatgactcagcaatgactgtggcctgagaatgcctggctgcacagaaacatcaatctgggatttaaaaataaacaggctgggtgcagtggctcatgcctgtaatcccagcactttgggaggccaaggcaggtggatcacctgaggtcgggagttccagaccagcctgaccaacatggagaaactccatctctactaaaaatacaaaaattagccgggcatagtggtgcatgcctgtaatcccagatactcgggaggctgagggcaggagaaacgcttgaacgtgggaggcaaaggttgaggtgagctgagattgcaccattgcattccagcctgggcaacaagaatgaaactcc

SEQ ID NO: 397274 - DNA, 656 bp, Homo sapiens
agaggcaggggagtttttgagatgagcctggtgcagatgtgggatgggcagagaggagagggatgaatcgctcagcctcacaacacagagtgagcagagacttggaaccctaggagttgacagaatgctttggacccagctggaaatctgtgtgggtttgtgaagatgtagcaggcaagaaaggagacttggggcctgatcttggaaggctttggaatgtttggcatttggaatctatcttaaaggagttaagtgggtagtatttttaaaccacctctagcgaatcagtctcctatccaggaaacttagttgtttatcagcatctcattgaatgtgaactcgttaacgtggtgacctacactcatcttgttcccttaaacatatgtacagagataccttttctcttaccagttatgtaccgtgaaagtgtggcacaagtgtaagaatacttagtagctttcactaacaatttgctcattgattgatttgctttttaaaattttcaaataacagcttgccttcatttatgttcctgtataaaaatgaactcagcactttcttaggaaggctcttgatctggttacatggaccaaatgaattccatgcaatcagtagaaggacagaatgtgaagtgaaacaaatcataacatcctccc

SEQ ID NO: 397275 - DNA, 610 bp, Homo sapiens
tccagtcttgctcccatcaggatgccataaagcaaccagataccctaattttgttaatttttagaaggggaagagatggaaaagtcatagaaaacctatttaacgaaatactagctgaaaactaatcttgcaaaatatatagtcttgcaaaagatacagacttccagatacagggaactcaaagatcccctaatatattcaacccaaaaggtcttctccagatcacatcatagtcaaactgtcaaaagtcaaaaatgtaaagataattacgaaaaacaacaaaagtgttcagttaacatataagggaatgtttatatgggacagtatctactgttatgaaaacacatgaaagtataaaactcactggtagagcagatacacgcaaaaaagaagggagtcaaacatcatcacaacaaaaaaaaaccaccaaatcataaatgtaaacaacaaaagaggaagaccagaacaaacgatatacaaaacaatcagaaactaataaagtggcaggaggaagtcatcacctgtcagttacaaccttgaatgtaaactgtttaaattcctccaattaaaagatatagattggctgatgggacgaagaccgtaggaccca

SEQ ID NO: 397276 - DNA, 197 bp, Homo sapiens
cttgggctgcactgaaggatgggtaggatatggatattgggaaggcaggtgggagcggactgccttaagttctcaacctggcttgtaggccagaataccctggatgcatgatcaacctacagattcctggaccccattctagatctgtgctgtccaatgcattagccactagctgcatgcaggtactgagcacttga

SEQ ID NO: 397277 - DNA, 419 bp, Homo sapiens
ggttgaggttggcagataagaagactccagctgtaggaaatatttctgttattgcccttttataaggaaatgtttagtgattccaagatgtacatttgaaatgataagtgaccttagagataatttattgcagtcactcatcctgtaactaaagaagctaaggaccagagaatttaaagtgttgaagatagaaccaagttaaggaaatgactcttgtgactcttaatccaatattgtttttatgaacaccacatcatgtatttgttctaaatagtcttggtattttaaagatactgaatttttgtaagtttggcatggtgatatgaaatggagataatatatttcaagtgcattactataacatgcaatggagtatgtaatagaaaattaactttcgtatattaaattttaaatattgt

SEQ ID NO: 397278 - DNA, 424 bp, Homo sapiens
tttgcacacacctgtccttccttcccagaggcacaaaaacagcgagaaacacacatcaacagtcccctagtacagttaccatgtcagaagctgtaaacccactttacaagaaaaatctcagcccaatttccaagtaatctttttttgggggggcgggggagggttatctccaagagaattaattagactcgtaaacaaagatggagaaaaacatccctccttgcccgacccaacctatcttgttccctttcctgcagcctctggctcttcagaagggttagcgaattacctgtgaatttaggtgattgcttcttgcaatattttaggattgtgaggagaagtgatgtctcaatacctattttttttttttttttaaacagagtctcactcggtcactcaagctggagtgcactggagtgatctc

SEQ ID NO: 397279 - DNA, 222 bp, Homo sapiens
tcagcaccctgtaggagcccccggggctgagcacaccaaccactgccaggcagcctaggacgatgcttgctttacggaatggcaagaggctctcatcagctggtagcatacagactgcaatgcagccaggggcttggggagaaggggaacaagcccttctcttcctgctttcttttttttttttttcttttgagacagagtcttgctctgtcacccaggctg

SEQ ID NO: 397280 - DNA, 225 bp, Homo sapiens
ggactcctccctgtcccctcagccctgggtcctggggcagggcagggccttccagcagcttccttccttcctttcttgggacggaagcctagctgggtggggggcgccgggctggagccttcgcaggggagcgggctcagtcatcaccctgctccccagagtgactcagcccccacgtccccacccatccccggggagccagggccgcagagggaggtagataag

SEQ ID NO: 397281 - DNA, 731 bp, Homo sapiens
agaaataaacatatcccacttcatgaaatgactatgccagccaagggagatgaaaaacaattttttttatagtacacctcatttttttaaaaacactttaatactaggaatatgtttctgtggcaaatagttacccccaaaggattatgtcaaatatctcttgtgaaaattaattttaaaattaatcttttggctgggtgcggtggctcatgcctgtaaacccaacactttgggatgccaaggtgggcagatcacctgaggtctggagttcgagagcagcctgaccaacatggagaaaccccatctctactgaaaatagaaaattagctgggcgtggtggcgcatgcctataatcccagctactcgggaggctgaggcaggagaatcgctcgaacccaggtggcagaaattgcagtgagctgagattgcgccattgtattccagcctgggcaacaagagcaaaactatgtctcaaaaaaaaaaaataaagaagttactgtagatgccactcttacttaaaccctaggccatgtgtggagtcccaggggaagacatgtatttttagagaaggaaggctctaggtaggtgtaaccttcctcttacagtttatcatgaacagttagtatgaaaaggaatggctggaagtttgcagtagtacaccgagcaaccaagagaaataaacatatcccacttcatgaaatgactatgccagccaagggagatgaaacaat

SEQ ID NO: 397282 - DNA, 216 bp, Homo sapiens
agggcaaacctctgccatggaacaggaggacccagactaagtaggcccttggcggagaggggtgatggacaagcctgatggcgtgaaggcccagggtggggaaggtttctgagagtctgagcagcatcagtggtctgcagagcaccagcagaggctctgaactcacatcatgagatgcaagcactccatggtgtagagctcccaaatcccagcccc

SEQ ID NO: 397283 - DNA, 153 bp, Homo sapiens
aaagaacaggactttatcagggtgaaagtattggagtgcaccctgtcagcaaagattatctatccactttaagagagacttaagggtggtggtttgaggtaaaaccaggagatatcctttatgatggtttgaaggaaaagtgtaaactggcag

SEQ ID NO: 397284 - DNA, 450 bp, Homo sapiens
aggccatggtagatgtgggcagggaactggagactccgggcccagtgggttcaacctcatgagggagtggagttgagatgctttggggatcagtgacacaacctcttacttggcttggggtgcaaacctagactccctgtcaccctggccttctcctctccaagagaaggagaactgtgggcatcgcagtggtgacacttcagttatcacaggctcagcagccaagtgaaaagatgatgttggaatttcctagatgattccattcatggattggccatgcagcagtccttagggatcccctcctaaaagtcacgatctacccaagaatccactgtgaatcgaccatccgccagtttctccaaacgttttaaagagcaatttgtattttcaacctgtctcacctcttggggataatgaattagacgagttgactacccactgtgtaagtta

SEQ ID NO: 397285 - DNA, 196 bp, Homo sapiens
acccattgagtaggaagcaatgatagacctgggtgtgcccagaagcaggtaaagatggagataagagttctggtaactacaagctaagaaaaataattgacacatgttgactattcagcctggagaccaagggatttgtcatggaagggatgggagtatcatcaaaaataactaaagggtggctgggtgtggtagc

SEQ ID NO: 397286 - DNA, 218 bp, Homo sapiens
ccataatggcaagtgatgcttgctagatcaaaagtacctttctgtttgttttcaaaattactttcaattccccatgaaacctagctatgtctgttcctaaattttagtgagattcttgtccttattttcatggtaaactgctgttccttaaggaaatctgaatgaattacttgtaaccaaaattgatcacagcagcctcacataccatctgtatgcta

SEQ ID NO: 397287 - DNA, 363 bp, Homo sapiens
ttgcagaaaaagaaatcaactttaagaaataagcaaaaaggaaaaaattgcaaacacattgatagaatcaacagctggttataagaccaggctcatgaatgaactggattaaaaagaaacatgagatccttggaagcaggaaatacggatttatctgttaacagaaactatcccattggcaagcagtacagtgaattatattcaactgttactttcatccttgcactactggatcaagattttatctcctgcaagtgagactctctttatgacaagtctaggtcatgcacccactcgccatatctattgacaaagggagaaagaggatctggcctctctgccacccaatgcagaaagaaggca

SEQ ID NO: 397288 - DNA, 410 bp, Homo sapiens
cctcccaaagtgctgggattacaggcatgggccaccgcgccctgcccaggagcagaattttttaaaaggatattaacaatataccctcccagaatttaagggcaagttgaacaaccaagagacaacaaggaatctgcttagtaatcatggcaagtctgaggctttcagtcaattgatgtgtctgtcttgattcatctctgatcgtctcagaagtgtacctccgctcagcctttctgaaaccaggtttcatgtcaaaggcaggaaacaatagtctacttcatgtagttcagaaattgagttggtggaccttctctctagagaagcaattaagtggatccccaagaagtgaatccaattagtgtgaccaggtcaggtattcgagggccgggccaggtctggaggtataacat

SEQ ID NO: 397289 - DNA, 1161 bp, Homo sapiens
aggctgagacaggtagatcacttgaggtcaggtgttcgagaccagcctggccaacgtggtgaaacctcgtctctactaaaaaatacaaaaaattaactgggcgtggtggcacacgcctgtaatcccagctacatatgaggctgaggcaagagaataacttgaacccaggaggcggagggtgcagtgagctgagatcctgccgctgcactccagcctgggtgacagagcacactccgtctcaaaaaaggaaagctgatgagaaattgggcatcccggaattcacacccaaaccatcagctggagctctgagactgttggggtgggaattcttccaagatgagaagcaagccagggaggctcaggtcctgggatgggcagggctttgatcaaaagaacacaggaagtgatttgctacttgaaagaaaggcaacccctccccaaggaagccctctgaaaatgcttagtcaacagtcggcttggcagacaaggtctgggaggggccacccgtatcgcagaggatgatagaagagaaaaaaatgacacccacctctgtctggggatgctgaaatcttcctggaggagtggtgaatgccaggaagatcgctgaaggattcaatgaaacaatatttctgaagtcctttacaacagggtccccaacccccggggtcatggactgctatcgggccatggtctgtctgttagaaaccatgagccctatcgggtcacagagcaggagatgagtggcaggcaagcgagcccgagctccacctcctctcagattctcgggggcgccattagattatcacaggatcgcaaaccctgttgtgaactgcacacacgagggatccaggttgcatgctgcttatgacaatctaatgcccggccgggtgcggtggctcacacctgtaatcctagcactttgggaggccgaggcgggcagatcacgaagtcaagagatagaaacgatcctggccaacgtggtgagaccccgtctctcctaaaaatacaaaaatgagctgggtgtggtggcacgtgcctgtcatcctagctactcgggaggctgaggcaggagaatcgcttgaacccgggaggcggaggttgcagtgagccaagatcacaccattgcactacagcctcggcgacagagccagactccgtctc

SEQ ID NO: 397290 - DNA, 284 bp, Homo sapiens
ggcatgtggtttagaagctgttgtttgaaggttgataaacttgcacccattttaacctccaaggagcactaatgtcttttctggaaagcagacagtcatgtggccccatgggggaacttcgcgtccggcataatctttatctgaaatcttccttgtcatgcctaaaataaagtgtcatcattcattcaaatgaatattcaataaatataaaagtttgccaactttctgggtctgagataagccccttaagccccttaagcctcaatctcatattcttgcaatgt

SEQ ID NO: 397291 - DNA, 493 bp, Homo sapiens
gccccctggtgacttctggtcaactttctgtcactgtgaattggcctattctaggtattttgcgtaagtggagtcatagaagtgtctttttgtgactgacttccttcacctggtatgtccaagttcatcagttctgtggcatgtgtgagaactttatttcttcttatggctaaatcctgttccgtctgtgggtatgccacattgtgtttgtccactcatctgcagaccaacacttaggttatttctactgtttggcttttgtgaggccgtaacgagcattgcatacaggtatctgtttgagctaatgcctgggaacgaactgctggattatgtggtgattctgtgtttagcttttaatactggtttctttcctgcagaaattcccagcctatgacatgtttctatgcaaataaatccccaatagaaaatagagttctcagatttcccaaactcacttgaccttgaaacctgtttttcctttgagaaacatctt

SEQ ID NO: 397292 - DNA, 352 bp, Homo sapiens
ttctctttctcatcttgcccttttttgaggtagcactgactggtatgttaatttcactggttcatttttcatttaataaatatgtacctaagatttacttcatgggaagtgctgtgttagatgctagtgatgcaaagattaaaaagacaggttgcagcctggagtgactcctttgggtggaattaaggaagcatcaaggaatttagcaactcagtgggaaaggattggggtggagttctagagggggaatctgcttgagctgagatagggcagacaatgagcacgaggtgctcccagcaaggggaataggtcagacaaatgtgggtgagtgagagaatatagagggagccat

SEQ ID NO: 397293 - DNA, 360 bp, Homo sapiens
attaggaaaccctgttagctctacctcctattatactgcgacatctgtccccacatctcctgcaaactccccagcccaggctgccctcctctttcacttggactttgcagtggtatcccaggcagattcctggccaccaattctttccctgtcccttatttcatgctccacacagcagtctaagtgatataatgtcttgcaattaaaagttgaatcgtgtcgcttctcagcttaaaacctggattatcgtcccaatgctgccgggatcaagtggaaaatcctcagaacagctggcatggcaatggaggatcaggctctgtctctccatcaaactccccttgcagcccctccctgcctact

SEQ ID NO: 397294 - DNA, 365 bp, Homo sapiens
gaggggaggggtgatgttggaggtataggctaagggactgctggagttccagccctattcatggactttgaatctctgtgtttggccgagtgaggtggctcatccctgtaatcccagcactttgggaggtcaaggagggtggatcacttgaggtcaggagttcaagactagcctgaccaacatggtgaaatcccgtctctactaaaaatacaaaaattaactgggcgtggtggcatgtgactgtaatcccagctacttgggaggctgaggcacgagaatcgcttgaacctggcaggcagaggctgcagtgagctgagatcacaccactgcactccagcctgggtgacacagcgagactctatctc

SEQ ID NO: 397295 - DNA, 518 bp, Homo sapiens
tggggcatgtgagtggaaagaggtcagtaaaatcagagattgagaacatcagtgaaggaattgtaaaggaaagtggcccataaaacacccacacatgcagtaatgttaggataccacttgtgtattctcttatctcagcccgagtagaatgtcttcttttacaaagcagtggcttagttttgtgagtcaagaagaatctggaggaagctggcttggaaaatcggacgtaagatggagagagttggttaggaaaaatttgtagtgatgaaacagtagagaatgacacagggctcaaacaatgacagtctcatgaagtagatgagataactagggaaatgactgtgattccaagatctgtcataccattatggtatgttgtcttacccatatacctgtgatcgtagctcattgtaagtgatgtttatggtgtagcattctaattgatgcttgttttgaagccttgcagagtctcaaacttccttccaaatcattatcaaaagattgaattgttgggcttt

SEQ ID NO: 397296 - DNA, 496 bp, Homo sapiens
cacacaatgctgatagatttgtgcatgaccaagcatacctttcaaggagctctcagcggaggtttgccctttgagacagacacagtcagtgcacagaaactgtttttttaagatatcatccaggagtcattcctagaataggaatggaatagacatgcctccctgagaagaaaggaagacagattctatactgttagaatttgaatctgtgttgcagggagatgaggaatttgaagccagactcttgggctgttaatgtatggctaagtggtgatgtggtgacaaccttgaatgctagtcctggaggtcaaatcaccagcagctggtgccatgggaggctttgcttaggggacacggctgggttctgcctggatgctgcatcccaagggaggcattgaggtgcggctgtgaggactccaaaccccatgtccagaaggatgagtaacagagatcctgtgtcattcattgatttcaataaaatatttattggatccat

SEQ ID NO: 397297 - DNA, 450 bp, Homo sapiens
acagagtagtgttgctattagtgttaaagttgtgctgatgaggcctaagagctctgctgataaggcctaagagctcttatcctgcttttctccctttactggaaattctgacaaacccaagagaaggccaaccagcttggagacctactaggtaaggcaggaaccacaagtagttcctgatctgttagtgagaacccctagtttgagtattttctcaagtccccccgccccccaccgtttgttttaactttgaaaataaccagtttacagtaatgagctatttcaacatgaggtcttttattgtccccctatttatccctgatattaaagttactcttattttgtttctgtcttgtcccacttatctttgaagtattactctgttttagaccttccaattcactgatttatcagacctttgaaatatattcttatcttccacagaattat

SEQ ID NO: 397298 - DNA, 344 bp, Homo sapiens
ttctgaatcatcccaatatcttgaagaaagggaaggggcagcaggggtccacccaccccttattatagatgctgaaagtacagaagtatgtcaggacttggtgacaaaaatgtctatagacacatcctgatgccatcctgctggtgcccctaccctaagccctgactggcagcaggttctccctcaccaggtaggctttgctacaaaaagatgaatttacttgttagatggaggatgcatattgaggccatccatgcctctgctgcaaaatcctttaggagaaagacaactggtatccaatatcttcgagtaatgaacttatcagtaaatgtaacacatgagct

SEQ ID NO: 397299 - DNA, 292 bp, Homo sapiens
caggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgaggg

SEQ ID NO: 397300 - DNA, 450 bp, Homo sapiens
cgagcggccgcccgggcaggtacactgtaaattgtatataactaaagtgaaaaaatggtgctctattaatttttttaaaggcaaagactgtgccttttcattattacaaaacatagtatataaatgatacttagattattattatgctaatgaactgtcagaaaacaattaaaaatccattcacacttacattcatattttaagtcaacaaataaatattgtgctgttggcatgtatcatctacacagatgaccaacccatggccctggccttaagaaactcttagcaacagtattgtctgtatgtcactttagaatttacaaaacgtttctgcatgcatggttactataaagatgataagatcagttagttacactatcttctaaattctgaaaacaatcacaaatttataaggaaaaggaagatggggagattaagtgacttggccaa

SEQ ID NO: 397301 - DNA, 170 bp, Homo sapiens
tctgatattcaaatgatgtgaggcacatagaattattgagatgatacctcatatgatatatggcaaatctttcaagtgtctaatttatcagattttactcctttctcctcaagaattggccacttttttttttttttttttttgatacggagtcttgctctgtcaccagg

SEQ ID NO: 397302 - DNA, 198 bp, Homo sapiens
cccctcctccacatgccaacttctttcaaacttagggatcaactctgccgtccccttcaccctctctccctctggtgtcgcacaggaacctccggctgttcctctaataacagcttgatcaggcctccctctcaccttccttattcttcttttttggaaaagttcctaaatttgtcattgtctgatcctggagaccac

SEQ ID NO: 397303 - DNA, 437 bp, Homo sapiens
agtttgaaagtgtttttctacacatggtgtgcttctaagtcttacctcagtcctgtaaggcagatggagcagacagtctgtcacaaattaggaaactgaggcctgagcaggcgcctgacttggccaagcttggaaagctgtcaggtcagggcttcagccccggccggaagtgtcccagactcacgcctggctcactgttgagcctgccaggagattccttttttcttttttcctatatatttcaaaatattttcattatgaaacatactttaaaagtttatacacacgcaaacatacattttaaataataataataggccaggcatagtggcccacgcctataatcccagcactttgggaggctgaggcgggcggactgcttgagcccaggaggttgagaccagcctgggaaatgtagtgagaccctgtctctacaa

SEQ ID NO: 397304 - DNA, 176 bp, Homo sapiens
gtccacaagggtctcttggttgtctcttggacaccctcaagggaatcacattgagcataccctagctgaagtttatcgtgatcgtttctaaataagaaattgtactgaaagttttaacttactgtttggaaagcaagtgccttgtttttgactgatttgtgtgtgtgctttttttg

SEQ ID NO: 397305 - DNA, 266 bp, Homo sapiens
gtgcaaggcactatgggtataactgtgaaaagaacagaaaatatatccattattctgtacatcctcacagaggctgtaaataaatactgttgacattagttatgataattcccaaccctaattatctgggcagagtcataaacagtgagactgtaggctgaaactgacctactaaattggaatcctacttgctgcaatatgaccttgccgggctggtcatcggtggagccttgtgatctatacagaatattgaggtaaggcaaatc

SEQ ID NO: 397306 - DNA, 304 bp, Homo sapiens
gtggttatatttcctctctaatacaaaagtttcttttcctctagcacttaaaaactgtattgcgtttttacttgcttatttttctatgtatttacgactagtttatctcaatctctgcaagagaaatctaaatccctctcaatgtgtatgaatcaattaatttcttctttttctgggagacatctctcctagagtcctttaagagtcctgctccaacatgaatgacttgctttctaagcctgctacacaccaacatcctgggaattctcttcactttctcctgcgttggattccttgtttccca

SEQ ID NO: 397307 - DNA, 497 bp, Homo sapiens
tgaaggcagagaaggaagggaggagggaatgattcaaggccaaaatggccacatttagaagatacctcagatgataaccatagttatgtgtgtgcaattttatttaacagtgatgtgtatgtggtggacaagttatatgaaatatctagtctttctagatatttggaagtgcttgatgtatttaaaagtggtagtagaataacactttgtaagtagcttttaaaaactgatgggaaatgctgtttggaagtggaattgttgaaccacctgggaggtgggagggaagaaattgcaaatggtgttttgccattgcaattattagaaaatttcagcttaaaaaaaaatggtctggtctcaaggatagttgtttgcaacttagctcttttataataatgtaaaaaaagatttgtctgtctttattttcaaaagctgactttatatagattctagcttctgacctaaatcatttccttgatataataaacttttacatgaaa

SEQ ID NO: 397308 - DNA, 230 bp, Homo sapiens
ttgatctcggacccgtcagacgctgaactatgtggctgaaatgcaggtaattctgtcagaatgggagaagagaagaatcaatgcagggtaggcaaacaaaagcccctgcttcactgacaagcacctttcaaaaaaattcagaaaaagaattcaatgatgaaagcatactatcaaatgccatgcaatagttggaaggaataaatgtatagcaacatatatagatcttagaa

SEQ ID NO: 397309 - DNA, 951 bp, Homo sapiens
gagccgctgtgcctggcttttccgtgcttctttaccaatgctgcatccagcacacttggagtaggagcgaaccgagagtcctcaatatctcatttccaggttctctgaggagctcctgtgacagcgcctgcctccctccctgtgcagtatcaccacgtgggccccggaggtgagaggaggttgggcacagctggcacaggtccctgacttgcccaagtgaaatagatctgtgccctggggtctggcaggaatccgcgtggttgcaaatggagatggactcatgcaggtcatttgtggaaagcagcaccactccctttgagaactccagagagggttttgggggaacctgagatgtggggatgctgagaacaaaaatatctgagaacagatgagatgggtgagcctcaagtgggaaatggggagagctgtcatttcaaggaacagcatgaggctgggaaggaaaccggtacatccaggaactctgggccactctgctctttacgtggaaagcaggaacccaggccaaaaggcagggcttggcaaaaagaccccaggagcattcttgccctggcaccttctctgccaggcccctgaacctggtggccatcagatgatttgtttcggggagccctgcagagcaatcaggctgactgtggacaatcagggcagagacggtagtcaggaggcagtcaggagcctctcccttctctttccagaggtagtttccttctgcctcttaaattcaggtagcttctgatcagatcaatccagaatctaggattatgctgatgtcgcagactcaccatgggaaacttgccctcatgaactaggatgactttccctgtttatcctcagcagaaagaaggcaaatgccctgtatgtgaaagcggaactgcctgtccctgtggagaggcctggctctgctgctctacccagcttgcttacaggccc

SEQ ID NO: 397310 - DNA, 1132 bp, Homo sapiens
gagccgctgtgcctggcttttccgtgcttctttaccaatgctgcatccagcacacttggagtaggagcgaaccgagagtcctcaatatctcatttccaggttctctgaggagctcctgtgacagcgcctgcctccctccctgtgcagtatcaccacgtgggccccggaggtgagaggaggttgggcacagctggcacaggtccctgacttgcccaagtgaaatagatctgtgccctggggtctggcaggaatccgcgtggttgcaaatggagatggactcatgcaggtcatttgtggaaagcagcaccactccctttgagaactccagagagggttttgggggaacctgagatgtggggatgctgagaacaaaaatatctgagaacagatgagatgggtgagcctcaagtgggaaatggggagagctgtcatttcaaggaacagcatgaggctgggaaggaaaccggtacatccaggaactctgggccactctgctctttacgtggaaagcaggaacccaggccaaaaggcagggcttggcaaaaagaccccaggagcattcttgccctggcaccttctctgccaggcccctgaacctggtggccatcagatgatttgtttcggggagccctgcagagcaatcaggctgactgtggacaatcagggcagagacggtagtcaggaggcagtcaggagcctctcccttctctttccagaggtagtttccttctgcctcttaaattcaggtagcttctgatcagatcaatccagaatctaggattatgctgatgtcgcagactcaccatgggaaacttgccctcatgaactaggatgactttccctgtttatcctcagcagaaagaaggcaaatgcgccccaaagtgctgggattacaggcgtgagccaaccgcgcccggccaggaatctttttaaagggcttttggactgctgtggccctctcaaagggtggtccagaggtgtgggttatcctctctcatggtgggcggggccgatagtgggctcagtcctggtagaggaaggccgaatagagcagaggctgcctctcctccccctgtctctgatttccacccagctgctgcaggtccagcactcatccatactactcgcggcc

SEQ ID NO: 397311 - DNA, 766 bp, Homo sapiens
aatccagaggctacatagatttttctgaacttggggaggcagagctacaattacggtagtaagaataaactaagagggaacaaacaggacattaaatcagttcgtctgttcagcagtgctccaggtacttgggactcatcagtaaataaaacagttcccttcatttcatttttcatctaaccgtgtccacttgctccccaccccacctccccgttaaaagggagcaatacaggctgggcacatggctcacgtgtgtaatctcaacactttgggaggctgaggtgagaggatcacttgaggccaagagttcaagactagcctgtgcaatatagtgataccctgtctctataaaaactaaataaggaaacagtgcagtcatccctttttgtccatggggtgttggttccagaacatcccatggataccaaaatccacacatagtcaagtcccttaggtaaagtcgtgccgtatttgcatataacctatgcacatcttcccatgtactttaaataatctatagattacttttaatacctaatgcaatttaagtgctatgtaaatagctattatactgtattgggttttttatttttttcttgttttgccctttctaatattttcaatccgaggttgattgactctgcagataaagtagactggaaaagtacagtcgtccttaggtgtatgagggagattggttctaggacccctgccaaaatccacaaatattctagtcccccagtctgccctgtggaacccgtgtata

SEQ ID NO: 397312 - DNA, 595 bp, Homo sapiens
gactcctgatctaaaaacgactgctgggacccaccaacccaggagcatctgcttcgcctggcgctcagtggccaactgtctggtttttgcactgaaagccccttgtctgtccagaagcccctcagtcccagtcttgggtcttgggctctgggcccggtgtggctgggatcgcaggcatgttcatggcaggtcaggactgcgctaagcctttggggaggatacttgaaaggggagtaatctgctgtctgtgtggttggagcttaaagtacagctggggctcaagagacacccagagtgcctgtcaggcggtggcactgtcatcgcatttgataaaggccaaactgagtctgggagagaaggggctggggccacgcagaatcagggcagggctggggccaaaatgcctggagagacagagtctgagagatacagagatggccagagacagatggagagagacagataacagagagatacagagacagccagagacaaatggagagagagacaaatggagaaagagagccagagacatacagaaagacagagacactagagtctgagagatacagacagacacagagacagccagaga

SEQ ID NO: 397313 - DNA, 292 bp, Homo sapiens
ttttcttcatgtggacttaaatgtttgtatttccaaatgaaatagatcccgggtgaggcgcccaaaggagaaggaaaatcaaaaccccagaaagaaacccagtagtcactactcgcctggcgctcagtggccaactgtctggtttttgcactgaaagccccttgtctgtccagaagcccctcagtcccagtcttgggtcttgggctctgggcccggtgtggctgggatcgcaggcatgttcatggcaggtcaggactgcgctaagcctttggggaggatacttgaaagggga

SEQ ID NO: 397314 - DNA, 514 bp, Homo sapiens
taaagtcagaatggagaaatgcatggagaacagtcatttctcataaagtcagaatggagaaatgcgtggaaaacagtatttctttctgtgaatcagaaaggacggagttatgtgattacgttctgtattctgaaaacagaagctggacacttgaggggtgctgtacatctaggaccttatttgtaatggaggaaagcacagtatagaggagacattaggatttcacctaactggccaggtgtggtggctcatccaataagcctagcactttgggaggaaaaggcaagcaggtcacttgaggtaaagagttcaagaccagcctggccaatgtggcgaaaccctgtttctactaaaaatacagaaaattagccaggcatagtggcacatgctgtagtcccagctattcaggagtctgaggcaggagaatcgcttgaacctgggaggcagaggtttgcaatgagctgagactgcgccactgcactccagcctgggcaacagagtgagactctgtctc

SEQ ID NO: 397315 - DNA, 911 bp, Homo sapiens
aggggagagtggagctgggtgagtgagtgagaggtttcagggaaggaagtaggggtagtaggcggagaagagaagagggagaaagattccaagaaaggccaggcccagggatggagtttccaggacaaagttgttgctgagagttggctggtggcagttgagggcagagaacccgggtggggtgggggtggggaggtaggagcaaggattgggaagctagaaagtcgggaatcagtgactgtcttggggaaatttccattccaaacaggaaaagcccaggagcatttgatctgtcctagcaatggacaaagctggcctcttcctccctcattcatttgttcaatgaatattgactctgtgtttctgagacgagctcaggtccaggccctagtcttgggaaagaatccaaggggtttgggatgcagacaaggaaacagttcatccagtaaacaatacttattgggcacctcctatatgccaagcatcatgctgggccctcagggagcccctagtctgatggaggagacaggtaataatgaaacatatacagacctggatcattacagctggggaagagagctcagatcataaagaggacccaggcaacggaaggtatcactagggagatgatgagctcctggaatggtccatggccaagaaatgctaaataccagaggggccctgacctagttgaggggcagaaaatgtatctgagtgaggcctagagcctcagaaggcctcagaaggcattagctcagtgcagaagggctgcaacagagtctgtgactttgaccaagcaccttcactcctctgagcctctgtttccttacctgtaaaatactagaccttcctaagccaccagggataccgaggaatagaaaagttagagcagaaatttcataaagtactaa

SEQ ID NO: 397316 - DNA, 428 bp, Homo sapiens
agatggcatgtgagccagcttggccaatgggaatgctgttttgcctgtggctggaactttccagaaggagaccattcccttggctgtactgggggatggtgagtccagagctgttggggccctgtgtgaggtgggatacacttctttgacactggtgctcctaagtcagctgtgcctagagggtggccattcttggactcccctgtgcgcaccaatagccctccttttgcccagattaactggtgttcagcctctattccttgcacctaaaggcacctggagcaataccatggggagttggggcaggggtgccaggccttgaagtcatctggggtggagtgggagctcaggagtggtcaggcttgatgagaagaaagtttcgtcactagagaaatggtgaagccaggattagaactcaaggccccccc

SEQ ID NO: 397317 - DNA, 585 bp, Homo sapiens
atgcaacagcagtgaacaggggcatggccgtggaaggattttcaggagtttaggatgaggtttaccatctatgctgttgccagcacttggagcacagtgattaaagacaaatttgtgcatgcttggcacaacctctggcctgcgactgtgttcagtgatgatgaacaagatggtgactttgaagagttccatatgtcaaatgagaaaaaatgatgtctggcctgcttatatatgaaagaaaatactccttcagagtcctgaaagctagaaaatgggtactgaagtttttaacattgataatgagactccagttgttcattcattgaccagggatgaaatagctgaaatggttctgagtcaaggtgatcatgaaaatggtgacaatgaagatgaatattgttaacactgtagaaaaagtacctaaagacaacatgattgtctaggcctgtttgtgttgctataaaggagtgcctgaggctggttaatttataaagaaaagaagtttactttggcctggcgcagtggctcacacctgtaatcccagtacttcaggaggctgaggcagaaggattgcttgagcccagg

SEQ ID NO: 397318 - DNA, 463 bp, Homo sapiens
acctgccctacttaatgctgtaggaggagcaggcggaggagagcagaatgggcaggaagaaaagtggtgtgagaaagcagtgaaaagtctggtgaagtagcgtaagaaaacaggacgattagatgagcttgagaaagccatcaccactcaaaactgttatactaaatgtgttaccataccaagcacttgctctgaaatttggggactgagtacaccaaatacgatagatcagtgggatacaacaggcctttacagccatttaggtaggtacctaaatgactgtggagaaactagagctactagataaagcacttggacttcccctgttgccattgggaagccatttcagatattggagcaggtccttgagagcagaaacgtagcctcgtcttggcaccatgcatcatgtaaacatcagtaatgctttttgaatgaatgaatgcctcaaactgtagtttacagg

SEQ ID NO: 397319 - DNA, 131 bp, Homo sapiens
ttgggtgacagagcaagaccctcaaaacaaaacaaaacctctctgcaaattccttccctctagctactctgaaaacacacttgatgagaatgtcaggattccattcagaattatcccagacaaatgactcc

SEQ ID NO: 397320 - DNA, 787 bp, Homo sapiens
ctgtgccactttttattattttaataaactaaaaacgcatttgttagtgtttatttcatttgatttttgctgattcttggcagagccctacactgaggcaatgtcttttaaaagttctaaatgaaacaactgcccactggcaggaaggcctctcccctgtgtgtgccccatctgcattctgacggaagcagcaaggccttggcctccgagttgggagctggcactggcagcagtgagtcagcccagctggaccccctacataggatgctgtgggggtgggcagcccaggtagcctctcccagaaccaggcccagtgccctgaaaagactggggccctactgatgggttttcaaccagcagacatgatttgattccaaaactggcacccccttggcagtcagactcctttctgggggccgtggctgagtgatgtcaccccttgggtatttcccaagatctccaaacaacagaggagcctgggacccttttgcatggtggagagagagggtggcccagggagaacagtccacacccagacacaccacggggtgacttgagaactttttcagggacatgaaggaagctcatccaatcagatcagataatgactgaggaggtgagaggaagagagaggcaggcaacatagtgtcagaaccttgaagagtctttgggacattggcaaatcagcagtttttaaactcaaatgaccataacttttattgccttgtgaagtatgggagctagataataattatagggacagtaaaatagacagaggtgagtgtgg

SEQ ID NO: 397321 - DNA, 572 bp, Homo sapiens
cgcgcacacatcctgaggtcagtggggcaagttcaccatgccctatgacagatggagaaattggggctgagaggcaggtgataaatgcacagtcctcagaaggggctgaggcaagctgagcccacatcttccccagctctagtgcccgcccaggacccccactccatcagccatcagtggccagatccctgagagcacctgctctggggtcagccacgtgcaaaaggcctgggagccacaacagggaagaaagggccctgcccgcccgcagctggcggtcactggggagaacagacaagagaaagcgtggaggatggcatagctcagagtggggattgtaggcggcagaccacactccgtagtaacccccagtgttgtgggatattaatgtgcattacataggcaaggagttatgtgatcaaataggtttgagctaggcacggctgcgcgtgcctgtagtcccagctactcagaaagctgaggcaggaggatcacgagtctgggagtttgaggctacagtgagctatgattatgccactgcactccagcctgggtgacagagtgagactcaa

SEQ ID NO: 397322 - DNA, 418 bp, Homo sapiens
aatcagtaagtcaacattgatatattaagttctttatatcattatggatttctgatttttgcagtaggttatatttttaaagtatttttataattttgataatcagattatcctggatttggccagtcagggagtatattcagggtggtgcctatatccttttgaaatacctgtcattcttttaagcacttccatactgtctggcacagtaagattgttattttgtgctttctgggctccagccctcgagtcagctatttcttcaaggagctcttattccttttagtagagtatggtagttagaaacgagacttgagtatgcttgttgctactgaggtgtaattgcttctagcttctttcaacaggcagaactaggaaatatatttacatacatgcatacctacatacacacaccaaa

SEQ ID NO: 397323 - DNA, 341 bp, Homo sapiens
ggacaagtaggcaaaaatgatgggatccattagacaagtggtgctttagctagaagcagggaggcatcgatggtaacagggggaaaagcaagtacttggacattggaggcagagggtctgaagacttggtggtgaaaggattcagaagttctgtcctgattagttccatttcccttgagcgtcactctccacttttaagggcaaaaaataggagcacagtagtccctacttcatggagttgttgggaagattaattgagcaaatcctgtgctggtaagcacacagcacagagccaaggccacagtaagagtgatcaataaatggcagctgaccttgcatcc

SEQ ID NO: 397324 - DNA, 286 bp, Homo sapiens
ggagattgagactgcagtgagctatgatcatgccacagcacttcagcctgggcactagaacaaaccccaactctaagagcgtggtccctactcttaaactatggccttgtagcaactcatctgaataccgaagatggttggtgctccatgacctctgttatttcctttattttttatttttaatagggaagacggggagaattttagccttttttgtgtatgtgtgcagtggtgtgattgtagctcactgaagcatctacttcttgggctcaagctctcctcccac

SEQ ID NO: 397325 - DNA, 203 bp, Homo sapiens
ctgttccctggcttatgggcaggagggagctggtgaggctttggaaattctattgctaacactaacacgggagatctttctggcctttctggttttggcaatggctctttttctcctgccttctaaggtactacaggaaaaaatatttcctctacctccatcccacattgcccaggaacattttaaagattgaaggctttctc

SEQ ID NO: 397326 - DNA, 745 bp, Homo sapiens
ggtgggagtttcccagagaacttatcttcttctttcttcctctcccctgctctgtgagatgtggttcagatcagagatcgcagccgtgggacaaatggctcaacaactgctgactgtggtgccagccttgggactgggggaccttgagatggacaactgcatgcttgaattttgagtctgaagggaaaagaagaggtgcgtgggggtgtgtgtgtatttgcacatgaactcacttgcctgcacacacccaccgtctgaaaggcctctttcctctcctcagggactgtagtgttggtgatttcagctgttccctgctccttgatgatgaaaggggagcgattatgctttttgctgggtgtctgtgtttaattgcagggatataataactacaaattctccctggccgagacttttctaataaaaggtttcttccatcccagctgctttctcttccctttcacacccccacccccatcactgtcctagcacaaggtcacttagggttttaaatgagagagagacacacacatgttcaggtttcgcgtagagtgtttttttaaagctcctcctccagacccatcattatggagatcagctgcttgcccccacctctgcaccacctcccctaagctccttgctgagtttatacagaacccaatttttcagtctcttgggtgtctgctttttctctggttctgaagaaataagagacgggtagaacagggaagaccaacaaaagaggttt

SEQ ID NO: 397327 - DNA, 369 bp, Homo sapiens
ctacatccagtagaacccggaaaagggagacagggactgacacacccccaggcttgactgaaaggctgctgatgggatgtgcatccctcccctcagtcccttcacccaggggtacaatggctgagtctcagaagccaatatgcagcaaccatgcaagcgcctcaccaatgcagaactgtacacaggatgctagacccagaaagcatgttcttacagacaagaagctcatacttgggtggagagatgcattcaggaccccgaggttctgggggaggtttaaaaaggaaccatcccactcgctatagaaggagacgggtcctggtctagacacaggcgctgtgtctcctctctaagccctactgatggcag

SEQ ID NO: 397328 - DNA, 582 bp, Homo sapiens
caaccatagaatggtgttaataaaagactttatgtttgaacagaaacctatataaccacaagaggttaactgatagagacaacgggacttaaactaagtgagtagctgtggggaaagggataggggaggtggagaatgaccaaagtttatatttggacagtagaaagcaaatctaagttccccagcgcacagagatctggagagaaagccgctccagaactgagcaatgtgttttccagggacaaagtatattcactttatcttcacaggtttcctttttctccatagaatgaaggactgacttactctaggtctcccgttagagaattccctccattccattaaagaggctgttatgatgttatgttagtacatgcctgaaagtacaaatgaccatcaaatgttgcaatggaagagttttttgctttctcccatagccttgtttagaatctccactttggagcaatttccgtattcctctctcaatcgattcactattaaaattttctaagacatttaagaagtactaacaatctgtcacaaactctttcaaaaaaacagaagggaagagaacatctccta

SEQ ID NO: 397329 - DNA, 672 bp, Homo sapiens
ggttgctgctggagctcttccgttctggataatttcacagatattttcaagagttaaggagataacatttccgtcatttctatggattgtaccagctgcttcgtctgtttcccattgtataaatatttatacaaggtcaaaatgtaaatgaagtaatgcagtggttgcacagatgtagttcgtctagagcagtggttctcaagcagtgtcagcattacctggggtttggttagaaatgcaaatctttggcccaaatggattactgaatcagattctggatatggggtccaggaatctctgttcactagtcctgtaggtgattttgatgctgccaaatgtggagaaccactggttttctgtctgtacaacccttttgaatggactctttaataaataattttcactcacagacgctggcagttggtttatactactttttctaaagtcttttatgcagcgttttaaaaaaaagcctttgattttgaaaagattcctgtagtgatctaaacttcttccattttttcccctcaaactgttaataagtaggccaattccatagttaaaattcaggaacatgtcagatgtggcttaaaaattctagaaattgggcttttgtctaaatatccataacacaaagcttctagactgaagttctttttagtcttaccaaaa

SEQ ID NO: 397330 - DNA, 352 bp, Homo sapiens
ccctagaggagtgacctgtataaaggcagggtggcgaaggagtgaggatatatgtcatccgtgaggacatccagacaacagccactgcacaggccggtggtcaggagagaggtctggacgggggacagccttgggcatccgtccaggaggggggctgggaactgaacctgggccctccagcctggacgagagagcaagatccatctctcaaaataaaataaaatgctcccaggtaatgataatgtcccaggcttgggccccaaaaggaatgtttttgttcctaagacagtctcaaaagtgggcactgtttcccctgctctgcctaacaaatggaaagttcaataaattattg

SEQ ID NO: 397331 - DNA, 506 bp, Homo sapiens
ctgtgttgttgctgttgtttcagagacagggtctcactctgttgcccatgctggagtgccgtggtatgactggagctcactgagcctcaaactcctggaatcaagagagcttcccatctcagcctcctaagtagctgggattaccagcacatgccaccatgaccagctaattttcaaattttttgtagaaatgaggtctatgttgcccaggctggtctcaaactcctggcctcaagcaatcctcctgcctcagctttccaaagtgctgggagtagagtgcatttcttttaaaatttacttactaattttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactt

SEQ ID NO: 397332 - DNA, 492 bp, Homo sapiens
ataaaaatgtgagaatccagaatggacacaatatccacattttaaataattttaaatattgcactaaaatatttatactactgagtttattggcacctgttaaattttgtacctgagccgagtgcgtcactcatctcaccctagtcctgatcctgttgggaagtctggaaagtcaaggatttcatggagttagggatccttgactaattggtgcttcatatgttctcattacttgctttgggtaagtcttgtacaggcaggagccaccatgcccagcccccaaatatattaaatagggtctgttaccatctcagtgactgtcttaaaacaacctacaaacttccagcaccatttcctagcatgctggctcagcagactgttactccgtgtaaatcaccagactgcaattctcaagggcgaccaatgcttgtctcctttccattacagcaactcttttggagcaagggtaataaaagactttgtcaaacaaaa

SEQ ID NO: 397333 - DNA, 475 bp, Homo sapiens
aacccagctacttgggaggctgaggtaggagaattgcttgaactgggacctgcaaggcagaggttgcagtgagtcgagatcgcaccactacactcctgcttgggctacacagtgagactccgtctcaaaagaaaaaaaaaaaatccttccacacagactagactgaaatgcactctaaaggtaagtgaggcagccaggtgcggtagctcacacctgtaatcctagcagtttgggaggccgaggtgggtggattgcctgagctcaggagttctacaccagcctggacaatacagcgaaaccccatctctattaaaatataaaaaattagccgggcctggctgtgtgcgcttgtagtcccagctactcaggaggctgaggcaggagaattgcttgaacctaggaggcagaggttgcagtgagccgagatcgcgccactgcactccagcctgggcgacagagcgagactccatctcca

SEQ ID NO: 397334 - DNA, 336 bp, Homo sapiens
cccattttagccccgtgtgggactccccaccctctggctccaggaggtggtccagggggacaaggagatgcccaggctaatgggagacaaaacatccttgacacccagacagactaatggccagaactatggatcctggacagctgttgacttgagggctgtacaatggaatggtcatagatgggaagatcaactagagagaagagtggttttcagaaaatgtcctcgaggagggagtatggggcagggcttaagaaagggggtgcagcaaggggggaaaccaagaggcggaagtaggcttctaaaaggccacacactatacctctcttctgcagt

SEQ ID NO: 397335 - DNA, 268 bp, Homo sapiens
ccccaaaagccacactacctgagttcagaaccctgggctatgccactcaaaagccctgtgacctttgacaagttagttattctttctgggccttgtctcctcacctgtcaaatggagagaaccttaccccttagggttgttgtgaaactctactgcttgtggagatggtaaaagctcagtaaatatcattttctagattttctaaagatctattattttcaagaatactattattcttctttctgaaataaatgataattttttcccc

SEQ ID NO: 397336 - DNA, 231 bp, Homo sapiens
gggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttgg

SEQ ID NO: 397337 - DNA, 135 bp, Homo sapiens
ccaagatcgcaccactgcactcaagcctgggtgatagagtgagactccgtctcaaatatatatttaaaatttaaaaaatgtatatctatatttaaaatgtgttttgattgatccactagggacagtcctttaatt

SEQ ID NO: 397338 - DNA, 191 bp, Homo sapiens
ttaagatatacaaagaggcattaagaataataaagcatgtcttggatacccaccaaacagctggagaaattaaacatttatacagttgaaactccttgtcatccttccccacttgcatccctctttttctgcaactcctgaagggaaacactgtcttgaaattggggtttataattacccttcatgtcttt

SEQ ID NO: 397339 - DNA, 2850 bp, Homo sapiens
ggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatc

SEQ ID NO: 397340 - DNA, 310 bp, Homo sapiens
gctttgttctttaagtacaatcatagacagcaattctacataaagaacaaagaataaagttagaagacactcaaaggaacagggagaaagtcaactgcagttaaacgtctttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatc

SEQ ID NO: 397341 - DNA, 2766 bp, Homo sapiens
  misc_feature (2757)..(2757): n is a, c, g, or t
ggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattaatttaaaacatgctcgcgtggntttcatgca

SEQ ID NO: 397342 - DNA, 2830 bp, Homo sapiens
cggcacgagcggcacgagcggcacgagcggcacgagtcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatc

SEQ ID NO: 397343 - DNA, 1774 bp, Homo sapiens
cattggatggagtgaaaaacattcttagctgagaaaaacagcaagtgcgatgtgtccgaagtgagaggaacgtggcatatggagtcatgaaggaaggcagggatagccaaagagaaataaggaaaccaatgggtatgagagcagagtggagcataggcagggcttggatctattactggtttctgtgacatgtgttatgaagagtatcatttcactgactggctctgcccaaatatgtttgaccatatttacatcccatctctctcactctggactgctgaagaagcttacactatcaacgtactcctttttttttttttttttttttttgagacggagttttgttcttgtcgcccaggctggaatgcaatggtgcgatctcagctcactgcaatcgatgtacttctctcatgtgtactcaactattccctctcaaatgaatcctttccattgactttcatgacttgaatacagctctcccatctcacctgtaaacaaacagctcctccctgactcctttagctccctgcaggtattgctttctttcctactctttatagcgagatgtgctgaaagcacttccctgtcttcactttcttgccttccatgcacccttctctaatttagcttccagcttcatcaaaacaacttttacttgcaatgactgactgttgtccatcccatagtcctcttcttagtaaacttaacagcattaaataaaaactgtcttcttctggagcaccaacttcccttggcttccaggatagcccagcctcctcctccttcaggtctggtgatatactctcagtcttgtctgccaggaatcagttactaatactggcaacgtcaaaatccctcttcttttttaccccctaccgtctccaaagttggtttcaacgcccttccttggcttgctatgagaatgacataggctagttataggatctgctcatttaataattgtgaggatataatgagttcatatatggaaagtacttaaagtaatgccaggcaaatgatagttgccccttgagtcgatagctgtagttacaatttgtggatgaaacctgaatgacatcagtccatacctatgtattcagtggcctataactatctccatattcactctaaaggcacatcaaactcagtgtatccaagaccacatgtatgtcattcttgtgcttcatcctgacaaaaataaacctggtctctcctagtgtgtcctgcttcaatgagtggtccaaccattctgtcatttgcacaagccagcaaagtaatttggcccactaaatttctatgaaaagcttccatttctcaacattccctctgccagcacaatagccagagataccatcatctctcttctgagttctataaaaagagattgccttgttttcattctgtcgactcatcaccccctataagttctccccccaacccccattgccagaatgcttatttcagaagaccaccctgagcccccctttgcttccagcctttccatggcttcccgtgactctcaggataatgaccaaaatccttcacatggtttgccaagcccagcctctgaggactgtcccacacatctcccatcccacctcctgctgttctctccactccagctgtgcatgtcactttcagctgctcacacacactttactctccctgaccagaggatttgtacatgcaattcatcatgctggaaagctctctccacctttataagcaatgtcttatgcatccattatcacagctcaaacacatttcattttcg

SEQ ID NO: 397344 - DNA, 270 bp, Homo sapiens
ttctacatatcatttctaggccttgaatttgaatggagcatctgctgagtataatggacctatttggccttttatctcattttttgtgaagctagtcaaatatgtatccttccactagggtcagcatcgactagatggactaggaagaatttcattagaaaatgagatctcatgggagacgataaagaccaggcttccaagacagagatgtgagttcaagtctctggtatttactagctgaagggctgtgggcaatcatgttaccttctt

SEQ ID NO: 397345 - DNA, 182 bp, Homo sapiens
gggggatcacttgaagccagaagccaggatttcgagacgagcacaggcaacaaaatgagaccccgtctctccaaaaaacaaaaaatctgatacagtgttgtgagcctgtaaacccagctacacaagtgagaggatcacttgagcagtgagctgcagtgagctatgatcacaccattgcattt

SEQ ID NO: 397346 - DNA, 190 bp, Homo sapiens
gtgacatgtgcctaagtcccagctactctggaggctgggacttaggcacatgtcaccaggccaggctactctggaggctgaggtgagaggattgcttgagcccaggagttcaaggctgcagtgagccatgattgtgccatcgttgtgccattgcattccagctttagtgacaggacaaggtgcggtctca

SEQ ID NO: 397347 - DNA, 327 bp, Homo sapiens
acagattcaaagtacatttttagtacttttgaaggttcttatatacagttaactttttagtctcagctacctttggtgacaacatattttactgtttactcttctgtgtttttcaggttaacgcttcatgtgagctttccttgtttagcttaattatgtgtgtttgtccatctatgtatttttgtaataatttgctagccaaatatactttgccactatacttaggtgcctccagatggtgtttaataaatctgggaatagctagtggttcagaggtgagaactggattgaaatcttaggtctgctactagaaacggtgatcttctg

SEQ ID NO: 397348 - DNA, 605 bp, Homo sapiens
actctgagcccatgttccgcgggcagcccccgacatctgtgcagatggaggactggggtcaccctgcagctataccagccagcctgctgagaagattctgcatctcctaagatgtcgcttgctattctgacatcatatcttggtctcttttgtttaattatgacaaagcattctctgcaaaatgccgctgttctcatcatcctggtccaagccaagttctgaatctgagagcgggacaccagcccgaagccaaaggtgagctcttcacatgggaaaaccagcctgggttcctggattcttctcagaagagaactaagactattagaaaatagaattctgcaatactttgttttcacaggtgtagaaaaattgtattcgatttttacccttggcctattttattataatgacctctctttttcctgcctttcaatccagctgagacaatgtatgcatgtttacatcatgtgtgtatatacatctacttgcacatagatgtatatagttatatatgtttaatgtatatatgaataaaatgtgcatacagcagacttagggacttctctggagggaggaataaaggttgtaaagtagaagaatatcta

SEQ ID NO: 397349 - DNA, 743 bp, Homo sapiens
caacccaaatggttggatttcaggcccgagcccccgcggcccattggacttttgactttttttcagcatctgttggaaggcaatattttgaaggttaccattaaaaatttccttccttttttttttgggaaaagatgtctcgctctgcactccagcctgggccacagagtgagactccatctcaaaaaaaaaaaaaaaaaaaaaaagaaacatcagcctgtatattccagtagttctcacagaagaatgaaaatccgtgctgtgcaaatagatcagtagtgagtgagtgttaagtgaaagatgagctaggttgaagaaaatatacattttattgatgagccactttgctatctctccttccttcctccttccttccttccttccttccttccttccttccttcccttcttttcttttttcttttcttttcttttctccctcctttcttccttcccttcccttcccctcccctcccccaggctggagtgcagaggcacgatcctggctgactgcaaactctgcctaccaggttcaagcgattctcctgcctcatcctccctagtggctgggattgcaggcatctgccaccacgcccagctaatttttgtatttttacaaaatacaaagagacggggtttcaccatgttggccaggctggtctctaactcctgacctcaggtgatccgtccaccttggcctcccaaagtgctgggattacaggcgtgtgttactgccccagcctc

SEQ ID NO: 397350 - DNA, 378 bp, Homo sapiens
tctctggagtagccttggaggggttagatttaggtagctacatggagtctccttacattctacaaagcaaagcagaatgagtaaggatgtaggtaaagtgatagatttaaaagcaagagaaggagggagtactctaattataacttctattaatggaatgaatatgaggcaaggtcattagctgagtgagtggaaggaaggcagcaataaaggattgaatgagcaaaaggtatgaactcatctcagaaagatagcacaagtttattaaagaagtgtaataggtttatctggtagttttgagtgcctgtttaagttttgtggccatagatttaaagtgagaccagtttttgagggtttctttcattagttctgttgctt

SEQ ID NO: 397351 - DNA, 432 bp, Homo sapiens
catctggatgtatatgtgcaggtcacagggcatatgatggcttagcttgggctcagaggcctgacactttcacttctagatgaaggactctcaaacatttcttgtaggactggtctagtggtgatgaattccctcagtttaaagtatttcttttaaacaaatgaacacttttctctagatagtgaatctaaatctcctccagcttgttccattgcagattgacttatataatttggtctgaagataattcatcttagagaagatgatgcactcaaaacagagaagatgttaagaggcttttgaaactataaagcagtcccactgctgttgtccgagtttatcaactcttttgcaaattatgtatgagtcaacactactgcttacctggcttctactttatgagtaacagctaaataaatgagtctaacttgg

SEQ ID NO: 397352 - DNA, 866 bp, Homo sapiens
ccccccgctcccccacacctatcggctagtacgaggccgggtggactcggccgaggaaactacattagaaaaatagtccatgtttaaaatttgttcaaaattgtgtagccacaatctaagtggttcttgagtagaatatctgatatctatgaggatctttaagagggaaaaaaaatagtaatcagcatatattgaatttttgttttgttttgtttgttttcttgagacagagtcttgctctgtcacccaggctggagtgcagtggtgcgatcctggcttactgcaacctctgcctcctgggctcaagcaattctcctgcctcagcctcccgagtagctgggattacaggtgtgtgccaccacacctggctaatttttgtatttctagtagatatggggtttcaccatgttggtcaggctggcctcgaactcctgacctcatgatctgcccacctcagcctcccaaagtgctaggattacaggcgtgagccaccacgcctggctgaaatgcttattattaccaagaactcactttatgtgagttttattaaatcttcgcaataactgtatcaaggaaccatgagctttgtcttatagatggcaactgaggcttaaatgaggtcacctgattcgaggcaattgtgtgatctttcagaattagtccacatctggagtgggttcctagccaacgatacttgaggactggcctatcacactgaaatgagcacaagcagcaggaaacagaaacaccagactagaaggaattctttttgacatgcttttgtaatgaagcattttggtggacattatgttccgttatgggctaaactgtttccccttaaaattcatatgctgaagtcctaactc

SEQ ID NO: 397353 - DNA, 610 bp, Homo sapiens
tctcgatgacggggttcttaatagatgttaggatttataacataggcagtcaggtcatccgcaaacagttctattcctatttataaataatagaactttatttctcacagttctggggattgggaagtccaagatcaaggcactcccagatttagcatctagtgaaggctagctttctgtctccaagattgctgcatctttatgtgacaaaaagcagtagggcaaagggatgaatagctttctcagacctcttttaggttattaatcccattcatgagggctttgctttcataagttaatcacctcataaaggccttacctcttaatgctatcacattggcgattaagtttcaatatattaatcttgtagggacacattaagatcattgcacctgagaattacttttactggtactcttgttttttcttgtgaattttagttattgtctagcaccctttcaacctggatgactgccttttgtattttcctagtgacaaattcagtttttgtttatatagtaatgtcttaatttcccctttgtaattaaggatagttttgctgaatctagaattcttggttgactgttttttcctttcaacacttttacca

SEQ ID NO: 397354 - DNA, 327 bp, Homo sapiens
aattaagagctataatttaggctctctgactcctggttaaagctctttccatcacctacagaaattttattaaatgttaaaggttattaaacccaaaatttttatcttttaaaagatcttctaatcaacaaattcaactgttacattgcttacccagtcttataatcaaatggacaataaaaatgcccaaaataaagtgagaagtgaacatacaaaattaaactagataatcccctccaaataactgacaggaaaattaaaaactaaaccccccgccccttgaatgagatatgtttacattacagcagttagctttttacttcatca

SEQ ID NO: 397355 - DNA, 317 bp, Homo sapiens
catacaagtgaaaaatgagggacgatgtactgctgactaaattagaaattaagggagaaaagcgcccagtgttaacaaagaagcaataacctgatgctcacactgcggacggtgttatgaatcggcctgacactttggaaagcaacttggcagaatttgtcaagagctgtaaaagtgttcatactgtggcacggtaacgttactcctgggaatccaaacacagaaaccacttcagaaggaccagtcactgtgacatcgcttataaggaaaaaaaagaaaaacaacaacaactggaaaaaacctaaagggcaacatca

SEQ ID NO: 397356 - DNA, 255 bp, Homo sapiens
gtacgaattctttgttgtggactgtcccgtgcattgcaggatgtagagcaacagccctaccctgcactcactggctgcaagtagcaactcccacaagcagtgtcaagcagaaatgtccccagatactaccaatgtcctattgtcgggggaggatatgcaagtgtgggcaaaactgtctccgcttgagaactactcacctagaataagagtcctaaattaaactaaaacaacatagtgttgtgggtagcaactatc

SEQ ID NO: 397357 - DNA, 561 bp, Homo sapiens
agatggtgccattgcactccagcccgggcaacagagtgagactccatctcaaaaagaataaataaataatcaatcaggctaagaaagcctaaaaccagactttttcaggatttaggcagtctgctagtcagaagaaaactctggaagaagataacgttccgagtctccacatgtactatttttagtacccattactcagcatctactcaatagttaccagccttgctagaaaggacttaatttgctgaaaaccaagagggaaacaaaatagacaatagaaagagacccaggcaggggtgattcagatgttggagttatcataactatgatatattcacaaaataaggaaaagatggagaatgttgagatatctggaatctagctacttgagaggcagaggtaggaggattctttaagccaaggagtttgagattcagtgagctatgatcacaccactgcactccagcctgggtgacaggaagaccctgcctcaaaaaaaaaaaaaaaatctggaatctaacaaaaagttaaatggcaattctagaactagaaaacacaagt

SEQ ID NO: 397358 - DNA, 653 bp, Homo sapiens
cagagtctgacgccaggaggtgtgggggccattagggctgcattctggttctcctctccttcaggcacaggacggaattgtgctttccagctccatttgcagtaggtcttggccatgagacttgtttcggccaatgaagcttaaagagccagtgagagactcaccacacacccttccctctactgtggtggtcatggtagcatgcaagataaagcctccatcattcagggtcactgtgtgaccacgatcagaagaatgccccaacagaccctcatggaacattacagcccgaacaagaaaatcaatgttctatgcggctactgagctgtgaggggttctggtcactgcagcatcacctatcccctgctgaccgagagactaagtacccagtgaagtctagataatgtgaattttgtttttgttatttcaaaatatcaccttttgaaaagaacgtgggaatgcctgagaagtcagattccgactgaacggatcccaaggttgatcccaaggcaattcaccagtcgaggatcctgacacattagttatttagacttaaaaggagaaaaaataaataatctcagctcctggatctaaatgatgcctccatgaattaaggatttaaaaagtcacattgagccaagtagataaataca

SEQ ID NO: 397359 - DNA, 362 bp, Homo sapiens
ccgcctcagcttcccaaagtgctgggattacaggcgtgagccatcgtacctgccctcgcatttgggtttgactgatgtttcctcttagggagacaggctctgcaggtttggcctgatactgcataagtgatcctctgtccttccgagtggatcttgccaggagacatatgatgtcagtgtgccctttgctgaggatgttcactttgattacttgttttttctgtactgtaaggatttttttccctttgtcatcaataaaccatttgtgagatttgagtctgtaaatatcctgttcccaaaaacccttccccaaatgatttgagcatctattgatgattcttgcctgtagcgattattactag

SEQ ID NO: 397360 - DNA, 380 bp, Homo sapiens
cttcatattaatctttttctccaaagcagaatcattgcttgggttcatttttatgagtagtagacctaatttgattttactgtcagcccaaggaacatctcttccatttaatttggagttgttggaagtgtcgtgggattttttttaaccaaggtggagcacttctttttcttttcttttttttttttgagacagagtctcactctgttgcccaagctggagtgcagtggcacgttcttggctcactgaaacctctgcctcccaggttcaagcaattcttctgcttcagcctcccaagtagctgggactataggcatgcaccaccatgcccggctaatttttttgtatttttagtagagacggggtttcaccacgttgat

SEQ ID NO: 397361 - DNA, 469 bp, Homo sapiens
ataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccct

SEQ ID NO: 397362 - DNA, 222 bp, Homo sapiens
tgacaattagaaaacaaaacataaaaaaaaatctctatgcttcaaataatttaaatctttactacaactatagataaacatcttaaccgggcgtggtggctcatgcctataatcccaccactttgggaggccaaggcaggaggatcacttgaggtctggagtttgagaccagcctggccaacatggtaaaaccccatctctactaaaaatacaaaaattaac

SEQ ID NO: 397363 - DNA, 376 bp, Homo sapiens
cctggaccctgctcagaggactctttacagggatgtgatgctggagaattataggaacctggtctccctggattttcggtctgtcacccaggctaaagtgcagtggtgtcacctcggctcactgcaacctccacttcccaggttcaagcaattctcctgcctcagccttccaagtagctgggactacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacagg

SEQ ID NO: 397364 - DNA, 416 bp, Homo sapiens
ggctcggacgctctcgtgagactgctacaccatagctcacggcaacaccagatccttaacccactgaacaaggccaaggattgaactccgtgtcttatggatactagttgggttcattaaccactgagccaggaagagaactccctaaatcaactaactgttaataagcatatatgaaataggaaacagccaagatgcaaatttgtgtgcataaacaggttggctaaatgctataaggaacaaataaagaaaatataagttactggccttccaatttctcctacacttaactgtaactccgtaactattgttaggagaaattctttctgttttttttttttttgtttttttttttggtgggtttccccggaaaagggggatccctttaggttcaccctgagggtttgcagcttggg

SEQ ID NO: 397365 - DNA, 140 bp, Homo sapiens
aaaatggtaaaagaaagtatttccccagggacactgtagaggcagaaggaagtaataggaaatcagccttgagacagtggacactgttaatacctgtctcttttttaagatatgcacataagaaaggcaaatttttggag

SEQ ID NO: 397366 - DNA, 751 bp, Homo sapiens
agctgggattacaggtgcaaaccaccatgcccagctaatttttttgtgtttttagtagagagggggatttcaccttgttggccaggctggtcttgaactcctgacctcaaatgatccacccaccttggaagcctttatcttttagctaacgaatggttaacttggttgaagtttggggaagggagagttagaactttctctgtctttgatggctggctgagaatacagggtaaagaactgtccagtgttgtgagtggtgccttagagttgctcatagcaagaaaatcacttgggagggtggaagtggctctcagatggtcattggttacctataacttatttaaagaagaccttgagaagttgggacatatcttgtcactgaggaaattgtgccaaagaactgctgctttattaacgcatttgatcagatttgaaaagagagctctgtatacactctttttctaactccaaagaaattttgtttctagaaagattcaattaccgtaatgatgttctttggaaatgtgcctttttgcgtgtatatcttaatatggataaagttccaaggtagttcaaaggttttaataaaattttacttaccagagtgatgtgaaattgggaataccctgtgtgaatggttaactctactttaaattggaaggtcagtgggagtggggatcttcccagtaaatcttaaatctctgtgtacgtgtatctctgacagcgaaatcttactggagattgcaggggt

SEQ ID NO: 397367 - DNA, 545 bp, Homo sapiens
ctcatttctatatctccctcagctggtgattttggggcagggacctgtttgattctccctgggtcctcagtccccaggcttgccacgcactaggagctcagatagtgtttgttgatcacatactacttttgtgtcccctactgttgcctagcaaagtagggcccctggtagacactcagtttataatgatcaatgcattaaactgaccacaaatctcagttcttcaggtcctaggaaaaccgtgagccacctgcaaatataggctgcttatgcccttgacaggttcagggaatccgtccttttagcactggggcggtttcactttggacttgatcagggcttagaggcctttagctttccgatcctgaggagcctccctttatccaggaagcaggggactggaccactgggaccttcatcacgggtgggcacggattccccatcccaatcagaagaatagctgtatctgtagcagtaggttattctaggccagttctttccattaaaaaaaaactaaagcccctaggttgaattaaaaaaattaa

SEQ ID NO: 397368 - DNA, 681 bp, Homo sapiens
ttctatctaatatctctcctctggttcactctttgttttttaagacagaatcttgatctgttgccttggctggaatgcagtgacactatcacagtttattgcagtcttgagtcccccaggttcaagttatcctctcacctcagcctcccaagcagcagggactacaggcctgtgccactatgcctggctttttttttttaattttgtagagatgggttctcgctatgtgcccaggctggtctcaaactcctgggctcagctgatcctcgcactacagcctccgaagtctgggattacaggtgtgagacaccacacttggccctgattcactcttgaactcactatagattttcacctccacagcttctccaaaagtgctcttattgtgaccacaaacagcattcagatttctcactccagtgatcagtgcctatgtcatctgacctattacatttgatagaactgaacgctctctcctctttgaaacattgattttcacttgacttctaagataccatactctcctggttttctttccagtctttgcttcttctcaaatcttcatcgatttctccccaccttcctgatctgtaaacatgggagtgctttttttgcctcgaggttatcatttgtaaaatgggatagtatctgctttgtgggaatttgtgaagatcaaataag

SEQ ID NO: 397369 - DNA, 751 bp, Homo sapiens
cttgcagagtcggccaggtgtggtggctcacacctgtaatcccagcactttgggcagccgaggtgggtggatcacgaggtcaagatttcgagaccagcctggccaacatggtgaaaccccgtctgtactaaaaatacaaaaattaactggtatagctgtgcgtgcctgtaatcccagctactcaggaggctgaggcaggggatttgcttgaacctgggaggtggaggttgcagtgagccaagattatcccattgcactccagcctgggcagcagagcgagactctgtctcaaaaaacaaaaaacccaaaaacttgcagagtgaatttaggaaaccatgtagtctacagtttgatgcaatgtcttccttttcctctttctcaaatattttgagccaggtactatcctagattgtcttgtgatatttacaatctaggagaaggcaggagagagaactaagaacagagagcatgttctgagatgtctgctgtgtttgcaggtaccttccctcaatttccctactcactggccatgctggaaagcaggtcttggagccatatttgtaccatggtacttcccctccctatactcaattggttggccagaagcccaattgtcattctctctctctctctccctctccctctcttcctccctccctccctccctctccaagatatccagtaactgattgatcagctggcggtgggctcggctggctgccagggtgggccaccagcaaaaagggaaaat

SEQ ID NO: 397370 - DNA, 359 bp, Homo sapiens
gcggcagcctcagcctctttgagcccctggaccactcgcccttcctatgtcctctctcttgccttgcagtgtttcttctatggttttcctgtcctgcccccacagggtgaatttcagctttctcttagaggcccagctcaaacatcacctcttccacaaggcaccccccgattcctggccctctccaggggcagtttcctgctgccaagggtggacgaaagcgatgatagccccagggcaggacaggctggctcacaagctcactatcaatgcgtctgaccggtgtctgcattctttgtgtgcctagaggatatcagagtgcaggcatcaaaacccagatctggccacccgatggctga

SEQ ID NO: 397371 - DNA, 618 bp, Homo sapiens
aggctccacaaaagggcaaattaggactcaaacacccctccggctttgtggccggttgcatagagtacaatcgggtgcgtggtgctgaagtgcgcccccgtccgcccgcctacagacaaaatggactttctgtggctaactgaggtgtgcaaagttaaaacagaaccaggtgaccacagctggatgagggagtggccacatactgtgtgttatcggaaagatattgtaaaagcatcacaggatctccttttgtacgatgcagccaaaccagttgctgctgtcagtgccaagataaactgcagcaagaaatccagctacccctacccccactggccattttaaagaaacatctcacagagacttcctatttttgtcttagaaaccaaccaatcagagctcacctgaaccaaccaattaagatacctgccctggccaatcacggctcagttttatcaacccatcaaggctcagttatactgaccaatcagaactcagttgcatcaaccagtccttccattgcatagacagacctgattgagagtctcagaagtattgtggaagaacagggaggcgagagtttcaagaaggaaaggatggaaattgagactccgtctcaaa

SEQ ID NO: 397372 - DNA, 357 bp, Homo sapiens
gttgaggactagaggacattctaggaagaagaaatagcattgccaaacgtatagaagtgtgaaatggtattatgctttgaagataaaagtgaaatttttttgtaagtagactgcaagatatgtttggattttggttgagggtgttaaagagaagggatggactttgtgaaacttattagaatttttcatcatagaaaacggggaaccagtaaaaatatttgagtagaagagacatataatggtggttctgttttgttttgttttaagttttcccagggagcatttttaagaactgatcagactgagggcagaaactgcaatgatgagatggctgccaaattccactgaagggtgagg

SEQ ID NO: 397373 - DNA, 241 bp, Homo sapiens
tgagccaccacacccagccaatagttgatttttaattttaaaaacaatttaaaaacttattttagagacagagtctcactctgccacccagcctgtagtgcagtagtgtgttgatagctcaccacagcctcaatttcctgggctcaagcagtcctcctgcctcagccttctaagtagctgggactgtaggcgcacaagtagttgattagtagttgattttattccctatttgtgtttcatt

SEQ ID NO: 397374 - DNA, 756 bp, Homo sapiens
gatataagtgtatagccatcacttcctttagcaatcaaataatgagctgggcgcagtggctcacacttgtaattccaacactttgggaggccaaggtgggtggatcagttgaggtcgggagttcaagaccagcccggtcaacatggtgaaaccccgactctactaaaaacacaaatggtgtttttagtgttttgtttttagtttagtggttttagattttagtggtggcaaatgcctataatcacagctacttgggaggctgaagcaggagaatcgcttgaacccaggaggtggaggttgcagtgagccgagaccgtgtcactgccctccagtctaggtgacagagtgagactctgtcaaaaaaagaaagaaagaaaaagaaagaaagaaagggaaagaaaggaagaaagaatcaaataacaaaaagcacagtcagcattataagatatcagacatacccagcccagaggcagggtggagttggagatcatctagtccatcaaccaaatcaatttaggttgatttttttttaacaatttttttttttagccaagtcaaaaaaagtatttttagccttacttatatataactgtatcttttttggctcacttagaccattttatcaaaggagatcaaccacaaattcctgccggtttttagttgtaagaagctttttttattggcaggaaaactgggagaatgtgtaagttgttaagcagccaggccactctgtgcccagtattctggtaactattg

SEQ ID NO: 397375 - DNA, 451 bp, Homo sapiens
ctagttggttgtcgatttgttgactaaaaagagaagagttgtgatatatttgagtaggttaacaaagttgttgtctctccctatgtttacatcctgaaaagttgtgtttgtgtgtgtgagagaaaaagagagagtgagatcaagagatgaactgcaagtgttgtttgaaacagtttaggtgcagtcctgcttggcaagtagagatgcttcctgcaggtgaggttagaattttacattgcttctgattgaaggctgcatgctttgggttctaggtgtttacttttaggcctcagagctttggaaaaaaggtgctttttttcttttgaacaggttttcttatgatcagttattttgatttagaaaaattctcagcctagaatttaaacaagaacaggaggatcctaatttcttatttgtcgacataccccaaaagccctcctcgtccacccaa

SEQ ID NO: 397376 - DNA, 105 bp, Homo sapiens
tcacactactgggtatacagccaaaggatatgaagtcagtacattaaagaggtatctgcattcccgtgttcactgcaactattcacaatatccaagatagagaca

SEQ ID NO: 397377 - DNA, 258 bp, Homo sapiens
ataatttgctataatgactcataaaatcaggaaggtgctttactattactggcttattatacaggatatgactcaagaacagccaaatgggagagaggtagaacacagggcgaggtatagggaaggggtgtggagcttctgtgccctattggagtgtaccacccttccagcgcctctgtgtggtcaccacctccagctctccaaaccccatcacttcagggtttttatggatgccttgtcacttaagcatgattgatt

SEQ ID NO: 397378 - DNA, 369 bp, Homo sapiens
gaggctgaccagaggacccagcggtctacatcattcatccattaaacaagtatctaatgagcaactactatatagtaggcacttgccatatcatcttgcaattatttatttacgaatctgttttgaggaaaaagcctttctatatctttgtattttgaggacctaatacaattctggaatataataaatgcaaagtaaatgtttattgaataaataattgaagtaaatgaaactattctagctaatagactagattttctcttatttgaaaattatcaataatataccataagtttacaaaaatatcagctctgcttcactaaaaacttgcactgaacattttagagatgtgaaagatggaaaacctga

SEQ ID NO: 397379 - DNA, 305 bp, Homo sapiens
aacaggtaatctgacggggccccaaaactttgggaggccaaggcgggaggatagctcgaggccaggagttcaagaccaggctgggcaacataacaagaccccattttacaaaaaatttttaaaaattagctggaggggtggtggcataaacctgtggtcctgacaacttgggaggctgaggtggaagaattgcttgagcccaggagtttgagaccagcccgggcaatatagcaagacctcgtctctatatactttttaaaaattttttaaaaaagtttagatgagaaaactcagctaacgtactt

SEQ ID NO: 397380 - DNA, 574 bp, Homo sapiens
ttctatataagggctctcacaacaggttttaattctaagtaatccaaatcaactttttgtctctaatgaacaaggaaaataagttggagaatatttagtcccctgggtatgaatttatcttaaaaaatgtaaggatctatgttaaaataatattcatttattttaatttctgttaatctggcattaattaactatatctttcttaaatatatttagattttgagtcgcatactatcctttgaagtggcgatttgaaaaatattcccctttgtctcccagtaatctgaattcatttctcctcatgtcttcaataacacggaggacctaccattgaatagagtaaagaagttgtatccccttctagaaggcttgtcttctagagaaaaataaattacccagttagctataagcaatgggataatcgcaattgaaaggagtgaacaaagggaggaggcaaggtaagttctgcctgaaggggtaaggacagttttaatatttagcgctccaggcaacagagtcaatatcacaataaagtgtaaatatgggaatgtatagcatcttcaagaaagagaca

SEQ ID NO: 397381 - DNA, 618 bp, Homo sapiens
tcctacgagcgccggctggaggtgagagggacaatctgccacatggacctgctgtcgggccagctgctcctggactacgagcgccaacaccatctagcttcttaaacaattacatccattcatcaaagcagcacaaattccattaaatgctactttagtatccttggcaacgaagccaccagcactgtagctatccttcccacacctcagccctactggaatcgtgccatggcaagatctggctcagcaccgtccagtaacagagtccccatggacatgaagtgggttgaggctgggaaaggtggcagaggccacgcaaaagcctgggcaaagaacctaaatatgggattgctcctcccttatactggaaagtgcttctaacttcccaatatttcttattacatcgtcagcagggaaagaatacacctggagtgaggcaaacacagatggagtggctgatttaaacagtggcatggtcaaatgggctcccacaacaaaagagaaaccgtggatgagagatgtgtatatactaatatacggatatgtgcgggtgtactcacacatgtaagcatatagtgtagaaagattaacaggcctcgccctgcatcctcagcctta

SEQ ID NO: 397382 - DNA, 676 bp, Homo sapiens
aacctcccaggttcaagcaattctcctgcctcagcctcccgagtagctgggattacaggcatgcgccaccacacccggctaatttttgtatttttagtagagatggggtttctccatgttggccaggctggtctcgaactcctgacctcagatgatccacccgcctcggcctcccaaaatgctgggattacaggcatgagccactgcgccctgtattttcttcttaaagtttttcttttttatatctaagaatttaatccacctagaatgctttagaggcttgttctgggttcctccgaggaaaagcagcagtcatttccactggaattctggaaagtgcgctaacgccaggctcttcacgtgggccttgagcaatcagtgccattccccctcctggaggtttgcatacccttttctctgagcccttggccttttcaacaaagcagacactaggatagtaagaatttctatctctagaaatccagaaaggtccaaaatgccctgcactttgctggctacagttgaatgacctgcgtggtgcaggcctttgactagctgcatgaaattgctctgaccttagtgtaattccttaccacacctaaattattccacataaaacactgacgtcttccccatgtttctaccattgttaaaattacaattgccataaccctta

SEQ ID NO: 397383 - DNA, 578 bp, Homo sapiens
gcgctctagagatcccgtgctatcggccgctggtctcgaactcctgacctcagatgatccacccgcctcggcctcccaaaatgctgggattacaggcatgagccactgcgccctgtattttcttcttaaagtttttcttttttatatctaagaatttaatccacctagaatgctttagaggcttgttctgggttcctccgaggaaaagcagcagtcatttccactggaattctggaaagtgcgctaacgccaggctcttcacgtgggccttgagcaatcagtgccattccccctcctggaggtttgcatacccttttctctgagcccttggccttttcaacaaagcagacactaggatagtaagaatttctatctctagaaatccagaaaggtccaaaatgccctgcactttgctggctacagttgaatgacctgcgtggtgcaggcctttgactagctgcatgaaattgctctgaccttagtgtaattccttaccacacctaaattattccacataaaacactgacgtcttccccatgtttctaccattgttaaaattacaattgccataaccctta

SEQ ID NO: 397384 - DNA, 394 bp, Homo sapiens
ctgatttccccactcattttttttccttctctgttagtttcaatgtttccatagaatatagcttttctgagctagaaaggacctgagagacatttgatttgacaaatgaggaaatgaatgcccagagagaggatggatttacctcaggcctcctcacctcatgattggcagaaaaaggattagaattcaggtctcttgactacaggacaatgtgcttctctcacacacatttcccaggttcagcacccggcaaacagactagtctcctcctacccaatttacttccttcctgtttccatttaaatttcttcagtcttgtctatgatgatagctacttccacttcctcaacttctgttctctctttgacctctccaatcttacttcctcactgca

SEQ ID NO: 397385 - DNA, 785 bp, Homo sapiens
acagaattatgattcaactacagaggtccatcttctcaaaaggatcttgtagacaagaccattgtctgtacctgcccacagccatcagtttccctagcctgaaacattccttccataacatcttcaaacacttttagagcaagattgtctggaggcaatgtgaagattattctggattggaaaatgagaataatgaataaggaagactgtggaactatttctgtaattcgaagaagctacaatagaaccttgaaacaagatggtggcagtaaagctgaagaaaataaacagagatgagaaatggagagatatttaagaggtaaaatgtatgaaatttgatgattaatagaaaatgcaggtgtgagaggatggtttcaaaacctcccatatttgtgggttttgaattttggcactgtggtaccatttattgataaatagtgcagatggaacaatttgggaagtaatcactgataaacttgagcaagttaatgataggtgaacatgttatattttaacaaagtggatggagcacaatcaccctgctttgatagacccaggcactgaccaacatgtttcacatatttctccttttatggataaagtaactgagtacagcatagtctataaagtaaagatagctttctgttttataaagaaatattttcctactctacttccttcaccattcactcattcatttctcgataattcatcacatacatattggacaacttatgtgttactgatttatcctgggtgcttgagatatgggaatgatcaaggca

SEQ ID NO: 397386 - DNA, 698 bp, Homo sapiens
ccactcccctcattcccgataattattgcgtttctatcatgatccgctttttcaagattgtctggaggcaatgtgaagattattctggattggaaaatgagaataatgaataaggaagactgtggaactatttctgtaattcgaagaagctacaatagaaccttgaaacaagatggtggcagtaaagctgaagaaaataaacagagatgagaaatggagagatatttaagaggtaaaatgtatgaaatttgatgattaatagaaaatgcaggtgtgagaggatggtttcaaaacctcccatatttgtgggttttgaattttggcactgtggtaccatttattgataaatagtgcagatggaacaatttgggaagtaatcactgataaacttgagcaagttaatgataggtgaacatgttatattttaacaaagtggatggagcacaatcaccctgctttgatagacccaggcactgaccaacatgtttcacatatttctccttttatggataaagtaactgagtacagcatagtctataaagtaaagatagctttctgttttataaagaaatattttcctactctacttccttcaccattcactcattcatttctcgataattcatcacatacatattggacaacttatgtgttactgatttatcctgggtgcttgagatatgggaatgatcaaggca

SEQ ID NO: 397387 - DNA, 951 bp, Homo sapiens
aacagattcctaaaggatgaagatgcatgaataaaaaaggaagtagaaattactgaaaaaagttctgtgggtatagaaagtaggatgtacaaatacaagacaactgaagcagatgtcttgaagaaagccagagtcttaggagattgggattaatagagataatggaatatgataggctggtaagaaagtccctgctatgctgtgttttctattaatatgctaagatcacggtctttatcttaagaacaatgggaggacattatagggttttaaacaaagattgacatagccatttttcattttagcaagattgtctggaggcaatgtgaagattattctggattggaaaatgagaataatgaataaggaagactgtggaactatttctgtaattcgaagaagctacaatagaaccttgaaacaagatggtggcagtaaagctgaagaaaataaacagagatgagaaatggagagatatttaagaggtaaaatgtatgaaatttgatgattaatagaaaatgcaggtgtgagaggatggtttcaaaacctcccatatttgtgggttttgaattttggcactgtggtaccatttattgataaatagtgcagatggaacaatttgggaagtaatcactgataaacttgagcaagttaatgataggtgaacatgttatattttaacaaagtggatggagcacaatcaccctgctttgatagacccaggcactgaccaacatgtttcacatatttctccttttatggataaagtaactgagtacagcatagtctataaagtaaagatagctttctgttttataaagaaatattttcctactctacttccttcaccattcactcattcatttctcgataattcatcacatacatattggacaacttatgtgttactgatttatcctgggtgcttgagatatgggaatgatcaaggca

SEQ ID NO: 397388 - DNA, 1020 bp, Homo sapiens
atttgggcagtggtaaaggtgatatgcaattctgtagataatgctgtcagtaacgtgtaatatgtagcaccaggttataaaacacttaataaaaacacattaatatattcagaaaggttctaaaaatagaatgtataaatatgccaaaagtcttgcagttgtacagttggaacagcctttcattttctaagtattcttaatgtgctatgtattacacatttcataattaagattcaggggcatctgttgaattgttacattctattcagtgtaacaaaacaatttaaccaccaattaactatattacttattagtttgttaacatctctgtgacctgtttcctcattgcattaaatgaactctgtagcctctctcctctcctatatttgggggggatataaaagttgttttaagacctaaatattgttaaaagtttctttcaaaatgagattttcaaattgaagataccctcataatattatctttaatattattttctgctgattttcctgatgattacaactgatatatgttatatgtttttgttataattgtggaggatgttattatttgttctatatgtatgtagtattgctttgaacaaaattttaaagaaacgcattgttttcatgatcacatgacttttagtggcaagtagtaatgatgcctaccatatgccatgcacaaaaattaactcaaaatggattagagccctaaatgtaagagctaaaactataaaactgttaggataaaatagaggactaaatgtttgttaccttagataagcagcagtttcttagatatggcaccaaaagcacaagcaaccaaaaaaaaaaaatagattggacgtgatcagacttctgtgcttggctggggtggtggctcatgcctgaaaattagccgggcatgatggcatgtgcatgtagtcatagctactcaggaggctgagatgggaggatcacctgtacctgggaggtcaagtctgcggtgagccgtgacttgtgccactgtactccagcc

SEQ ID NO: 397389 - DNA, 164 bp, Homo sapiens
ctcagtctctcaaagcactgggaccacaggcgttagccagtacgctcagccttagcacattttaaaatgaccaaaatccattaaaaaacattctcttaacagccaagatttttacatctttcatttcttgaatgttttcattttatgtgctccaattttatcct

SEQ ID NO: 397390 - DNA, 451 bp, Homo sapiens
caaacttctgcaaactgtgaaactattgtgaacttgtgtgaatgtatggaagttggcactgattagacgtttgaacttctttccttgtcctgtgttatgcatggtaatctgccatttgctgttcctagctgtatggtcacccttagaggtatgagttgtgcttatatgtatatgttcatgcctagatctgttgctcacagaatcatctgacatccccatttcgttgaatctaggcagcagggttgatggcagccagaaaagtgtgccctgggggcaagaatgtctttagggaaaaatatgttattgtctttcagatagtagttctccaaacagttgctccaacagttcctatgaaaagattgcttgagcccaggagttcaaggcagcagtgagccatggtcatgccattgcactccagcctggacaacaaagtgagaccctgtctcaagag

SEQ ID NO: 397391 - DNA, 329 bp, Homo sapiens
gcattgtaaggtctattctgaattcatttgggaagaatggtgaaataaatccctaaaggcctctttcctatgcattaaaatagaaaatcctatgggattacattcatgtttgctttctaaattatgccaaaagctcaattttattaagtataatctgcctagccatgcataaaataaactactttggtttagatgtgagtatatgtattatttatgttgatttttaatgaaaatatgtttacatgtaccaatatgttctgcctaatattggttaatgtcataaaagataatatagtaacattactttcctaaatgtttttctgtggtca

SEQ ID NO: 397392 - DNA, 302 bp, Homo sapiens
agaactgatacggaagctactaaggccaaaggacaaaagctaggccattttggaccagggctcagggctctgtcgatgtgtttgggaagaaagcacctgtgaaacatctctcaatgtgacaaagccatgaaccaggttgccccatccatgatcaatgagacaaagcagacaggaggggagcacatgtgttcagaagtgaggtggaccagggttccaatttcagcccagccacatattagctatgtgaccttgagcaaatcccttctccttaagtgaagcttaagtgtttccatctgtaaaat

SEQ ID NO: 397393 - DNA, 265 bp, Homo sapiens
aactatcatataatccagcaatcctactactaggtatatatcccaaaaaattgaattagtatgttaaagagatatccacagacttttctgtaccagcttcctccacagtttcaatagagtgaataaatgtgtctacctctgaagtttccctgcaagctctgacttgctcaccagcactggggctggtgagtgcagaccagttttctaaggtctaattcctatgaagctctgatcccataattctcatggaggatcttcttcccta

SEQ ID NO: 397394 - DNA, 475 bp, Homo sapiens
gggaaagaacatttgtggaggcattcttttcagaccagaatgaagcaatttcgttagatcatttctgtattgtttccctcatattaaaaaaatttgaattcatcaatttgatgtgatcttttcacagtgaataaatataggcagcacatgaaattattttgagttattatataccgaatactgcattcaggacacaatcagatgtctagcttcacaattcaagttgtagtcatatttcaagcattcaacttgattctgcatttgctattcatgagatcctgggccactgaaagttattcagatatagaagcaatcctgatgactgggtcgctgcatctggacaaactgtaatcacgctttgtaatcgctcagtgggaaatatgaaattactggcattatataaaaagggcatcacaacggaaatgggtttgcatatacacagcgtcatttgtgaattctttgaaatctggcatac

SEQ ID NO: 397395 - DNA, 321 bp, Homo sapiens
ctattctctatactgcaattagaatgttctttccaaaatacatattggatcaagtcacccctacttaaaacacttctgatgctttcctcactctttggataaagatccaaatccttaacttggtctatcagcccagaaatgcatgtatggtcacttcttatttttctagcttcacctggcacattcccagtccctttccccaactctcacttttcacgtttcaaacacatggccttcaatagtttatgctgtcagcataaactattcagcttcctacactattaaagtttaccacaaccaccaccccatcatactctttca

SEQ ID NO: 397396 - DNA, 291 bp, Homo sapiens
agttctacaatcttggttgactgagattacagtagtgtgattccttgaagagttgagaaggccagttgttttaaccctaacactgaagcagttattagtaggactgtatatcagtcattacagcaagagatagcagtaacagaagccacagcaggaacccaaaagcttaccatcagagaggactttatcatcgctaaggccccagtgacacttcatgattcttattttcctcttttccaaatgagagcttttattctgtttatcctgttccagctgcaccgtgataggttg

SEQ ID NO: 397397 - DNA, 283 bp, Homo sapiens
gcctggataatggagctgtgcgagcattagattccacacagaaggctccataagacagatcggtatgaaaagtcagtttggagagctgctgccatgttcgcagtgggtttaagacgtgtccctggtctggatccagaggaagttcagcaggcctgttctcaaaagtggtgatggtgaaggtaggggtggatgcatggagagggcacacacatcttgcctccagcaggcacactggctactccagcaggcacaatggctattgctatggccagaaagtaggaga

SEQ ID NO: 397398 - DNA, 452 bp, Homo sapiens
atatgtgatattcagtggaagccagagattacaaacaaaggccataatagggtggggatgggggcatctgctgcttttattccattcgtcatttgtcatttgtagccatggcatccttccttagtcaacgaagcctgtactgtggaggtcagtagagcttggagaggcaggctgtctaagtgccaagctttaaggggtgtatcagcagggccctgacaccagagggcttctttctgccctccccaccagtgccctgccttgcctctagatagagagtatgcagatacttatatgatgtcattttgccagaaggccaaattattagcctgccttacacccccatgtgtggaaagtgattcacaagcttttccttcaacgaacctttgtaggcataaggacgtgtgttatctgcaaaggtctctgcagacaggacctttgggtgttatatctta

SEQ ID NO: 397399 - DNA, 425 bp, Homo sapiens
ccataaagttgaaaagttatcaatcaaaccattgtaagtcgaggactgtctgtgtatctgtaaactccactgtgtttcattcacagccatcctccttgaaagagaagtcctccccattccttcttcagccccctcaaagccagtgttttcttttaccatctgggcccttgcaccatatcctcaccaccaccactgccactttgccatctgcccctcagcaaggccaccagtgacctccatttggctaattgccctcaatacatttattatttggcttggtcccttaaggttatttaatattttgtgataacctttcattctccctctcctccctctgggacatttagaactttgtaacatacattcactcgccctctctctctctctctaacctcttatttctttggcttctgtgccactacttt

SEQ ID NO: 397400 - DNA, 758 bp, Homo sapiens
aggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgccctacacgcggcctcgcagacttggcggctccgctcccggccgggagcaggtggccatggtgcccggccctgcctcatagcaggctgccatgtcgcgggaggcgggctcatgccgcgtgggcacaggggcgagggcgcggtctcggaagcccaagaagccacactacatcccgcggccctggggcaaaccctacaactacaaatgcttccagtgccccttcacctgcctggagaagtcacacctctacaaccacatgaagtacagcctctgcaaggactccctgtccctgctgctagactccccagactgggcgtgcgccgtggctccaccacgcctaggccccacgcacccaccccagaccgccctggggagtccgaccccggcaggcaaccccagggagcacggccacaggtgctgccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatggga

SEQ ID NO: 397401 - DNA, 141 bp, Homo sapiens
gcagcatggcctccaggggataggaggtggttggttggctgacggcagtgaagggaggaatagagcctggagtagcccaagcaaaggggccttgatgctagatagtgtgttacttgaggacctcataaggacctcctgtgg

SEQ ID NO: 397402 - DNA, 543 bp, Homo sapiens
gaagaaaataggctgtgatcaatgcattttattctgttctctgagttggtgctctttcaatgtgttcacttatttatcaatttaacaaatatttgcaaagtttctacttgtggttaggctttatgcaaagcactgaacatgtaactgtgaatcagatgagtaatattccttacctcctgcagtttgcagcctgatcctatttcccgctaaagaagggtaaatgtattgtttagcccctacactatgctgaatttttaaaagcatttaaaggtcttattagatacctcctgcggaaagtcactaaccgtgcaattcccctggttgaatgcccagttatttgcagcccattgccatacatggagatagatttttttgctttgtccattgcggtaggctcaatgcctactacattagcttttctttcctggaatatagtaggtgcttatatgaataaaggaaaaatatgagaagagaacaaaatgtgttaaggatcaactatactaaactctttgtagacataatcttactatagacataacccca

SEQ ID NO: 397403 - DNA, 331 bp, Homo sapiens
tccagttgacgcagggcatattccatgtcttcttttctgagacacccaaccatccccactccatccttctgcacatccgtgtaacaggcatccccagcttctcgcgtgtgatccttcaggtcctgccagctgcctgatggaagaagtccatttcttccataaatagcatcctctgcatctcgagggtcctcgaagcgcacggaggcgaagggcacaaggccgtaccggctcttgagctcgatctcgcggatgcggctgtacttgtagaacaggtcctgcggctccttctcgcgcacgtgggtcggaaggtttccccacgtagatgcacccg

SEQ ID NO: 397404 - DNA, 381 bp, Homo sapiens
ctcccaaagcactgggattacaggcttgagccactgtgcccggccatctttctttttcttcctctccttctaccttgcccaccatggcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtgggggg

SEQ ID NO: 397405 - DNA, 463 bp, Homo sapiens
taggcaagtctcaacttgtctctgagcctcagtttctccaaatgtgaaatgagatgttggattagaagttctctgaaagaagaagctgcagctctttcctgcatagaatccattccccccttcttctaacaacagttctccaattttcctttgggaattactccgcccctagtctcagtttatggattgggatagagttgactccaacccctggctgtagaggtggatctgtgaccaaatcaagccaatgagagttgcagtaatagaagcagagatgggtggatgggcgcggtggctcatgcctgtaatcccagcactttgggaggcagaggcaggtggatcaccagaggtcaggagtttgtccaacatggtgaaaccccatctctattaaaaatacaaaaaattagccgggcttggtggcaggcatctgtaatcccagctacttgggaggctgaggctggag

SEQ ID NO: 397406 - DNA, 678 bp, Homo sapiens
aatttcttcagtgtacagttccctgtagatacaaagcatcacaaagactgatctctcaagatatccatagtaacacatacaattacaaaagcactttttctgtggaaattgttccaatatgcaaggataaagttgtctgtctccaaaactggtacaaagcctgggaaatatgaaccagatttgtgtgtgtatctgagtaaccagtgccattcacctcactgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaag

SEQ ID NO: 397407 - DNA, 728 bp, Homo sapiens
gtaggctgactctgaggatccctcgaatcgacggtttctctttaattctcaaacacaaaatgcaaatctcagaggtaatctgtcaaaattggaaacgaagaacacttcttggctgtaaaggtaaaatgatcaccaacaaacaattaaaaattaaaccagcagagttaagactttcaagattactataattcagacattcatataacagtgccaacacactgcacagaacttagagaacagcctcgccttggacccaggaagtcattcaatatcatcattagtgtctaaataaaagaaatgctgtgtcaggcaccagtcatttgactggaacaggtcagatcatattgggagttgtaaattttaaaggactgcttacccagagaaaggggagcaggggagagactctgtggaggtaagcattattttcaaatagctaaacggttaacacatggaaaaggaaagcaccgatgctccccgacttaggatggggttacgtctggataaacccatcataaggggaaaacatcataggccaaaagtgcatttttgacttcccacactttcaccgtatggtgggtttatctgaatataaccccagcgtaggctgagggctcgctaagtgcatatggctttggcaccacggtaaagtcgaaaaatcgttaagttggaccactgtaaggtgggagccattggtatatttacttctgggtgatgctcaaagatctttg

SEQ ID NO: 397408 - DNA, 338 bp, Homo sapiens
ggtatagccggcgtctcctgtaatctcaactactccagaggctgagatgacaggatggcttgagcccaggagtttgagcttcagtgagctatgatttctccactgtactctagcctgagcaacagcgaggagacctggtctcttaaaaaaaaaaaagacaaaaagaaatatagatgtattgactgaatgataagattctttattacttagggttatgttcagctttaggttgtcctttttctggaatagtttaggaaaggttcagagagaacacttttattccttggttggttgtagcatagccctatatttaatggcctgggtagtctcaagaaatt

SEQ ID NO: 397409 - DNA, 403 bp, Homo sapiens
gttctgttttgcaacaattcaactctgctgttatagtgtgaaaaccacgatacagaaatgaatgatgggtttccaatcaaagttgattatagcagatgttgagctggccatagtttgccaactcctgctctcaaacaataccccctgccctttccttgaagaatccagttgtctcatagcatgtttcacattctgggtttgtctggttgtttcttcatgattagtgtcagggtaagcatttttatcaagagatctacaaagcagatgttatacattttccatcgtatcccactgggaggctcatgtcagtggtcccagaatttgaccacttggtttagctgacattcactaggtccctccattgtgaagatgcatttctatttttgtaataagcaatccatgg

SEQ ID NO: 397410 - DNA, 548 bp, Homo sapiens
tgcagaaaacaagctgcatgtcatcagacacaattccagagaggataagaacagatgattttgaaaggataaaaagaaaggcacacctaacaatgctacaaggacagagaggattctgagtcacaatagttgacagaacaaaagcaggttgctacaactccaactgacgcatgaagattctaggctcagtgactcatttgggaatctcgggtgagacatttagattcccatttactgggccaatgccttctggtctgtaaaatggaagacacgagcagcattaaggtatctagacactttcaaatcctctcaagaaataaaatgttaagtataaaaaagcacgtttgaacacccaccggagtggctaaaataaagaagtctgacaataccaggagctgacaaggaggcagagaaactaaaaaccttaaacactgctggtggaaatgtaaaatggtacaggtactttggaaaacagtctagcaacttcttaaaaagttaaacatatacctgccatatagccaagccattcaatgcctaggtacccaccc

SEQ ID NO: 397411 - DNA, 641 bp, Homo sapiens
tgagacagggatttcccagagctataatgataggcagctcttgtttaaactctgttaccacttgcttaagatgtgttaccatatcgcttttaggtaaacctataaataacaatgggtcagtaggcttataatatgttcattatattttttaaccaaaaaaattgagaaaataagatttttttctttaaaatttgttaaaaactactttatcaattattaaactacattaaaataacatgaagcagtgagctttattaacattacccttccatgagaatcaactatacattaaaataagagaaatagttataaggacaggtgactaaagcccaactatcacaaccaaatcatcttagaaaatttgataccaggagtggccagctaccacaggtttcccagattttcactgacatgataaatatacagacaaatgggtacatgcgcatgtgcacacacacacacacacacacacacaccacaaacattcagaagactgtcacagattctgggtatttatttatttaattaacatcttaacatagcaagatgaggtcttgctatgttgcccaggctggtctcaaactcctggcctcgaatgatccgcccacctcagcctccccaagtgctgtgattacaggcat

SEQ ID NO: 397412 - DNA, 357 bp, Homo sapiens
cacctgcctggtgggacagtgacatctctcctgcagcactgctgtcagggtgagggaggtagggcgcagtttcagaaaaccattgggctgcacctgcgtgagcacagctgcaggagcaaaagtcagaaaggtcagcaaaggatttcaggagcaaaggtcagaagaaaccctcaaggtggttgtgtctgcaggaaagtgctgtcgtctcctgcaatgctttcaagactattcagaagcacagtgtgaagggagagccggagcccatggggaaatgactccagagtgttccacgtgttggaaggcatctgttggaaaacggacattcaagcaaatagttgcctgcatagacaacgcaga

SEQ ID NO: 397413 - DNA, 520 bp, Homo sapiens
tatggcattctatccactgaccttgtacgtcctttgctataaaactattaccatagtgtttttaaaaatcttatgaactcttaaatttgtaacttgactgaagaaaaacagttaatccaaatttcagatgtcaagaacaattaagcatcaaacatgctgtataaaatagtaaaagttaaacttttaaacaaggaggtctcttctgagtcaaatcccacatgtctggtcctaaagtatgatgactttctctggagactgtctgaaaagtataaaaagtatgacagcaatgggagcagcaaagacagagctcaaaaagtgctgagaaagagaaaaagagaagtagaaagaaaaacgactaggtcttaaataggttttaaattttgaacatttaatcagctaccctgattaaaatgaggataaggaatccataatgctattgctcatcaggagacttctaagacacttgctagaatccacaggtctccaaaaagctcagggatcttatctaagtgtgattctt

SEQ ID NO: 397414 - DNA, 574 bp, Homo sapiens
  misc_feature (8)..(8): n is a, c, g, or t
cttagtgnttcctttgtctcccacgctgagtgtgtggtgcaatcaaagctcactgaaacctcaaattccggggttcaagcgattctcctgcctctgcctctcaattagctgggattacaggcatgcaccactacgcccggctaatttttgtatttttagtagagatggggtttcacagtgttggccaggctgatctcaaactcctgacctcaagtgatccgcccacctcagcttcccaaagtgctgggattacaggcatgagccaccacacctagccaacaaactttctgcgcgttgaatatgtcactcactgccttttggtctccattgttgtttatttgaagttgttaatcattttcaggatttgttgtataatcacttttctttaacattttcaaaatcctttgtccttgtctttcaacagtttgattatgaaatgtctaggtaaggatatctgagtttatcctctttggcgctcattgaacttcttggatgtgcaaattaatttttgtttcaatattaatagactatttttagagcagttttctgtttacagacaaattacacagaaagt

SEQ ID NO: 397415 - DNA, 272 bp, Homo sapiens
taaataaggtagtattgatttaacccaagtgtaaaataaatatccatgggtccatgtggatataaataaatgatagactaaataaatgaaagacaagaggcaactctcttttgcagaagaatttattttttctttttttgagaccgagtcttgctctgtcgcccaggctggagtgcagtggtatgatcttggcgcactgcaacctctgcctcctgggttcaagcaagtctcctgcctcagcctgctgagcagttgggtactacgctttggca

SEQ ID NO: 397416 - DNA, 274 bp, Homo sapiens
gttattccccctaggcaggataagagacagactgctgagcttccctggggttacttacctgagatccatatctccatcaacccagaaggtgaaaatgttagagatggtgccccccgggcagcagcccatgatgagaacagcaatagcttggactggcttcagagaaaagctaatggccaggagataagctgtaaaaggcatgagcccaaactggcagagcagtcccacagcaatgccccagggtctcctgatgtgcgaccacagcttccggatc

SEQ ID NO: 397417 - DNA, 358 bp, Homo sapiens
agctgccttgctctttccaccatataaggacactgcgacaggcatcatttatgaaccagaaagcaagccttcaccaaataccaaatttgccagtgccctgatctcaggcttcccagtcttcagccctgtgagaaatacatttctgttgtttataagccagccagcccaaggtgctttgttacagcagttcaaatgaatgaagacacccctttatttcctataaactgtgtaaggcttgctaagattcaggctaaatgttcttgaaaagaagatttcactggtgacactgtgtacagttgacacttgaacaatgtaggtgttaggggcgctgacttcctgagcagccacaaattcatgt

SEQ ID NO: 397418 - DNA, 568 bp, Homo sapiens
ctttcccaccattattcattatctcagtatcttccttgtcagcatagttactctgttaactttgccccttttgcgctagattgtaaattccaagtttgtcttgttcatagttggatccaggtttagcacagtgcctgacgaacagtaggtctttaattaacatttattgaaagattgattagatatatgcagaaataatatattacttgatcttaagttttaagtttaaccgagtcttaaattttgtgagcgcaggtacatactgtattagaaattatggctgggcgtggtggttcacacttctaatcccagcactttgggaggctgaggcaggcagatcgcctgagctcaggaattgaagaccagcctagacaacatggtgaaaccccatctctacaaaaaaatacaaaaattatctgggtgtgatgccacaaacctgtagtcccagctacttgggggggctgaggcaagagaatctcttgagcccagggggtggaggcggcagtgaaccatgttcatgccactgcactccagtctgtgtgacaaagcgagaccccgtctcagaaaa

SEQ ID NO: 397419 - DNA, 853 bp, Homo sapiens
gaccccgccactctctgtggtggagcaggccaggccctgtagccccagaagggacactcagccaaaaagatgtgagccatcctcttcctgagagtctgcatattgcagggcccaccccaagcgttggaatcttcgtgggagactctcagacacccccttggtggctccaagagaccttccagtgaggctgtggcaggagggggcagggtgggctgggagaggctttggcccctcctctgagattttggggcaggaaggcaggacctgcatgaggctccaggcttagtcctggagtcacctaagaccggggaagatgcatcttgctttgccctggagtgtggccgtggggctcagacatcactctcccagaccttgctatgagccacgcactgagctcgttcactttgcaatgccccaagggagcaggtaccgtcacctccccaggcttcaaggtgaggaaattgaggctcagagaagggaagtggcttgccaagaccacagagccagggtggggcccatttcaagtccagggcgtgtgaccccaggggctctacctcctccccggatgtcggggtgggggcggcaggagatccgaactgtggagcagatggtggcacagtgagggtcccacctctgcttctttccgtggctgtgcccagtgccccctgccacccacttacagactggaggcctgaggagggtgcccgggactgctcccactccaccctgtgcgtggatgtcgctggcctgaagataacctccgcatggccttcctcagccagctctgcccgaactttggcttcaccacttatctggccatgacctcgggcaggcagtttgcccagccttggcc

SEQ ID NO: 397420 - DNA, 180 bp, Homo sapiens
aagctcttacacaatgtatttcctttaaccttctcatcaaccctgcaaggtgacgactatatccccattttacaggtggatcacctgaggtcaagagttcaagagttaactatttttcgccttctttctcccgcagtgagaaccctggttctaccctgtttctccttgtgtaaactgatt

SEQ ID NO: 397421 - DNA, 604 bp, Homo sapiens
ccaccaaattccatattgcacagaagtaaatgttagatgtagtttctattgtatggtaagacatgtacattttcactcttttcttatgtctgcctctaggttctatttcgttgtatctcacaagatacaatgactagctcaagagtttttcttcccaaggtaccctgttggttttcctccagaagcttacgttgtttgggcagggctgaggattctggcttgtgggagatagaccaagaacacccaaacaagccaataaaacatgaaaataaataaacagaatttctaatggaagtgaagaaaataacagagcaataggatgggagggcagagtgggaagtgagttgagggagttatctttgaggaggtgacttttaagctgagatcggatagtgaagaggagccagtgctttgaggacttggcagaagtccttctaggaataggggcagcttgtacagtggccctgagatgcacacacatttggcaagtttgaggaaacatcagagaccagtgctagtgagaaacagagcaagacatgaagttagaggggtggcaggagcgccgaaaagagtttagactttaattgcagtgagaagcagttgt

SEQ ID NO: 397422 - DNA, 272 bp, Homo sapiens
aaattgaaggtggtcttttctaggaaatcctcattgaaatactgcccattttgaataagtctaatagtacgatgaaccacacccttagtggaaacgttataggatgcaaataggaagatttgtgggtgtttttccttcatgaatttgttgttatctttgcagaagtgaagaatatcaatattttatggcctttctttgggattcgtgtttattaccagtgatgcagagcgtggccctggtcctcagcgcctctgcctttgtggtggcggggg

SEQ ID NO: 397423 - DNA, 760 bp, Homo sapiens
tgtatttgtaacagtctcattctggaagaattcaggaccttcattccaaaggtccactttcaaatggggagaatttatgtctgtagagtctgtgatactcagggtacttcaaaaccctccggaaagatgaagaacaagctggactccatcaggcagctggactggtaacagcagccttcccttcaacctgcagctttataaactataaacacacactgagtgcctagcaacaggccctcccggtaactgaggttgcaggaagatccctgctggctctgtaggagacaggtaatgagatgcattaggagcagggagaacactgtcacagaagccccttgtgcaagagggcagatggggttgcggcaatcaactccctgcaggggtggggaatcagagaagattcatccaggcagcaaacttgtggctggagcctcaggcaggacaaggagctgcctaacaagaggtggaaggggttacgtacgttgcgaaagactccaaccctcctggtgagtcagatctgtcatctcgggctccagtatctcacactggttctccagcctaggtgtgcatcagagccacctgctgagctaatgaagcccactcaggactaggctcctggaagcgggatggggcttaggccttggcatttttgccattttccccagatgattttgataccaaacagtttgagaatcactgtttcataccaggctaatcagaagaacaggcagcaaagtagcagctggccctgggcatttca

SEQ ID NO: 397424 - DNA, 417 bp, Homo sapiens
agaaaaacaaatttaaaaagtaatatcctaccagaacaagcagcagtagaaaatagaggtattttaaaaagaaaaaaaatttttaaagtaatattctatgatggcaaggggatttggatttgaatcttagctttgccatatggagaacttagggttaatgaggcttaaagaggtagcatatataaagcacccaagaagaaaggttaacttcctttggcagaaacataaatacaaaaggatgttaaaatcattatggagttagggcacaaaattagaggggcaagtatcatgagaaatcgagaaggaatgagaacaaaagcatatgtcaagacttatgtacttaatacactgataaaaaatattaaattgggggaactatgttttcccttaataagtaaatctctaggctgggggtgg

SEQ ID NO: 397425 - DNA, 401 bp, Homo sapiens
tcattcagccttacaaaaggagatgctgctatatttgcaataacatgggtgaacctggaggacgttacgctaagtaaaataacaatattgaaggaaagaaataatactgaaagaaaaatattgcttgatctcacttatatatggaacttaaaaactacacatagaaacagggtagaatggtagttatccaggctgggaggaagagaaaacagggaggtgtaggtcaaagggtacaaacttgcagttctattggatgaatgtctagagagctaatgtacagcatgagaactatagttaatattgtatatggaaaatttgctgagagactagattttaggtattctacctcaattaaaaaggtaattgtggccaggcacggtggcttacgcctgtaatgccag

SEQ ID NO: 397426 - DNA, 1205 bp, Homo sapiens
atactgagagaccctaccttaaaaaaaaaaaaaaaaaaaaggacatagggttgtgcattaaaggtcctcaagcaaacaactgccaggacaggagaaactccttgcaggcagaggatagctgcattaaatggcccttgagtaccaccattcccttggaatttttgggtcacaattactgctactgtcaagaaatacaccttatgcgcttctcccctttgttctcaaagaacaatctagaggagtctaggcaaaccaggtggtacagttcagactgtacagtataatctatgagttctgccctatgactcccatgatccctcttcatcttcaatagagtattggtaggaaaaagttctttatgagagatgtatcaagatcatgagcagttcttccttactccaggatgcagcctaaaccccatagctgcattgtgtggaatcgtttgagatcctctctcctgtctccattccaaccagatcttgacaattccttttctccacaccacctcctgccctgctgactctggctgtttccacacatgctatgcttccaggcctttgtgcattttcctgggcttctacttgtccctttttgcactctcttctgcttagatgtctttcaagatgcagatcagccatcagtttccttagggaaattttgctctctcctcttacctacactgttccctgtatatttattctttcacatgttggcattaaacacgaccctgattcctgtggatcattacagtctctatgatgacctacaagtatcattgcacttattatcctttgcttctccatgtcccacactagattcagagcactttatgggcaggcacagggggctactcaaatcatgccacttgaattaagtttataggacctgataatgaggtagtagcagcttcagttagcctgcaaacaaacaaacacaactagtagaacctcactgacagagtataaaatgtactctttgatttaggatttagagacacatagggaggaggtatgtgtagccagaggaatgccagtatttgtgccaattcaccactttgatgaggggatgtggagtaatgccagggacaaaagaggagtttatagaatgattgaaggtctaaaggcagcgtgctgagaggcaggtggaggatatgcattgggcaaagttctagggaggtctctgggtttaccctagggtgaacatgc

SEQ ID NO: 397427 - DNA, 225 bp, Homo sapiens
ttatcgaatgcttctctgcgttcagtgaccagttgtatttagtcaccactaaccagccttgtacgttcttctcctccatgagagggggtgtgaaatcgtgaatcaaaaaacaaaatggaagagacgggaaactctttaaactgtaagacgtacatctttaagtgctgtgtctaccagacgaagttacttattagctcctactccagtggcctgaaatcactgaaa

SEQ ID NO: 397428 - DNA, 495 bp, Homo sapiens
cgccctctgcagccacacctggaccggcaggcatgcacgctgcaggcaggctgcctccgctgtttgggtcccatgaacgacggaagcctcccagtgagatctccaggtctctcatcaggcacaggctctgagggagggtcctggggccacatgactgcagccagcgagggccgagcccccagaatccaggtcagctcctggtggcaggggacctgcccgtcaaagccgtccaagggtttccgcggccctgtcagaacaggcttgatagatgcccggaggttccctctgacagccgcagcagcagggctcaaaccggcggggccgtgtaccgctccaaggacaagctctgccgaggccgacatgaaaagccagcacgcgggtcgcctagagccgctctgcctccaagctgcagcgccgttcgtgaaaatacagagggagagggaaggcacaaagaaatacaaaactattttccaaataaaaagaaatgtcgaaaca

SEQ ID NO: 397429 - DNA, 249 bp, Homo sapiens
agaatacttccgatactcagaactaaaggtaaaggggcttttccagaagccccacccacactgagtgaagagcagcaccccagtctttctaaggagtccccccaccctccagggctccctgtttgctgtttctacaatgaatgctacctgtataggattcttacctcacgcatccttttcccaatagacacatgttcccttgcttccctccacctaggcagagctggaaacattccccaggaactccat

SEQ ID NO: 397430 - DNA, 328 bp, Homo sapiens
tatgactcttagtaatataatattataagaaaaatatcagaacaaaagaatgtaccctccatgatttcatttacatatgtacatatacacacctacatttatattatttatatattctatatattatttatatataaaaaataaacagacaacattcatctctgatgataaaagtagcaatagtggttacctctgggaggcgttggctgggtaggggcagaaagggacctaatgggaatgtccaacactctcatctggatgtatttacggaggtaaccatcatatataaaactgatagagctctacaatgaaaacgtgtgcatcttac

SEQ ID NO: 397431 - DNA, 408 bp, Homo sapiens
tatatactatatactatatataggtatatgtaggtacatatatgtgtatgtgtataggtatatattgtatatggagcttgtgccagaaggcaaatcaactatatcactaatcatctttagttccattgactcactgattgtaggaagagttcctcagtaaaggcagcagtgcatttaattatactttggtgcaagcttatcttaccataccatatccatatggaatatcatgcagctcttacaggtttttagaagaaaccggcatttaataatacagagaaagttcatgaactaccattgagtgaacaaagcagaggacaaaactttatgaatgatcacaatttcattctcagtgtatttgcagagcaaaatcttagaaggaaataaatcagcatactgatgaaaaaa

SEQ ID NO: 397432 - DNA, 416 bp, Homo sapiens
cttgttttgttacttcttgctttttcagttttgaggactattaactttctactacagaaaaagatttagttctctttcctccccgttacccccaccacatacttatacccagctttccaatataattacatcataacttcatttagatcaatatgagattttatattatgaatttgtaagtgcaatttaaagctaagccaagtagtgaggtatcactggttttctcttcctgtactatttttgttttttctggaattactgtcttattttttccctttgttcggttttcaacgtacttattgatccaaccttaaatcaattgcctaaatttcctctcaaagaggtcaggtatactatcaattttatcttctggaagaattctctctcagagccttgtgtggacttccttcatctgg

SEQ ID NO: 397433 - DNA, 513 bp, Homo sapiens
aaatgcgtgaacctgggaggtgaagcttgcagtgagccgagatcgtgccactgcactccagcctgggcgacagagagagactccataaaaaaaaaaaaattaataaagtggtacaatttttaaagttgcaaatatgaaaaatgaatgatttctgcatgaaataagaaaaatttggtttttatttgagcaattataagggtttgtcatttttacatgctgcctcattgtaggttattttcattatttaaaatgttatttgcatttaaaattacattgttgagaaagctataataacatgttgtaatccttgatatgttgtcatctctgttggtagacatcatctctgggtgagtgatttgcttgtaaaaaaattgttttgatttatttacattttatatagcattgagattatatcacatacaagaaaactatcctttttcagtgataaagattcaataatgataatgttagcaatggtatagctgtgaaataaaataataaaatttgtaattg

SEQ ID NO: 397434 - DNA, 217 bp, Homo sapiens
ttcttaacaacaagcgtctcaggtcagggtaggcttattgtggtttgcttttgcctacaaaggacgtatgttgagtaagaatcttggcctattacacagtaagttaataattgtgtccttgcaaataagcattgtgttctaaaatggaatcagcatatttccctataaagacacttccactcattcattaattgagcagccccagttgataaagaat

SEQ ID NO: 397435 - DNA, 623 bp, Homo sapiens
agaaattttcctttaaatacaggttttctgcatcccataggccttaataggaagatgtatggttaccctcttgacacaaggatgatttagaatgtgagttccatgaggaagagggcagggatcttgattttgttccctgctgtattcccaaggtgtagaatgaagactgacacataaccatgcctgctttctcttcaccttccaccatgattggtagtttcctgaggcctccccagccatgtcccctgtacagcctgtggaactgggagcagctgcaaaggaacaccacaatgatattccactggaaaaagggccaaaccacctgatcataagaacatcttatcaatatcctcctgggcagcaagccatactgcccagctccctcccacccatacctcagctgcaaccaggatcacccccattgctggacatcacatccaacactgggcttcaattcgtgggctaaactcccctgtccaggcggccacccagcaacacattgataccatccttctcctctgccaagtccagtaccagtgcctccaggaaaacaactctgaagtccaacacccactgcttcaaaacccaaaccctgattacagctcccctattcggcaggaagc

SEQ ID NO: 397436 - DNA, 529 bp, Homo sapiens
gaggccaatggttgaatgcgtggcagtaagcattcttacaagcaagtaatgactcactagtaggtggagaattgaatgagtttcttcttaaagtcaatttcctgaaactccaagtgtggcagacatctgtttttattctctaccattcttctttcatctggtaatagcactcctccctccctttacagatacgcttctaccctattccttgtgggtctgccagtcacaatcctcttgcccttggttgcagggtgagcatgtgatccaggactagtcaactggtatatggcttcagcaaattatccaaggataagtatataatccaggtcaggccaggccaagcagggcctttccctgggacttttcgtactgaagatggaagggaaatgtgtctagaagcatagaatcacctagagttcctggccatcatggaagggtctacaaaaaggaagccagtacataaaaagcagccaattccttatataaaagaaaaagggagagacgcagttaaaattggaatactatttta

SEQ ID NO: 397437 - DNA, 392 bp, Homo sapiens
aaatccacttttagcaagaagcctggctaagtcagtttagccagacccttcccacccgcttgctatcggatcaccgtggagatcggagccggctgctcacctgcgccatcgccggcgacgcccgatcaccctgcctgcctgaaaccagaagcgcctcatccctggggtttcctctcagagactgtccatgcagggaccgcaccctgctccgggctatcaattcccactcgcccttgctgtattcagcggagcccaatgtctccccagcggcgccccaggcgcggccccccgctgctcactcgcgcgcagcgcccgagcggagggaggcctctcacggccacagcccgggccagcccaggggtgcgcagcggggccaaagcggcttctttcgc

SEQ ID NO: 397438 - DNA, 469 bp, Homo sapiens
ttggggagaagggaaagaatgtagaaggtggcccagggttgctctcttcactttcagaaggaagtgcagccacaaactttaagtgggtcagctctggctttatttcactgcctcatcacctcgctgtgtttttaatcagtgcttttcagcagctctccttggaaaattggttcacacatttccattacaaacatttctttgtcttcaagtgaaaagggcacttcttcccatcgagagaattcttgttataatccaggaaacctctgactagagatttcttttgtaggctcagctatttatgcagagtgaattaaagagctttgctgcagtgttttacttcttgcagatctcaaacttgctcttttgtacaccaactatatttctggattttaccccaagctgtttatcccatggaaccttaaaatggttaaagcactttaaaaaatattcgatcctttaaccatcggta

SEQ ID NO: 397439 - DNA, 468 bp, Homo sapiens
gcctgtaaatccctgcctctggaaattgctggtacagagctcttcccttcacatcccccctttagaagggtgaaacgcacctaaaaaaatatgtctgaagtgtgaagactaggtggaaaatggtagataacttttccacaaaggaggaatgctctcttgtaaagtagagaaaacctcttcaagttacttgtttttttaaaacaagagtacatggttaactttggctttctaactgacagatgtcatggaactcaatctgtcagcatctcagtcttacccaactatctgggcttcgtcagagatctcctataagaaagagaaatatggagaaaccaaggtgatgttcctatggaatgagaagaatgcagactatatttagtctggagttagacctgaaatttgagacaggagaggcatgagcttctgagtaaagcattcagactgaaatccagagacccgtcttctcct

SEQ ID NO: 397440 - DNA, 532 bp, Homo sapiens
agagccacacagggagggtcccaagcacagagctcacatgtctgcacctggtgggatcaggtgcctagtcctccctgcatgtgacctgtgcacctgccaggaggctccgtggagctttggtgtctgccgtgtttactgggctcattacgaatgcatgaccgattgactctttggccatgtgatcgaactccatccccagcacccctttcccctcccccaccctggaggtcaggccggtatcgcccagctcacagccccagccgtctagtcacatgcttggtctttctggtgtcggagcccatcctgagccatcacttagcacaaactcaagtgggatccaaggccttatggtaacaaagacagaaattccaggagttttacaagcttcctcctaggaatctgggacagagaccagacaaatcctttatgacaatacgggctagggccaagccctctgccaggtgctgggggtcactggcccatggtccatcctcggggagcccagttgtgcccaccattctctgtaaggtgg

SEQ ID NO: 397441 - DNA, 572 bp, Homo sapiens
tcatgagtcttagttcctattgaagaaataaaagtatattctatccagacttgagtgaagacccctttaatgtcagaaattttgagaacttctatgtgatattatttctggttttagtaccttttgactaaagaaaacacgtgatgaacaaaagccattttgaattcagtaatgttaagtgagttttgcatcctcatccttttaaaaaataatacatatttgtccaaaacatgcatacctgtctatagactgcttgggtatctatggattcacagtccccctgcaaccgtgctgcagctgcccagggatctttgtcctgggcctgtcttggcttaaacaggaccatcttgttaagattctttcatggtgtgggctttgtgtctggacagtgggaaggcagctggcgatgtggtgtgaatccagccttgggtgttttggtgtgggagaggctgagctggatgtgccctccattgcctgctactgattctctttattcattgaagatcccctcagagacgtgagaaagctaatggtttaagtaccccatcagaatctccacatttccacttggg

SEQ ID NO: 397442 - DNA, 399 bp, Homo sapiens
acagaactgctgcatttcatttccattttcactctttatggttgtaatggtggacagtttgctttacttcctgagccttatttgaggttacctaaattctgatctctgtttctggaagaagtaagaggtagttttctgggaagtgaggccatgtaatagcctaagtcttacatgtttgcttctgtccattcatgctttctgagtattcacatgttctattcagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaag

SEQ ID NO: 397443 - DNA, 299 bp, Homo sapiens
tcatatttcttatatgaatttaattatgggaaatgttaatgcatacacgtgtttgtctttccccaagcagatttccagcacaagttcacggtgcaggcctcccctaccatggataaaaggaagagtcttatcaacagccgctccagtcctcctgcaagccccaccatcattcctcgccttcgagccatccagtgtgagactgtttcccaaattagctggggccagaacacacaggggcacctgtcccctgctctgtccagccaccgactggtccaggcttgctccatccataacttctg

SEQ ID NO: 397444 - DNA, 5457 bp, Homo sapiens
  misc_feature (1666)..(1666): n is a, c, g, or t
gccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaangagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcgaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttcatgtgtccttctctttgttcagtgaagccaatatgtaagatactgttttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaaaaaaaaa

SEQ ID NO: 397445 - DNA, 534 bp, Homo sapiens
atttaattatgggaaatgttaatgcatacacgtgtttgtctttccccaagcagatttccagcacaagttcacggtgcaggcctcccctaccatggataaaaggaagagtcttatcaacagccgctccagtcctcctgcaagccccaccatcattcctcgccttcgagccatccagtgtgagactgtttcccaaattagctggggccagaacacacaggggcacctgtcccctgctctgtccagccaccgactggtccaggcttgctccatccataacttctgccacctctcctcgacaatgtgtatatacatgcacatatgtacgcaaacccttagccctctcccttgtctctctccattaactttactactgccccctctaccttttagtcacatatcagcaaagggatttgtgggtactaatgggatctttagtggtttgcaaagcaatttagaaactggtgtgtgatgtggatacaggttgctacctggcctgagaacctaacacactctttgccatatttggggcatcat

SEQ ID NO: 397446 - DNA, 182 bp, Homo sapiens
gtgttctttaacctcctctttttataacccctacttaactaacactgttatcttggctacctgttcctcacagatttaacttactctttttttttactatgctgaaacacacataacattaaacttatcatcctaaccacttttaagtgtacagttcagtagtgttaagtatattcatattg

SEQ ID NO: 397447 - DNA, 314 bp, Homo sapiens
taaatcagaagaatcacagttccctgctcttctggtttttgtgactgtccgcctctctcctctgccttggattggagggtggggtgtgtcatgggttcgtggaatcctctctctgttcttgtgtagccaccagggactgttatccaggctgattccacaggaggagtttggggtgagttcctgagcgagagttgggaagactgacgtctgcgtaaatcttgcttgttcgtggttattcctctcagtcttcttaaattctgaaaaattgggggccaattagaaataaggatttaggtatggatcggtgaggacag

SEQ ID NO: 397448 - DNA, 387 bp, Homo sapiens
aatctactttcttgttatttcctgttgtccacgtcttgatttcactttaaattttcatcattttctaacacgtgcaaaaattccttccttttttttccaatctattattttattcagttataacatttgttattgtctgcagatatttcttgtctttgaatgtcaaaatcctgtacatggatacaaaatttctgttatctctctgagattagtaataactttgggaaggtttttttgatttactccattatatctattttctttaagtttttgtcatgcatgtaagtatgtatttttttgttgttttttttttgtattggaggcttttacaactatccagtgaaacacaaaacaataatataaatgtaaatttctgcttttttttta

SEQ ID NO: 397449 - DNA, 478 bp, Homo sapiens
tgagacagagtctccctctgtcgcccaggctggagtgcaatggtgcgatctcggctcaccccaacctccacctcccaggttcaagctattctcctgcctcagcctcccaagtaggtgggattacaggtgtgcaccaccacacctggctaatttttgtattttttagtgggatagctggccatgttggccaggctggtctcgaactcctgacttcaggtgatccgcccacctcagcctcccaaagtgctgggattacaggtgtgagccaccacacctgtccttggacttccacaatctaacacactccacaacattcactgtctgtacccaagactgtcatgcctaccaactctaagttttatatgacagcagggatttttggagtcactaggatttagtactatgcctgaaaaactgtagatattcatgtgtcacatgaataaaccacattatctgttttacaaatctgtcttctgtt

SEQ ID NO: 397450 - DNA, 607 bp, Homo sapiens
tataaaggggcttttctgtgatcatctctttcagatagcacgttcccttccctggggcactgtgaacctcaaagaagaaggtttcttttaaaaatctcctctgccaggcgtggtggctcacgcctgtaatcccaacattatgggaggccaaggcaggtgggtcacctgaggtcaggagttccagaccagtctggccaacatggtgaaaccctgtctctcccaaaaagtacaaaaattagccaggcatggcggcaaatgtatgtaatcccagctacttgggaggctgaggcagggagaattgctggaacccaagaggcggaggttgcaatcagctgagatctcgccactgcactccagcctgggcaatagagcaagactctgtctcaaaaatacaatacaatacaatataataaaatgtcctcaatggggacataagataagtctgtctgccaaaggtaaagaagatgagatagagaaatggaaaagtggcatttccttcccaagagccaggagtgactttcatgatgggtccaagtgcagccaagctggaggctaagatgcaaggggtttacgcctctccttgctgtgggaatactgggcctgggct

SEQ ID NO: 397451 - DNA, 470 bp, Homo sapiens
tggggagttacaatggtggtgacagggaagatttaccatctgggactgtgctaggtgccaagcgaagcagagcttgtcaggttcctggaaccgagtattaacgattccaatcaagcaggaaatgtctgtgcctgttctttgctaagctggattcctcgctcactaggcatcaaggtgcctgcggagtacgctaggcatgagaaaggtctcgggaggccgagagtgcctggcctgccctctggccccaccccaggtcacgcttggggtccctgtaggctgctcactggtaatggaggaagccttcatggacttgggtcccatcaggctggctctcggagaagccctgcagaactgtggtttggttttaatgaggggagaagattccaaaagtttatcatgaaaagccccatgaccacctgtgttttagagactttgatgacttcagaggccttgaaatacaatcccagaga

SEQ ID NO: 397452 - DNA, 575 bp, Homo sapiens
gcaaggttactgtattttgaatcaaaaccaagacatgcatgtcagttcttttatatataaagcatcaagcaccatcaaatccgcagataatttaaacataatgcttaattttaaaaaagattacatttacaatagcatataaaaataagacagctaggaataaataaaaccaaaaatgtacaagcctttcctggggggaaactgtaacactttactgaaggacattggagaagacttccataaatggggagttatgccatgtttatacataggtagactcaataatgcaaagatatcagttttcctcaaattgatttatagattcaattcaatgccaatcaaaagcttaacacattttgggttttgggggtcagtggctcaataagttgtgtctaaaatttttacagaacaaagggtcaagaatagtttggatacgactaaagaaaaagaataaagtggggttcttactctattagatatcaaagcttataactaagctatattcataagcctgcattgcacttgtacagaaacagatgaaaacagactaataaatagatcagaatggagaactc

SEQ ID NO: 397453 - DNA, 570 bp, Homo sapiens
tattcaattttggatttagatgtttttgagataccttggaatatgaaggaagagagatgcaacttttaaatgagctttgtttatcctcaacattaaggtagggtatcacagaagggttttaaggaatggaccagttaggaaaagataagggctgaagataaagtttcagtagctgtcaactaaaaaccatgagagtacgtaagtctcctatgtagaatataaagggaagatttcagaaccaaacccttggagcatcagaatttaaatagtgaacagaagcagcatatcaaaggagactcagaaacaagagtcagtgtgagatgaaaagcagaagtgtgtaatttgacaagtcaaagaggagatggtttaagttaaaacagcagtcagaggtaccacatgcagcagggaaatcaaaaaaagctaacttctgccacaccatactagtctcagtggtacaatgaggacagaaactagatttcagcaggctgaggactaaatagaaggtgaaaacattgagattacaagtataaactactgtgaaatttgataagtgaaagtagacagaaaagg

SEQ ID NO: 397454 - DNA, 490 bp, Homo sapiens
ctgaatgtgatagtcgtgggttacatgtggctgttgactgagcataagaaacgaggctagctcaagggagaaactggatttttaacattatcttctttaagtcggctaccatattgatcatcttcagtacagattattccataccctgcctctctatttgtcccaatcctccataacttcaccaaaaaacaccatcttccaatgagttggaatcattttttcaatggcgatagccctttatctataaactgcttatgacatacacttttctacatttaattccagttacattgcttatctccaattctagactatatggaatcagaggggagagactctattttctatatttctgtacctactcagtgcacagtacggagttctccaaagtttgagataataatatcaatagactaattgactattttattgattgattaaataaaatattttgttattaatgtattcagtgaaagaaaatttaacccct

SEQ ID NO: 397455 - DNA, 683 bp, Homo sapiens
aaaggggtttctgaggcctgatatgatctggaacagatcttaggctcagtgtcaggaatgcctgttttaagtcatctaagagctgtgaaaaagtgtaaatcatctaattacccagatttcagagagctgtgagaatccttccaagccaggtcccaaatgagcggcaaggtcagctgggtacccggatacatcagaatctaccgtgcttatctcctgctcaatctcaatttgcttccattgcctctctctttctttgtaattggagacaaaaaatgatcttagctcatctagtttccatttcctgttctaaagataagtaaatagacccaaaaagctaaagtgaagtaaaaaccatgatggggtagacgttcagactaacaccagctaacttgcactgtgtgcttactctgtgcaaggcacttttctaagtgctttatgtaattatcatctcaacctgttacaggttcaattgtatccctcctccctccttcaaaaaatacactctgctactccagtcggctctcttgtcctcttctccttgaaactgtaacctgactgtgatgaggcaatgaaggctctgcaatgaactaatgacaatttaattcattcttgatttataatttagaagatcctccctccaatcaaacagctccccaaaaaacctacctaaattgcttttccat

SEQ ID NO: 397456 - DNA, 1283 bp, Homo sapiens
caaagtctcaagaatgaagaggttgagaaaacagcacttctaaaatctctgctcactacccccaaggagaacccagctcagtgagcattttctcctggatgtttcattccccaaaatttagtcaaaagtggagcaagggaaagagtgagagtgatcctagtgtccctacttaccccaatccctccataactcctgctttcccctgtctcccagtctacactgggtcacaggacccctgagaacaaatcctatcaccccagatacactgtgccttgcacagaggaggtacagaatatagtgtttttgcttaattacagagccacctttgtgctgtgtatgatctctttttcagaatcactactcttcctttttgtacaggacatcttatggagaatgacaatctattttttttttttatgggttaaggggttgcattagtccgttctcatgctgctaataaagacattcccgagactgagtaatttataaagaaaagaggtttaattgactcacagttccacagggcttgggaggcctcaggaaacttacaatcatggcagaaggggaagcaaacgtgctcttcttcacagcagcatcagggataagtgctgagcacgtggctacacttgcttgtccactggatctcatagaaccttttccacttgcccgagaacagcctgggtgaaccccgccacctgactaacctaccttccacgcgggccccttctgctcgatctcgggcattctggagcctcaattcaagctcggcattgcgtccgcacacgcccaacacctttcgccgggcctcttttcctccctccttaatttgcccccccgggcgcatctcttggacctcgctatcggccgtctcatccccctctctatccacatcctctcaccctcttgcacgtgcgcaacgcgctcttcattccctctggttcccctcttcgtttccttcctaatctcgtctccgcttcagctctcctcgctcttcgaccaacgcgctcttcactctggcgtcatgcctgctcccttctcgtatgctctctactatgtcctcgctcctctgtgttcctacgacgcgtttccgcggctctctctccgcgttgcactgcctctcctctctaccctcacagccccgctccctcccatcgcgctcccgcgctcttcgtcatgccgctcttcagcctccgctactcatcactgcgctgcctctatccgtccagctcgacctcccgtctcctcgcatctccgctctctcctctgtctgctgctctctcccc

SEQ ID NO: 397457 - DNA, 382 bp, Homo sapiens
actctagtattctctccattaaatattgctttttgcaaatgggaggatcaagtagtgagatacgacttttttggaatgagggttacttgttcccttggaagcaaaggaggacagtgcagaactgataaaacaaggtttgtttggaagcagtcaaattggagaccaaatgatgtagattttgttatatatgcaagaagatctcagagggaaagctgcagagatttcttggtcagtagattgggaggaagcttgagtacttgaatcatttaagggctcaatcaagaaaacagagctactatgatattatggaataagggatttaggaaaggaataggacttcatacagctgtgggagaaactccagaagtcagagtctgtaggg

SEQ ID NO: 397458 - DNA, 568 bp, Homo sapiens
tgaagtactgctgcgcacggccactgccaacgtgcttgtttgtgtattgtctctcctctttggaacttaagctttatgagcttttctgttttattcacaggcctagaaccatggctctcatagagtagggacacagtaaatatttgttgattaaatgggtggatggatgaataagatcaaggctgaaccttgggaaagaagagggaaatttcacactctgagacaggaggagatgagtgaatctgtatggatatagataagtttgtagtggggaagccttgggggtagggtgggaattgaaggcaatcataacagataccctcaattttctggagtaaggaggcaaggttgtctgccgaggatagtggtaagtatggggctgaggatactcctgagagttgggttagtcatcgaggggaatgagagagggagctaaccaaggacaaggaaaggacccaagccaggatggacaccatgaggcagtcttgtaaggctgtgtgatttgaggtcacaggcaagagcaagaagagcctcgatccggccgcgaatttagtagtagtagtagacc

SEQ ID NO: 397459 - DNA, 471 bp, Homo sapiens
attaagtgacatgttcataatctgcttgattgcatggaaaagaacatggagagaaaaaatttccagaaataccatagatagatttagtagcgtaaaagggatctgaaaacattctaaatgcacaggtaggaattagcacaaataaataagctgaccaagagttaagttctcagccgctcttatcttgactcttaaccaggatctgttttgatatttaatctatgtatgtatgtatgtacctagtaattcatactctgtatccagcaaggtgttcagaggacctatgatgagaagggtctaaacactaactctgttatagaaagccagatggaggaaatagcagatagtctgaccaacaacattgtttgctgtcctggcgaagttgaattctgagagtcttagctgccaggaaagccaggaaagatcttgagagaaccagtgtatctgcaatacagtctttttctgattaaa

SEQ ID NO: 397460 - DNA, 502 bp, Homo sapiens
cttgaactcctgacctcaggtaatccacctgccttggcctcccaaagtgctgggattacaggcatgagccaccatgcccagccaagccttgttattcttaatgtttgagtggtttaaaggtgaaatatattgaaagtaatgctgtgcttcactgaacctgcgatatcatgaaaacccatcttacctcacagctgtgtttctcctcagagccacagtctgtatgagggatttttcagagacagttctcttcctatttttctctgagaccaaatggctttgttcatgtacttttttagtacttgaaataaattaatgcagagttttgatacccccatggagcaaaaggcttcaaaaaaaaggtaagggggccttatttaattaacccagcagtttaaattaaaagctaacaaagatgggaaattttatgcgtttaaaaccaaagaaagcctctgccctggcaaggtgtatgctctggttctaaatgattatgctcccaataaca

SEQ ID NO: 397461 - DNA, 296 bp, Homo sapiens
agggagagtgggtaaaagcaagagttagaagcatttcttaagagaagcatttctttagaagcattcactccacaccaacatactgaccgtgaaaaacgtttttatgaagaatgttaattacctctctcagaacacctaattttctgcagagcatagtttaggaaattctgaaaccagtgaattctatctaaattttgaaagacaggagggaaaccaacaattcagtgacccctaagtgaaaaacattatgttagtttaggtatgttcccgtaactcatttcatcctcaaaaaaaaa

SEQ ID NO: 397462 - DNA, 443 bp, Homo sapiens
ggtaactcatttctggagtttcagctagtttccgatagggaaggcaagaaccttatgtctgttcctgtgcacctttccaggtatttttcctgcttctaagatggtaaagagcaatcttgtgccagggctctattcctaggtaagtagcaagaattgggatttttttgtcttggaaattctccttaatgactacaagttgaaattgacaagcagctggttttaatttctccttaccgttagagcactcagtaatcatattgttggggtttttgttgttctgatctttctcccataggatttgatcaactataacagacttggtcaaattccaatgagaattccaaattaggggaaacaaggcctctgaattggctaaaattcctggcagctgcacaaacaaaaacaaaaacatgtgcttggtttctgtgttcacttcctttctt

SEQ ID NO: 397463 - DNA, 435 bp, Homo sapiens
gcaaaatagtacagccactttgtaagacagtttggcagtttctagaaaactaaacattctcttactatatgatcacgcagttctgtctttggtatttagccaaatgagctgaaaacatatatccacacaaaacctgcagacagatgtttatagcagctttattcatagttgaaaaaagttgaaagcaaccaacaagttccttaataggtgaatgggtaaataaacagtggaaatccagacaatggaatattagtgctaaaaacaatgagctatcaaaccatgaaaaaacttggaggaaacctaaatgcactttactaagtgaaaaaaagtcaatctgaaaaggctacatgcaataatgccattctggtaacatcaaaactatggagacagtaaaaagatcagtgattggccaggcgaggtggctcatgcctgtaa

SEQ ID NO: 397464 - DNA, 532 bp, Homo sapiens
ctgtgatggactgactggggcagagctgaaaatggttaacatctgtcatccagcttttcaattctccatccccgtctttcaggccaatgtaagttagtcacacaaagtcaagcttccctctcctttgccaaatgttttgactctcacctcccgctggtaggaggaataaataatgttttaaaaggactcctcctcctgcggcttttgtggaactatagggtaggtcactggtacgagaaaggagaaacagcgtgggtgcggtgactcacgcctgtaatcccagcactttgggaggcctaggaaggtggatcacttgaggtcaggagttcaagactagcctgaccaacatggtgaaaccccgtctctactaaaaatacaaaaattagccaggcatagtggcatacacctgtaatcccagctacttgggaggctgaggcatgagaatcgcttgaacctaggaggtggaggttgtagtgagccaagttcacgccattgcactccagcctgggcaacagaatgagactcagtctca

SEQ ID NO: 397465 - DNA, 546 bp, Homo sapiens
ggtgggggcaatcactggagtcttgtattctgccatatgctccacctctgtcccagccaataattttatatccagccaaactaagtttcataaatgaaggagaataaagtctttttcagacaagtacatgctgagctaatttgtcactaccagaccagtcctacaagaaatgctaaaacgagttctaaagcttaaaacacaagtacaacatgcactagaatagaacctcttgacatcctaaaactcacagggcctataacaaaataacataatgaagaaaacaacatcatggctggatcactacctcacacctcattattaacattgaatgtaaacgctgtaaatgttctacttaaaagatacagattggcagaatggataaaaaaaatcacaaaccatctatttgcgtcttcaacagactcacttaacacataaggattctcttaaactcagggtaaagaggtggcaaaagatatttaatacaaatagaaaccaaaagggagcatgagtagctgcacttacagcaggtaaaactgaatttaaagc

SEQ ID NO: 397466 - DNA, 381 bp, Homo sapiens
ctgcaacctctgcctcctgggttcaagtgattctcttgcctcaacctcccaagtagctgggactacaggcacccgccaccatgcctagctaattttttgtatttttagtagagatggggtttcaccgtgttagccaggatggtctcgatctcctgacctcatgatccacccacctcagcctctcaaaatgcttacaggcgtgagccactgcacctggctgataatagttttaaaatgatgagccagcatatatatagttgaatacatgtaaaaatgagagttcagcataggctgctcttcaatgaacattcatttcctttaaactgctggtaacataaatgctcttttgcaagtggttaagttttagatggctgatttcta

SEQ ID NO: 397467 - DNA, 469 bp, Homo sapiens
agctgtgaagctagaagttcattagaaatcaacaacaatgagatacccagcaaaaccccaaatatttagaaattaaacaacatatttctaaaaaatccatgggtcaaagaggaaatcacaagagagattagatactattttaaactaaatgaaaatgaaaatgcaacacatcaaaatctgtggcatgcagccaaagcaattcctcagagaggaatggttgtgttagattacattaatagaggaatgcttgtattagaatagaggaaaggtctaaaataaatcaaaattccaccatgaggaggtaggaaccgaagaacacagataaacccaatgtgagaaggaaggaaataataaagaaaatagcagaaattattgaatagaaaacaacagtagagaaaccaaagccaaaacatggttctttgaaaagattaacaaaattgagaaacctgtagctagaatgaacgagaaa

SEQ ID NO: 397468 - DNA, 1001 bp, Homo sapiens
ctgattttgatgaaaaagattatttcagattataaatttcaaattccatatatggttttaccccaaatttacctaggtctctaggtttcaaaacaactttgcacatgtaaaatgattatgcactgtaatacagtaattgtcaattaagagaaagggttgtgaatcacagaggcaagaccttaggagaaaaaaaatcctgatctatgtttctcccctatgaggaaagagacaaagctatggactagcagagcctgaagaccccaagatttttggtctaagaaactgtagtattgcaactgataaagggaagatatgtctagggcaggtttggggtaagtttgagttgtctctcagacgtccaagtggagatactgagtaaggtattagatatatgggactggatttcagaagagtgatctgggaactccaaaattaagaggttaggaataaaaggaagagccatccaaggaaactgatgaagaagctttgagagtaaaggagaataaccaaggtaatgtggtgttctagcagccatgtgaatgcaaaacctgaaagagaagggaaaaatcaattgtgacagatgctgctgaagagtgacacaaataacgacagagaattaaccattagacttagcaaactggctgccactggtgattttgacagtttctatgcagtaagaagagcaaaaggcaagagttacactttagccacaaatgccagccgacaaggcagaaattagatgggtcgttgtcctggaaactagaggatttatgagacatagcatctaacatcttaggactctgattcatctatgttcataatgccctgaaagccccaccccttccctcagacacaaggacactacctgagggagataactcggggggttggagggctgtgtaataactaagcgttgtttgtgttttactttttgccaaggcagactattgataaagcttctgcctaagttaacagatcaaactaagctttgaatagagtta

SEQ ID NO: 397469 - DNA, 463 bp, Homo sapiens
ctgagatcttattgggaagctgctgatcaccagtttgaggttttcctatctactgagagactgccgttctctggcgccagctgtgacctatcattattttagagaggcagtttagcaaccgcctgaccatcacctgatggttgctgacattcctggtgggcgttggggtggaggggggcttctccttccctgctcatttctgactgcctacctatctactgtaacagtggtgctaatttttctgacaagaaaaaagttacatgataaatgaaaattctgtggttgagaaggtgcttctggtggtagaaaattaagaaaatgtgatatgtattgaagtcattcaaattttagacagaatggtgaatttgtgacaaaactgaattaaaaaaattacagctcactgaaacaggttgaaggatagggaatacatgtgaaattcattattaaatatatttttataact

SEQ ID NO: 397470 - DNA, 163 bp, Homo sapiens
gggggtaagtatgcacaataaagctgatgtctaaagtactgtttccagatattcagcaattttaatcatggttataatcgccattgctcttgtcagatattgaaagtttgctgccactgcctgtaaatggagagagagcgcgcgcaaagaactttaaccattc

SEQ ID NO: 397471 - DNA, 581 bp, Homo sapiens
cacatgccaaagccaagaccaaaaccacaggtctagaggtgtttgaataagtagcccgatagctcccctgcatgttgagcactaaaatgttaggggaacatgttctgggctgctctcttcatcaaaattgcccagtgtgtgtcttataacatgcagcctttctcacttccttatcctacttatccttgaagactgtgctgagatgtcctgaagtccttccttaatttcctaggtagaaattatatttctctcccttgtgtcctcaccgttcttcttacataatcctgtcgtgaagctcatcaaccacgttggcagttgtttgcaggttctattctcagaccctagcctcaaggagctcatctagacaaattactcatctttgtatctcttatgtcagtgccttataaatgtttgtgggatgaaactgcttctccagctttacatcacatgtcccagaaagccactgccttcatctcctagattcttagaaaatgcagtatttgaaagaatctgtgccaaaatggaatctcagctttggcaataggacttctaatatcttactgactgagaaggtcggtcta

SEQ ID NO: 397472 - DNA, 423 bp, Homo sapiens
cagcatagaagaaagaaaaccaaatcaagagtaagaaaacctggttttagcattagctgtctgactttaacaagttgcttcagacccagcagattatatttgggttaattaggaatttaaccagctaaaagacagcttttgttttgattttctgccacagatctttgtaaagcctacaaattgaatttgagaatataaatggtctccttttccaactttgtatccctgatcattgttaacaaatgcatgttaagtcatattatagaaacttggaacactttgtattgttttcttgagtatagctctgctgtaatgactaggtagctgataaaagtgtgttctgtaagaactgaaaataaagccattgaaactagtatattgacttactaacatgttgaatttgaggggaatgcataagtgaaa

SEQ ID NO: 397473 - DNA, 294 bp, Homo sapiens
tcgtggcgtatgttccatgtgcagatgagaaaaatgtacactctgtgattgatgggtggaatattctgtagagatgtctattaggtccaattagtcaaatgtaaaatttaagcccaaaacttatttgttttctcccttgatgatctgcctaatgctgtcagtgaggtattgacgtcctctactattattgtgtggctaagtcttttcatagatccagaagtacttgtttatgaatctgggctccagtgtggatggagtgtgtatatatttaagacagttaagtgctgttgttga

SEQ ID NO: 397474 - DNA, 932 bp, Homo sapiens
agtccccggagaactctagctccccgacacgctacctcttggcaaacgagcgagaattggggcgcagagccttgggagggccgttccctcggcgggagcggcccgagcacagcttcacagcagatgcgggcgcggcgggcgctttggtgacgaagtagcgggacctgcaggaggcagaggcctggtggggccgtggacgccacgccgagctgcccagacccttccagaagacagtggggactattcaacggtttccagcagaaactaagccaggtgttcgttttacggagattgctcggctgcagggtggaggctggatgagaacaggcgtcctctcaggtaggcgctcgtggtggtaacgctgcccaggaggagggcacgggttccgggaagacttgcgaggttaaaccggcagctccggagaactgagcgcaagaggtcggtgacacagagaggagtccgggaggccgcatgtttcaggctgaagtcacttggcggggacgtttattgagatgcgaaacacaggaagggatagaggctgcgcagagggaaaaggcgatggactcggttttggaaacgctgatgtgaagtccctacgatgaaaaaagaaatcttccgatttctccctttgaagtctttgcttcttccgttgcaaagaacacagcctatgacatcaggttgaaaccaagaatgtagttctctgaaaatactgtgtgtgggggagggagtttatcttgtctcattccttacaaggatactttgctctccgacaccttagctccctgaaagtttcctagatcgtccatcttttcctcattttttcgactgcaagcaatgaactgttaataattttttacagtttggttttacagccacacactttattcttctttgtcaagtttaaagtattctagggcttgtgccttcccaca

SEQ ID NO: 397475 - DNA, 495 bp, Homo sapiens
gctggagtgcaaatggcacgatcttggctcactgcaaccttggtctcccgggttcaagcaattctacctcggcctccggagtagctgggactacaggcatgcgccaccatgcccagctaatctttgtatttttagtagcgatggggtttctccatgttggtcaggctggtctcaaactcccgacctcaggtgatccgcttgcctcaaactcccgatctcaggtgatccgcttgcctcggcctcctgaaatgctaggattacaggcgtgagccaccatacccggccgtgattccatttctgtaacattctctgaatgacaaaattatagacagggaggacagattgttgattgctagggccttggcgttggggtagggagtgagggggtctgtgaagggcagggctttggggttggggtagggagtgggtgtgtctgaagggcagcaggaggaagatgggattgttggttttggtggtgattgattaaatggcgta

SEQ ID NO: 397476 - DNA, 226 bp, Homo sapiens
gccaacaatctacctacgtgctccgtagttaacaggagccctcgacaatactagagacggcctgccattgatcttgcttcagtcgcaggtctgcataagccctctggaagccctggccatgtttgcttcacataaaacctggacactgcgctatatgggagacacggtcatgctcctccaggtgacatctgaccccagtgtggagtccttaaaacagttgggcaaa

SEQ ID NO: 397477 - DNA, 440 bp, Homo sapiens
acaggcgcattggcagctacactcggctaatttttttttttgtatttttagtagagatggggtttcaccatgttagccaggatggtctcgatctcctgacctcgtgatccacccacctgggcatcccaccgtgctgggattacaggcgtgagccactgtgcctggccgaagattgttatttcactgagtatttgagagtccacagcttgctgtgtgaatagtaaggcaaagtaactgcactcaccttatgttctaatgaaagtagcaatcagtgagtaaatacctatgatgtaatttcttgggggttaataagtgctatagggagaaacaaagcagaataatgggtttcagagggatgaggagaatattgtagaaaggacatttagggaaggcttctctgatttgagtgaagagtgtgctgccattgcggtccgctaagg

SEQ ID NO: 397478 - DNA, 393 bp, Homo sapiens
cccaccagagttgtaaacatacatgtgtgtacgtgcacacagaggcacacaccgtatggtgtgtgatttcagagcaagtgtttggaaccagacctggatataaatcctgctttcaccaactttggctgcatcaatgcctgcccagggcctagtctgcaaaggccctccaaagggattctcctttccatcttctccccactgtctcactatgtgaccttgtccagctgaaaagcagatggagcaaaacgctgccgcgctgcctcctgaatgcctgctcagtgtcagatccacgccaagcacctcacctacatcgctgcatttaataacagccacctatgagatgggcgctagtggcactcccactgctatcaggacacagaatccattcacatg

SEQ ID NO: 397479 - DNA, 946 bp, Homo sapiens
cccttttctcaacaaacaccatttccgtacataattcagttcatattagattcctaaaatcgtagaggtgatggaaggtgatttagagagattatcgaatgggtttcatcctctataaaactttattgcccttatcactggaacttttgtgtgtgtgtgtgtgtgtgtgtgtgtgtgcgtgccattttgaacatctaaccacctcttacccccaaagaacaagttccctgatggcaggaatgtgccacccctgattggggcaggaggaacagagtggagctggaagaggatcaacatttagtaggtgctcatgctacgctgggaaattgacatgttcaatccccatgaaaactttgcttagagatactagtatccattttatagacggggccataatggcctggaagggttggataatgtgcccaggatgatctggaaaggggtgggcccattggtcatccaccctaggcctgctgactaagagtggaccacagtgatggtaaaaatgtaaacaagaaaacagagcactccaaaacaactttaaaaagtggaaaaggtccagaataaatgtccaggtagctacagaatctggccaccactgtcatcagggtgaggttctgccacgagtgactcatctcaaaccttttgtgccaaagcactcatttgatcattgaataaacccacattgagcactgactgtgtgccaggcaccgagggggctgagtgtggtggtagatgagatccagtccctgccttggggcactcaatgtctaatgggggaggcaggcttggaaacaacacgggcagtccccagatagacatcggcacacacaggtagctgccatctaaccctggctgggactcccagcgagggcttccaagaggagatggtgtttgagcagagtcacaaaggcctggtatcgagggagggcagagggtgcttgag

SEQ ID NO: 397480 - DNA, 929 bp, Homo sapiens
cccttttctcaacaaacaccatttccgtacataattcagttcatattagattcctaaaatcgtagaggtgatggaaggtgatttagagagattatcgaatgggtttcatcctctataaaactttattgcccttatcactggaactttgtgtgtgtgtgtgcgtgccattttgaacatctaaccacctcttacccccaaagaacaagttccctgatggcaggaatgtgccacccctgattggggcaggaggaacagagtggagctggaagaggatcaacatttagtaggtgctcatgctacgctgggaaattgacatgttcaatccccatgaaaactttgcttagagatactagtatccattttatagacggggccataatggcctggaagggttggataatgtgcccaggatgatctggaaaggggtgggcccattggtcatccaccctaggcctgctgactaagagtggaccacagtgatggtaaaaatgtaaacaagaaaacagagcactccaaaacaactttaaaaagtggaaaaggtccagaataaatgtccaggtagctacagaatctggccaccactgtcatcagggtgaggttctgccacgagtgactcatctcaaaccttttgtgccaaagcactcatttgatcattgaataaacccacattgagcactgactgtgtgccaggcaccgagggggctgagtgtggtggtagatgagatccagtccctgccttggggcactcaatgtctaatgggggaggcaggcttggaaacaacacgggcagtccccagatagacatcggcacacacaggtagctgccatctaaccctggctgggactcccagcgagggcttccaagaggagatggtgtttgagcagagtcacaaaggcctggtatcgagggagggcagagggtgcttgag

SEQ ID NO: 397481 - DNA, 555 bp, Homo sapiens
gaacaattactttttggctatggggtttccttttagggtgatgaaaatattttcgaatgacatagaggtggtggttgtactacattataaatgccagcctgggcaacatggcaaaacactgtctctacaaaaaatacaaaaaaggccaggcatggtggctcacgcctgtaatcccaccacattgggaggccgaggcaggcagatcacttgaggtcaggagttcaagaccagcctggtcaacatggtgaaatctgtctctacaaaaaatacaaaaattagctgggcatggtggcgggtgcctgtaatcccagctactcgagaggctgaggcaagagaatctcttgaacctgaaggtggaggctgcagtgagcagagattgcaccactgcactccagcctgggcaacagagcgagactccacctcaaaaataaaaacaaaaacacgagccaggcatgttagcatatgcctgtagtctcggctactcaggagggtgatatgggataactgcttgagcctgataggtcaagggtgcagtgagccttgagcacaccactg

SEQ ID NO: 397482 - DNA, 198 bp, Homo sapiens
ttggaaaactatgtaaattttaaaaagacaatgattatcattaggaaatattcaaaggaaagcattattctgatagactatttggctctgatgtaaacaatatttaaatgtcattaacagtacaatcactgactttggattaacaaagttttgtaattaagtattttgggaggataataggagtgtaagaaagccaaa

SEQ ID NO: 397483 - DNA, 301 bp, Homo sapiens
atggcatcataatcttcattatctttatctctgaagtaacccttacatcttaacaaggatgttcacattacagtcgcccagagaatttttccaaaggattcatgcccctgcagactttgactcactggggttcagatgcaccctggtcaccccactgcgaagatgccataaactcctgctttcaacagtgaaggagaaaataaatctttgaaattttccctggggttgttattttctctgagtctcagcttgaggaaatgcaagaaaaaacttcccttgaccagtggggcttgtgatagaa

SEQ ID NO: 397484 - DNA, 516 bp, Homo sapiens
gatgaatgagggaaactgcatgagtcatggtaaagcttcaacattaagaactcaatccttttttcacatttggtgtcagaattaaagaatgagcaaaaatccttttaaatgcagtctactcatctccaatacaaatatgctgttgtatggttgcaactacatttaatttttcatttattttctagagtaagaaaaaaaacaactaatgaggcagaattgattacaatacatttatcaagagttttactgactggcaaattttgccctagagcagaggactacagtgtttgatataatcaaaaaccacctttttgtgatatgaaaggtcttttatttttgagatggagtcttgctctgtcgcccacgctactcgcccatgctggagtgtagtggcacaatctcagctcaatgcaacctacacctcctgggttcaagtgattctcacgcctcagcctcctaagtaactgggattacaggggcgcaccaccacacctggctaattttttgtatttttag

SEQ ID NO: 397485 - DNA, 157 bp, Homo sapiens
gtggacaagtacaaccatctatgctacactgcatattttttcctcccccagactggaccagggaatctctcaactttctagagtatcctgtctccattgacaaagctgaacagtattaaagatcctgctgcctttgttaggcagatttggaaggaag

SEQ ID NO: 397486 - DNA, 472 bp, Homo sapiens
ccagaatatccagtcagcttctgaatgggcttccttaacaggagttgctttgaactcagaatgaggcctgttgcaattgcttccaggatattgcaactttgggggcaaccaatcagagacacatcacaacagtttaactgcagagaactaaatgcatctacctagaatactttttaaacagctctcccctgtggccagactgaggaatgttgattaaactgtggattttggcttttcttgagtaagttttcatacaggataggtttttttcttgctataagaaggtcctatcaatatactgtgttacagaaagaattactccagaattaagagaaaaaagaagtatcaagggaaaatgtattatatgtattttactacatatatatattttatatacatgcccacacatggatataatatataagtatgtgaactcatagtaatctttcaaacagtgacatttcattatatt

SEQ ID NO: 397487 - DNA, 657 bp, Homo sapiens
gaggttttcattatcaaagacaagttggtcctgctttcttgagtttaataaaaacagatattgctgtttctggtgccctctagagtgtttttgatgatagtggttataataagagatttgaattatagtttcattgcatttgatgctaagtttctgttcattaacagtgattagttaactcttcatatttgcccatataaaggggaagacagatatgaataatccaaaatataattttttggtttttttttttcctcttgatccaggggaaaggcagttcagatttaactaacagtaaatctgtaggggtctgcagcaagctctatccttgcctcttcagaggaaaggattcggctgaggggcagaagtaggtttaaggcagagggagagaccaagggaagttttagggcaggagtgagtttattaaaaagtgttagagcaggaacgaaaggaagcaaagtacacttggaagaaggccaagtgggcggcttgagagatcccagtaccctgttcagcccttggcttgggatttttatgcactggcttggttttggggtttgcatttctcctcccttgattcttctcttgggggcaggctatctgcatgcatagtggcctgtcagcacttaggaggggccacatgtgtagtgcctttac

SEQ ID NO: 397488 - DNA, 578 bp, Homo sapiens
cgtggacttcattcattgtgttgctcacatgcaggaaaaaaaaaaaccagaatgcaataaggataattcattgatttgtggggaaagagaaaattcattgttttggggggaaagagagaatgtattgatttgtggggaaagagtcaataagtgaatgtttcctgttctaggactggctttgccttgtcaataattgattttgttgttcagaatacatttcaaaacctttaaagcagtgtgcagttaaggatgatatttttgcctgaaatgactactttgcatcatgtagaaggaatagtgtcttttaaaggcaacagatgcaagtctaggaccccagagctttagaaggctctgggcttcgggtatgtgtctgatgtgttgagagttgcaggggacgggagggatgtccactgtgggccagtttctaccagccaccgagaagctggaatttgtttattcatttatagagcaacaggaactggaatcgaaatctgtcagtccctatgtgcagggtgtaattgaattgacttctctgctctcaattggaacttcctttgacctgtagtgagaacatttta

SEQ ID NO: 397489 - DNA, 571 bp, Homo sapiens
tagatttttaagcctaaaattattctattaataaaaaggaaggtcatatgaagtaattgtttagcagttgattctattttaaataaaaggaacaaacctttgtataatactctctatgttccaagcccattataagcactttacacaaatattagttcatttaatctttactccagtcctgtaagatagggacattattattcctatagtgtggaaaaggaaattgagacacagagagactatgtaacttgtccatggtcacccagctggtacatgacagaaattcagggaaaaaataccatcacaccaattgttgcaattattttaatttaacattcgagtcctgccactgctgtttgtctcagaataaattgttccgtctttctaaatcttagaaacctcatttataaattaaaggtggggggattctatcatctataaggccctttcaaatactcttatttattgtgtacaaaaacccctgaaaagtcacttacaaaaaaacttgttcatgcccgtctgaagatttacgaactccagctttttatctgactgtgcattctgacaattt

SEQ ID NO: 397490 - DNA, 289 bp, Homo sapiens
tcccccaggctggattagtgcctccgttaggcctcttcagtgccctgggctacctctaatttagcacatcttcctgtattttaagtatctgtgactgtgtccctaccttggagagttgcttgagggtcagattcatctctggatcctggattattcagcaagcacaagacaggcctagcacaaatgtgtgctcaactcatgtgtggggaattgaagacagaagtcagaggaggaataagaaatcagagaagtaggcaaaaactgcctccattcaacgccctggttctac

SEQ ID NO: 397491 - DNA, 420 bp, Homo sapiens
tcagtgctttatatcttcccaattttatataacactttttctccccaccaaatttgcacacacccacctctccctcctccctcccagaggcctagtccagggctaagtaaacaggctacctgcttttatggaacatagataccttatagataccttttgtaggcggcatctgtgattccgtgattgcgtctcgcgattgccaataagaacacagcacacaagcaccatcacacccacacgacaaaacgccggctgcacgggactgcagccttattgtcacaacattttgagctttctgacaacataagctgcacttacaaagaagtcagagcaaggaaagaaaagtctcaaactgtgctagttagttggtctagcaaggtactgtgatagcaacttaagtgggggagaatcaggaaggca

SEQ ID NO: 397492 - DNA, 401 bp, Homo sapiens
cttttcacacagtctctttctgtagtgccaagcctagcattaattcccattgatattggtataattatatgattttttattctatgagttgcttcttatttaggttgtatgagtgtcaagtttgggccataccttttgtttcataccttactctcatcagcacctttcacccggaaaagaaatgcagtcaagtgagacgggctctaccacaaatgagctattttatatatggcatatgaaactaatagctcgagtgtatttgaagcttcttgcgataactaactacatggccaatcaaaacaaaggtgcagaaaacagtattattatcctctgtgtgctctgacccttagaaagtagatagttattgccaaaccacccttccaggtaaagaggatgctcct

SEQ ID NO: 397493 - DNA, 203 bp, Homo sapiens
aaaattctgaaatctcctagagttacaaaatatgtagaatcaccattttcagactatcaaagggtaatacaaccctgccctcaaaagttaactcttttggcttagtggggtggctcacattcccagcactttgggaggtaggaggattgcttgagcccaggagtttaagaccagcctgagcaatatggtgaaaccctgtctct

SEQ ID NO: 397494 - DNA, 275 bp, Homo sapiens
cccgtgttcccacaagtggtcctgattaggaggagtgataaaggaaggctcagtgtgtgttagagtagtgagaaagcttggtagagaagtaggacctgagctgaaactcagctaatggtagaatttgagtaagcggaggattttgagcaggatgtttccagcagggggaagcatagcatatgcggcagtaattggagagctgcctgattaaatcaggctgtgtgtgtagcagaaggaaaataaagttggctaaatgaagtgggcctaaattatag

SEQ ID NO: 397495 - DNA, 549 bp, Homo sapiens
ttgggtgggttccataaaattatccatccttgagatatgtctaaatacatattgatttttatattatttgttcacaattatttataagcttatatcccagtacctttttaaaacaattttattttaagttccgggctacatgtgcatgactcgggaggtttgttacataggtaaacatgtgccatgtttgtttgctgcacctatcaatccatcaacccaggtattaagcccagcaatgcatcagctatttatcctgatgctttcccacctcccacctcaccccacaacaggccccagtgtgtgttgtttccctccctgcatccacatgttctcattgttcagctcccccttataagtgagaacatgcagtgtttggttttctgttcctgtgttagtttgctgaggataatggcttccagctccatccatgtccctgcaaaagaccctttctaagtgtgcaaatatctccctctggaatttatatgaatgttctacaattgttcccagtgaaacttttaaatatcctctccacaaaatggtaaattattc

SEQ ID NO: 397496 - DNA, 275 bp, Homo sapiens
actcctgacctcaggtaatccgcccaccttggcctcccaaagtgttgggattacaggcgtgagccaccgcatccggtgaaaagtttctaattttttcatgaagtttactctatcaacttcttttgtgaattgtgtttttttggtcagatctaagaactcttccccaagctctagatgtgagaaattctgttttcttctaaaagttgtatattttacgcctcagtctgatcattttgtgttagaatttgcatttgcagataacatgatggcccatg

SEQ ID NO: 397497 - DNA, 459 bp, Homo sapiens
tgcattttagttgaccagtgtttaatatttaggaatagttagtacctaattcatgatgacctcttgttctagcatattgaaggccagctatcattaaagcagtgcttttcacagaatggttttgctgacctcctaaatagaagtgtggatggcagaagcatcaaagaggatgatcacaagtggggaaggcagaaattttaaaagaactgactgaagtaactcctctactaatgtgacaccatctctatcccccacaaacccttggaaatactagttttgggagaagagaggagtatggtgactagaaagtagctataacctgttgatcattgtatactttataaggcagtgagtcagaagatatgtttaagaaatggaaggttgttggagtagctctgatgacagatgcttatcataaggcaaacttaatatatgttccacagtgttcagaataccact

SEQ ID NO: 397498 - DNA, 196 bp, Homo sapiens
gaaaacatctctaagccaagtgactaaaaaattaatttaaggaataaagaagcaatttttttccttaaagaaatatcagattattttagtatttcccaaatgcacattttatatttctctaaatagttaattagggcattacatgtaatttgaaatcaaaaatatcagcattaaaagtaaacatagaaatcaactg

SEQ ID NO: 397499 - DNA, 1591 bp, Homo sapiens
agcaggagaggggccagttgggggaggttgcctgctggaaggggaagctgaggagcgggaggagggcttgccaagactggcattgcaggagacttgtctcaggtgtgttcccagaactcttgcccctggagatgctgcaggaaggaaggggttatggtcacttgggtttagacgacattctgtgaacctcatgaagaaattagcatattaaagactctgaaagtagagcagagaactcagctttaacctgctcacctgctagttttcgaggtctcgctctgttgcccaggctggagtgcagtggcacagtcatagctcacttggagcctgaagctcctgggctcaggcagtcctcctgcctcagcctcccaagtagctaatattacaggttcgtgccaccgcacctgggtcttgctgtgttgcccaggctggtctagaactcctaggctcaagcagtcctgtctcagcctcccaaagtgctgggattacaggctggagccaccatgcctgtccaagggtcttttttatactatatgaagtattccttctccagctattcttgttcgtttaccagccagtgaagattctcttgagggctgaacaatacagatgagtatgggggcccttgcaccaaggaaaacagcgttacatttaattaagtgccctgtctcaaaccccaaggccccacagcttcttcatttggcccctagttcatcctgctttcctttgagccacaggattttaaaatatttcaatcttattttcatatcaatttttctttgtttcactacaagtacagtcattgtttaaccctatcaggactaacacaatatttcacgtaactaagagttaatttgcccttgtgagtccttggaatttaagccccacacacacacacttagagcactgttgctatgggaacatagagtcctccaaacaaaagtgaactttttcaacatgctgtttgtaaatggaagccttcccaagcagacactgtgttcctcttttattttgtattttgcacattatatattttgattagattaaaatggaggaatttgcaggatgtgttgtcatatctagccctgaaagttaactggttacagttaccaaatgttcacagctagcgccattgaaagcattgactgtaaaccgctgtactgtgctaagcctttttgtttgcactgtttggcttaatcctcacaacaacactgagaggttttcatttgatgagtcatatttaaagaaaaggaacccaagacggggagtcaggggcacaaggtcacagctggtaatgatgaccctggaatgtcctcacagctgcacacctgcaccgctcacaaacacagctgaccgtctcacagctgcacacctgcaccgctcacgagcacagctgaccgtctcacagctgcacacctgcactgctcacgaacacagctgatcgtctgcctcttcgtgtgagctgagctccgaatctcagctgtccaggctgtctggaaatcatcagccccactggctggatctcaaaatttactttcaaaaggctgatggagtgttttcaattaaacatgacctaaaattaagtaataaa

SEQ ID NO: 397500 - DNA, 416 bp, Homo sapiens
ctggaagactgagggaatggggtgtggatgcctcctctcggtggctgtgaccctctgggttcaaggagggagaactaaacagctgccaagactcatcgcaggccctgggtgcctacacactttgaatcacagctactgtaccgtgctgggtcactgccaggaatctgaggagacaataagctcttattttaaaaagatttgccagcatacccgggcttttacaaatgcttgataattattgccaaaaataggtattggcttagggtctccagtgctgtcctggcagctccagtgatgaggggcctgcaccatgtatgcagtccaaacctcgccacagagggggcctggaggtcagcaagccgggcacccctagaccccacagggtgggcattgtggaccacgcctttgctgctcga

SEQ ID NO: 397501 - DNA, 188 bp, Homo sapiens
taacccaactactgtaatctttgtttattctatctttttcatgaacatttaaaaatagttttaattatactgcataacattctataatttgctattttactttataatgtgttgtttttccttacatctgtgcttttccatgtaactatggaatcattttaatgactgtttatattggctgcataaaa

SEQ ID NO: 397502 - DNA, 591 bp, Homo sapiens
ctcttaggccagtgcatttaaaagctggtgtgtgttcactctctctcttctctaccatagtgacctgagagccacatgttaagatcatagatggaagggttctggatccctgcattaccacctggaagaaagctgctctggagggtcaactggataacaacatactttgtgtgaatgagaaactttgtggggttaatctacagagaattcagaatgaagttactatcttcgggtaagttagcctattctgactaatacactattccataaggtcagctctgtctcgggcggagttaatccctctttttcgtgttcccactgcatacctacatgatggcactcaatgactatactgagatctatctcagtataatcaaatagaaatagtatacacatacagtatagaaatagagtagtaatataccacataatgctataattaccgtaagggaaggtgaccctgatgcattggaagtactttagggagaatgtacaaaccagttgaccattgtatgctaagcttttgttgaaggaacctattagtatgacttccccttaagcaaatcttctttttccattaacttttcttag

SEQ ID NO: 397503 - DNA, 367 bp, Homo sapiens
cgtgattgcaccactgcactccagcctgggtgacagagtgggaccctgtctcaaaaataaacacataaataaataaaaattaaaataaattcagtggaaaagttagaagataaatttgagaccatttcccagaaaagtagtataaaaatgaacaacaaaaaagaaaatagcaaagtgagtgcaattcatgcaggaaatgtaatatccaactaatagatgttccagaaaaaggaaatacatggagaagaagaaattaataaataattttaaaaattgccccagaaatgcagtactgtgtatgtatttccagattaaaaggatcttttcgttgggcatggtggctcacgcctgtaatcctagcactttg

SEQ ID NO: 397504 - DNA, 342 bp, Homo sapiens
aaaagttcatgtattgggaacttaatccctaatgcaacaatgttgggaggtagggcttaataagaggggtctgccctcatcagtggactaatgtctttagtaagggagcaggcaagttaaagtgagagggagttgttataaaagcaaactctgccaccttgtatgtgctcactctctcctcctcctcctcctcctcctccttcctctctctctctctctctctcatgcttgcttctaccttccaccatcccaccatgggatgacccttgcctgatgctggtgccatgctcttggactttacagactataaaaccattagcaaataaacttctggtctttata

SEQ ID NO: 397505 - DNA, 405 bp, Homo sapiens
agcttccaatgaagtagatgagctggtagatttaggggtgtgtgggtgtgggtgcgggtgtgtggtgggggacagggtaaaatagttgggggttgtttactcattgctttgcagctttagagttttggttgaatccatgtagctaaccccagcagttttctgtaatgctggtaaggtagtagggatcctgagccaggcagaatttcatctctagcagcgtggaaatattcatcggagactgtgggtaaaataggcatgcaagaatttaataaaaaattaatgacctggccaggcgtggtgtctcatacctgtaatatcaacactttgggaagctgaggtgggaggagagcttgaggccaagagtttgagaccagcctgggcagcatagcaagaccctgtctctac

SEQ ID NO: 397506 - DNA, 480 bp, Homo sapiens
ttactattttataactatatcactatccagttcattggaagacagatttgattcttttaagacaaatgtaataatgcgatttaaaaaccattgcgctgaatttgatccaccatgctgtaatccatctgattgttgaattttccactgttatgacagctaaaaacaaactctcagtatactggaagaaggaactgaggaatataaagacagtctaatttatccatatgcctaaaaagacaatgtcatatggataaactaaatgtcacctttttttcctttttaaatattgtaggctgaacgtctttcaaataaaaacacaaccttaagaaaatcacaagaaaccagatcaaagacataaatagaacaaaatatgcacaagagatctcatccaagatcaaagatgtgaatgtaattgccatgaataagaagtgcagagctcaccagaacagaatgtcttcggtgcacagagaattataccca

SEQ ID NO: 397507 - DNA, 349 bp, Homo sapiens
aaaaatatttactagacacctgtgataagagctataaaatatataaattacaaagttctcggtctttgaggccaaacgcggtggctcacccctgtaatcccagcactttgggaggccgaggtgggcagatcacctgagatcaggagttcgagaccagcctggccaacatggtgaaacccagtctctactaaaaatacaaaaattagccggacatggtggggggcgcctgtaatctcagctactggggaggctgaggcaggataatgtcttgaacctgggaggcagaggttgcaattagccaagattgtgccattgcactccagcctggtcaacagagtgagactttctc

SEQ ID NO: 397508 - DNA, 230 bp, Homo sapiens
cacctgacttctttcaggtaacaagcatgacttatttttgcagggggtctaaagcttgaccaccgctgttgtatatgtcacctttcctagttccttctcagaagtccagcattttgacagaagcataaagcagggcacagggtcctgcctttgcacacccttcctgtgcccattgtcctatcacaccacctccctggtgcagccagactctaggccctgggccctccagt

SEQ ID NO: 397509 - DNA, 186 bp, Homo sapiens
gacccagctcgctcatgggcaagcagttgcttcacctcagctgctaatttgtaggatgagaagagtttagattaggcagctcctaggttctttcagtgattgagagtgctgctttttcataacagatttctgttgatggtgtgatttggaagatgaatctcaatcttttgactttcctaaggcctg

SEQ ID NO: 397510 - DNA, 444 bp, Homo sapiens
acctcctaccccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttga

SEQ ID NO: 397511 - DNA, 510 bp, Homo sapiens
gaatgcatagcttgccatagctgagggtgggcagggttgagtacagcctgctctctcagcacaactgtgcctgaaatgtgagcggtgtggagagctggagactcagacaaaaacaggtgaaggaaaggctcttcaaggggtccaacgcacttccctagcccctgttttgtcccacaccacagcccaggttcttgctgcagagggagcccagctgagcctaggatccaggctgcttctgcgaacctgaagtcccccaggacacagcggggccttggggcttttgaaggaagcaagtggccaagggtgtgaaagtcatgagaaacccgagcttaaccactgggtgattgtgcacggtcaagaatttcatcatgatgaggcataggaaggaacctaattaatatccagggaagccacccacaggaaggaatttctttcccagaaagctagtatgatttaatattagaaaatctataaacatgatttatatgaataaaccaagaaattttttta

SEQ ID NO: 397512 - DNA, 766 bp, Homo sapiens
gaaaattatttgtaaacgcatttaaacaaattattatttctattttgagacggagtctcgctctgtcgcccaggctggagtgcagtggctggatctcggctcactgcaagctccgcctccctggttcacgccatcctcctgcctcaacctgtaatcccagcactttgggaggctgaggcgggctgatcacttgagcccaggattttgagaccagcctgggcaacatggtgaaaacccatctctacaaaaaatacaaaaattagctggacgtggtggcatgtgcctgtagtcccagcttctctgaaaggagactgacgtgggaggattgcctgagcccggggaggttgtagcatgtagaggacctgagaaactgtttttcataggtcacaacaacatgacaaataataacacatagactcaaatgggccccctcacttgattcaaagccctggattattataccatcctaccaaatagcaatcaggcactgccaattgggcatgcagctccttgtctccctccctcagagtgctatgaaagacctagggctcatatatttgttcaggcaaagtgagtgtatctgtgccactcctgttgccacacacccttgcagacagcctcgggtgcacctttatatttcaaagttgcctcagatactccaatctgacctgatttgacctcagtaaaaaacactggtgaagtaggtatggaactcacctacctgcaacccctgacgatggtcttatccatctccctttataatctc

SEQ ID NO: 397513 - DNA, 484 bp, Homo sapiens
cagcacacaggaaaatgcagtttagtagaggtaaagggtgggtagaaatggcattttttcccggaggcctttcctgtaggcaactatagttaaggagtgccctgtctgatgaaaactctgccaaaggatttcctggctgaggaattttctttccaaaggaaggtgggaaggaaatcagcccaaagcccgtgactttcacacttcaggcaaagttgagaggcagttagagggaacagggttgaaagcaacaaaaagtgccattttgatgagaacttcaggtgtttgttccaacatcaacctccctcccatacacaccaggcagaagccatgacctcaataaagagggagatcggaggacttcctgagaagggcgttttgcttttatgtctcccatgcctccagaacgtggaaaacacatgccagctcatttaacggggcaccttttctctccgtctagacactgctctctgctgggcctcctttc

SEQ ID NO: 397514 - DNA, 576 bp, Homo sapiens
aacgacgaattcacccaacaacgcatttctcagaatgaatccctgttgtcaagcgatgcatgactgtgcctttgatagttccttacaaattgatcttgagtgtgtattcatgtgtaacctagttactgaataatgcatctcgaaatgttggattctttttgcatccgcctgtgctgtgctgccttccatggagctctatgatgactggcacctcctggtggaggcatccttcccacattacccccagtaagagcaacaacaggcaaggctgtcctcttccccaggagggggaaggtaaagatggagagtcaggagaaaccaagagtttcccagtggcagaagctccggctcccctgaccacacagtgtgggttttcaccagagcttgagccttagcatcagccactcctgcgttcaacaacagctttggtgcttagtggctgggtgatgctgacccaatatagatgtcagtagagtgtacattttgcaaggaaaaaagctactgttctcatttattatttcatatgcttgttacatctattgctggataaatttgtgaatacgcacatcttagtga

SEQ ID NO: 397515 - DNA, 435 bp, Homo sapiens
caaaaattagccaggtgtggtggtacgcgtctgtaatctcagctgaggcagggaaatcgcttgaacccgggggacggaggttgcggtgagctgagaacatgccaatgcactccagcctggatgacagagcaagactccatctcaaaaaaaaaaaattaattcctcatttctggctaataaatttcattcctttttattgctgaatgaatattccattggatgtatatactacattttgttgatcagttcgtctggtgatgaacacttaggctgtttctactttttgtctgttgtgaataatgcttaatgcttctgtgaatatgagtgtacaaatatctgttcgcatctccagcttcaattcttttgtatatatacccaagaaagatatttttatttaatgttttcttgaaatataattcacatactataaaaata

SEQ ID NO: 397516 - DNA, 642 bp, Homo sapiens
actggttccagtgcctgaatccacttccttcctcttcccaggatatggtatcatcctgtacattccaccataataatggggccatctacttgcagagttactgcttggatcaaacaagataatgaacaaaaaagacctttcgttgtaaaggataccatcatacaaggttaccgtcagagaaatgtgttaaggatcggcagaagtgccaactaaacacaaaactattgaaggatgtaaagaaaggtatagtttacctaattgcagttagcttttcatttttcaatacggaactgcttggttctgaacaggacaaaagttcatctgataacccacaggacatcacccaaggaccgtgcaacaatgatcatctaaggaaacaagcatcagcatctgagcccaaacaacctacaggtcagtaacagcataaagaagcttcaatctcaggtgtctgcatcaagcaaggtttaatcatagtaactaaaaaaatgaattatctgaactaactttggcaatgtctttgaaaaaaggtaatgatctctactggttgtcttctcagacttccctaaatgttctacagacacaatttagcaaaagaaagtattaagaacaacagcctagaatggtggctcatggctgtaatcc

SEQ ID NO: 397517 - DNA, 302 bp, Homo sapiens
gatataatgtgatatgcctgggtgcctacaaattcttgatatactatttttcaaatagcaagtgataaatagcaaacaaagatgagcagtgcctatcttggctttcttcctcaatggtggttctttgttttgggcatctttcttcttactctgttttgaataacatatttcatattaaacacttttataaaatttccttattggataataagaaaatacaaaaaaggacaaatacaataaaaaaggaattttaatagttacataatatttgtctatgtcatagcttatagtatatcaaaatt

SEQ ID NO: 397518 - DNA, 357 bp, Homo sapiens
caggtgtgagccactgcaccctgcccccatttttaattaacaagcaatttatggggagatatttgagagaaatattctcttaccacatttttactcactactcttatattctagtgatgattcttgcctcaaccaatagctactagttttcaacaccaaccacattccaggtgctgcactaagggctctgcatgccttatccctatgtcatagaggaggaaaccaaaggtgcagagtgaaaaaatggcccaggcactcccagggagcaagtactggaggcggaggcagacagctgggtgcagtggctcacacctgtaatcacagcactttgggtggctgaggcaggaggatcgcttg

SEQ ID NO: 397519 - DNA, 409 bp, Homo sapiens
taaccactatagaatcccaatgcgccccacacctactgcccgtcgttttgcttccccacccctcttttatttatttatgcatttttttgagagacagaatttcgctttgtcgcccaggctggagggcagtggcgcgatctcggctcactgccacctctgcctctcaggttcaagcgattctcctgccaaagcgtagtacccaagtatctgggaccacaggtgcacaccaccatgcctggctaattttcttatttttggtggagatggggtcttactatgctgcacaggctggtcttgaactcctgggctcaagcaatccccccactttgggctcttaaagtgttggattacgagtgtgagccatcacacctggctgtctttttttttttgggggtactacgcttgggcg

SEQ ID NO: 397520 - DNA, 177 bp, Homo sapiens
gggggaaaaaacccacgtttggtcacagaactgttctgtgttgaagattgtgattattgtaatatggtgtgagcagaggaaaaacagattttgttttcccacactcacactaccactgtcaaaaatatttataagtgttagaagaagcttactgcattcatcactacgaacttatga

SEQ ID NO: 397521 - DNA, 655 bp, Homo sapiens
actagaatatcatgcctccagcacaggccaatgaccaagtgtcaagatgttgtccagtaggtctcggcactagctcgaatggagaattagatggcttccctggttcttggcatttaaaattctttgatataaaactacaagtatcgtacatatctttggacagtcagttttataaattatcaagataaaaagataataaggactatattatttatagagctcaggacttcaaacatgataaaagtattaaggaagcatcaaagacctcttccttcaatgttttagaagacacaaagacaaggaaaaaaatgtttttggcaacataggtacaaatgtactaaaatcaagaagttcaaatagttgtgattggatcatgtttaaaactctgtaattctaaacacatacaatcacacaggctttcactcgtgcaaggcaagaaagttttgttattggaaggaagttggcagaacagggtggatagtttgacactggatgacaacaccaattatgccagatgcagttctgcaataagctaactgtgggtccccaaccggtaatcaatcatgtgactgtggccactaacgggctaggggcctgccaaatttcacatgactgatagttatgaaatagcttcctttccgtgtgtctcaaaaca

SEQ ID NO: 397522 - DNA, 437 bp, Homo sapiens
atgcatcgatgccactgttcttccaagcctggcctgttaccttgtggcacatgagactagcagaaacacaggcttgatgtaaacaggcaaaagtcagtgccttttcttttagtccaactggagtagtggaaattaagaagaaacaaaatctgtaaccggttgtaattaattcgttgtaaacaccactgcactaggaccagaccatctcttttcaaaatcaactctctgcccgtcaaggagaaaggctccacggagggacatgatgccttttcccacctcccctaacactccctggcctccgggctgggactcacactgtcctgcggctgccagaattcagtaacagcttcatttgttcattgcattatttttccagttgccccctagttatgacaaggggtaactatttttttccatttttggtggagataaaaagt

SEQ ID NO: 397523 - DNA, 608 bp, Homo sapiens
ataccaggaaaaccatttggagatcaatgctttaaaggagaaaatgtgaactagtgggtgggagacacaaggaggcactttgacctgctaacacaaggagaccacactgacagcaagctatgccaatgacaggggcttcctacgtctagaagcattccagaaagggcacaaaaatgtacaaggggacatcaacatcgtatggttctctagcagcattttccaaagtagtttccaggtaacatgattcccaggaatcagggttccttcaaaaggaaatacagaaaatgctatattctgtaccctgagaagtcctgtagttaagcaaataaaacaaaaatgaaacccctcatgggtttctctaacctagtttttttgctaagtagccctttttacgtctcatactcgctggcatccctgaaacttgtgtttggtggcaaatgcttcccatgggaaataccaaactccactatctttctcagttcagcctctccttggctgaaataaccagatacagtttccaactctaagaaatacttatggttgaataagattaatgggagctagactggtcagctaaaagaagtaatcatctgaagcaagcaaaggga

SEQ ID NO: 397524 - DNA, 462 bp, Homo sapiens
cacacagaagatgctcaataaataccaagtttaattaaagtaggagtgcacagctagtgggcttgggagccatttaaacctagatacctggatttgaatgccggctcagctgtttactagctgtgaggctttaagcaaatcacttaacttctgtgtcttgttttcttcacatgtaaaaggggatccttactaaaattataggttaagataatgtatataaaccacctagcatgatgcctgctgaatagatcattcttgaataaagctgtgtattttccctgttttataaacttaataagctgtatcaaggcaaataagaagcttgtctcaaaagtaaatacaggctgggcatggtgactcctgcctgtaatcccaacactttgggaggccaaggcaggtggatcacttgaggctaggagttcaagaccagcctggccaacatggtgaaaccctgactctact

SEQ ID NO: 397525 - DNA, 266 bp, Homo sapiens
atgccatctctgatggacaacatgcacaaactttctgccttttcctatctacaagatcagagtaagtgtccaaggtttggtttattttatgtatccctaaatacagaggtacccctgagttagggtgacacagagcattctagaagcaaccttatagagaaacttaattgtaggcttaatcccaaaatagaaattcttttcactgcaaattgtcagtgtgatttggcatgccccaaaatacacacttgggtgccattggtcatcct

SEQ ID NO: 397526 - DNA, 491 bp, Homo sapiens
agtcactgggaacataaaggtgagcagtgccatctctgtctgtctttaagaattccgtctttgctgggtacggtggctcacacctttaatcccaacactttgggaggccaaggcaggtggatcacctgaggtcaggagttctagaccagcctgatcaacatggagaaaccctgtctctactaaaaatacaaaattagctgggtgtggtggcaggcacctgtaatcccagctactcggaaggctaaggcaggagaatagcttgaacctgggaggtggaggttgcagtgagccgaagtcaaaccattgcactccagcctaggcaacaagagcgaaactccatctcaaaaaaaaaaaaaaattcatctttaactgggtgcggtagtttatgcctgtaatcccagctacccaggagaccaggagtctgaggctgcggtgagccatgattgcatcactgtgctccatcctgggtgacaaagatgacccagattcta

SEQ ID NO: 397527 - DNA, 291 bp, Homo sapiens
aagcagttatacagactcagcatcgttaatgatcagggaaatgcaaatcgaaagcacaatgcgataccaccatgtctgaccaacaagaactcttttagtagagtggtggagggggttcaagagagaatgggaggaggccgggcatggtggctcacacctgtaatcccagtgctctgggaggccaagttgggcagttcactggagatcaggagcttgagaacagccttgggcaacatggcaaaaccccatctctactaaaaatacaaaaaattagcagggcatggtggcatg

SEQ ID NO: 397528 - DNA, 531 bp, Homo sapiens
tcgggaaaaaataaacaagattattaaagccccaaatttaatttctctctctcaggaatgttttactttctatacagcatgcccaacgaactgcttttctctcacacacacatacaaagcattaagcattggaaggagttcaaatcttctcaagattctgtttgcattaaaacaaagactggagcagccctatctacataccagcttggtaggtatggcatgagccaccaccaacccaaagtgaacaaagctcagggttggttccaagtttcaggactacacgtggactatgaaccctgggagagaccagcacatcataaggtatgacagaaagccaggctgggacagaaaaccagggtatcagtctgccccaaatcaaaatgttcattaaaattacttactcttcactgatgctgatggcaaaaagccatgtgtagaagaaaaacgaaagagccactgttctgcctggaacttctctgctgtcaattacgttaacttgccttaagatgcctgctatttgaagagtgcgtg

SEQ ID NO: 397529 - DNA, 501 bp, Homo sapiens
agtcagattcaggccaatggtattatgtttagctgttcatgaactagtagtttttcttatatagggtcttggagaaattgtggaattttggaaaaaaaaacacaattttccctatgtaatgggagttctagaagcatgctagataaaatgtgctagaaaccctcaaagaatggttgtagattatcatagagttcagatatacagctccatccgtctcacagttggtagtaaagggcagatggcccggtgcagtggctcacacctgtaatcccagcagtatgggaggccaaggtgggcagattgattgggctcagtagtttgaaactggcctgggcaacatagtgagacctcatctctacaaaaaaataaaaattagccaggcacagtggcacgtgcctctggtcccagaggattgcctgagcccggaatgtgggaggttgcagtgagctgagattgcaccactgcactccagcctgggctgcagagtgattctgtctcaaa

SEQ ID NO: 397530 - DNA, 1126 bp, Homo sapiens
tagccttcttgtagagggcttatgatcttagttggattagttaacaagtttttgttcagaaattggaaaatactagtcaccattactttcatctgtacttgaaaatttcgtctctcagacatccatcatctctaggtgttggtgacaaggcttgacatctttctagcagttgactttggcttcttaaattccttgaactaattgagagttttcttaagcagagcttagagggagtacttgcagcccccaaaacaaaggcagtttttaaattattgcctatagtctttgttattccagctgtcaccaaatgggattttaggcatttacaatcgtaaagggcaaaacgcaaattagggatgacaaaatcactcactgtggatgactctttaatgcttacctcaagacttcttagagtgtgattatcaccagtgacttcattgcctcttccagtattttgttaacctagtttggttccccctaaagctcttggataggccatttaaaagatgtacatgctgttttatgagctaaagatcatgtaacatattaaataatattttaaaaattactcataccctgttacttaacttccagtcttaattagaagagtgtgaactttcatcagtaggtcatagaaatagtacacacagcagcaaaataagaaaaagtatacttccctcttgatttcctttttctcccatgcctcccatgcctcattctgggttgaaggaagccagaatcgctttgggtaatagtagaacattatagtgactttaatttaggattttttatttactcttttatctttttctttccccacaccctgtaattatatcctaaattttaaaataaatgttcttgctgtttatggagcctttttattttatagtaatttcatatttttataagtattcttttattctgaaagtaatccttctatagtaactaggtaagttacatggaacactttcccttttccttaactaccagtgggcagttgatgaatgcacatacatccaaagaaagcttttccacccattttaagaatttctaagaaggtaacatttgtattggaatgctaatgccttgaagctgcatgttttgaaaaaagtagtggaataaaacc

SEQ ID NO: 397531 - DNA, 448 bp, Homo sapiens
tcagattttctcctatgtatctcttcaccatgccctacctactcttattgcagcatgtgtcttgctgtcttgtgctaggaatctaccatctctctttccaccattatgctgaacactccttatgtgtagggaacagattttgtttatctttaggccccagttcctagaaaagttcctggtatataattgacagtcaataaatattggctgagtgaatacgtgcctgtatctggctcctattttggacttctttctcttgaagctcctttaaaaacaaaactacataaaacaataaaaggacattaaaaattactgtctttctgccaggcacggtggatcacacctgtaatctcagaactttgggaggccaaggcaggaggatcagttgaggccatgaattcaagaccagcctgggtaatatggtgagaccctgtctgtacaaagaata

SEQ ID NO: 397532 - DNA, 351 bp, Homo sapiens
tctgtgccaagggcttgtgcaatggtattctaaaccaggtaacaagaagcccccaaatagcccagagctgtgagacctcattcctgcccgacaaggccacagccataccctacaaggccggggcctccagtaagtgggtgaggccaatgaccaggagaaaagggcattttcacccagggctctgctaaacctgcactggggaaccgaccccaggatccacagggaatgagtgcatttacccaacagagctgcggagcctccctcctcaaacccagactctgctagtccaagcagcccacttccactacaccagtttgcccagacggagagcctctgtttaagcagggcccc

SEQ ID NO: 397533 - DNA, 1173 bp, Homo sapiens
ttctttcttatactctcagttttacctagtatttcttgactcccctctttaaaagatgacaatattaatcctccttctccttcgttcagtgcttcacatcccaactgctacctttgtgctttaagtttgtactaatcggtaacaagtatatttagttctcatatttatatgctctgttctgttctcaaagttaaaaatcaatcaagagtgtttacattttgtgatgttttaaatactatttactgtggagctgagttgtacaccatgtttgcacatgttttgtggcacagctttactttttcctgatgtttctaattgcctttgtttttttttctcccttgtactgcttgccttcttcatttcctcagtttctctcaaactgtgaatcctttgaggtattctattgagtccctttttcccacagaaccattccctttttattccatcctggactggtcgttttgtaggcctactgcatgtcccactgtgatcctcagattcccttctctctgggttgattttcctgttttctggatcccatgtctttttctttcttggttatccccacctgccctccatggatgcacaacacatacacacacacacacaccctttcttcctcccggtggctcattctcaagtagctttcttagaacaccctgtgaccctgtgcctggtaacttttctattccccatatagctccttttcttctgtcatctttttggtttattttctggaggatttccgtgactttctttcacatggtctctctagacttgtttatttgatcatcaccttttagtttccacgaaaatctctttttttgttcgttccattgatttttcttcttttctatatatcttgttttaagtttatgaataaaatattttttaatctccctgaggacatgggtttgagatttaaaaaattacttgtttgttctggactccttttgtatttggtcatcttggtctgtttccccactttcacctttctccaatttctgatcctagatctattcatattgaacggggtggggggcaggtctactggcagtcttccctgtagggtgattgaatgggaacccactgaagtgtcagaatacaaagatattatttctggggcatattgcttcagtcatgaactctctgatttttttcactggtgtagac

SEQ ID NO: 397534 - DNA, 277 bp, Homo sapiens
atttcctcagtttctctcaaactgtgaatcctttgaggtattctattgagtccctttttcccacagaaccattccctttttattccatcctggactggtcgttttgtaggcctactgcatgtcccactgtgatcctcagattcccttctctctgggttgattttcctgttttctggatcccatgtctttttctttcttggttatccccacctgccctccatggatgcacaacacatacacacacacacacacacacacacacacacacccacccacc

SEQ ID NO: 397535 - DNA, 477 bp, Homo sapiens
attcaattacctcctaccaggtccctcccacaacacgtgggaattcaagataagatttgggtggggacacagccaaaccatatcaacccatctttattaaaacttaaaaacaagcctcaaaaagtataagctgataaacaagcaaattgtctgccaaaacaaaactctattaagaaaggcaagaggatccagacattaaatatcctaggatccatactatacaaaattatgggaggaaaattactataaattccaagcaggaaactaacccatgacctacaggagaaagaaatcaataaaaaaagagtcagaaatattaataacaatgacgtaagtagctgagacttcaaaacaagttactattatgtaacactaaaggatttaaagcaaaacacaaaggcaacaaaaaaacaaatgagggggccaggcacggtggctcacacctgtaatcccagcactttgggaggctgaggcagg

SEQ ID NO: 397536 - DNA, 535 bp, Homo sapiens
agttttctcctactccatacgcaattctcagtctcctttgtcagtttcccctccctgcaatctatctctaaatattaaaattcctcaagactcagttttttgctttattctctatcctctctttctagtagcacagatggaaatagatttaaacaattcatactgtggaaaatgaggggggctgttattggctaggactggctgccctgggttaaaaggagcattatccccatacaatgtaataagtttgggagaaacacttgtactgtatgactttcaaatttatagcttcagattaggcttctctgagctcagagtcagagtcagactgaaatattcaactgcccagccaatagatttttgcatctggtcatgatggagtaacatgcataaatttactttctaccttaaacaacaggagaactggagaaagatatggaacagatgttttttaagtttttgaaaacagggagtatagtatcgggattccaaagagaagagaaataattgcatctaccctctaattgccctagat

SEQ ID NO: 397537 - DNA, 469 bp, Homo sapiens
tcattcatgtgttcatgaaattactttttcattcactcatatttccaacaaacatttttgcttcacttgggccactgttttggggactcactagtgaatggaaggttcctgccttctggaagttacagctactagggtgcccaagggctgtatctgggctaactgctagattagctgcctaatttggacttgcaaacagctgttcccaaggtagaaacaagaaccctagtggtatctattacatgcttatgttctgcctctgagaggaggagactagggaaagcaccgaactcaaatcacagacaaatttcagtttgcatcctgccttcaccataaaccaactggatgaccttaggcaggtcacttattttctctgattcatagttagaattctgacttcaaagggtaataggagtaagtgagataaactatatggaaagcaagtatcacaatttctggccatagtaaa

SEQ ID NO: 397538 - DNA, 336 bp, Homo sapiens
ccatttccatcacccaagatagttctctcttgtccctctccagtcagttctcccctctccctggaggcaactttccagctttcattactatccattagtgttgactgttatagaatttcacgtaaatagaaccatatataatctgtactcttttgtgtccagcttcttttacttagcacatgtctgtaagatgtatgcatgttgttgcatgcataaatagttcatttcctttttgaatcatctgcctttgtattactatactacgatttgttctggatacattttcccactgatggacatttgggttgatccgactttgcgtgactgtgaaaaaag

SEQ ID NO: 397539 - DNA, 434 bp, Homo sapiens
ggcctttggcatctgagccagttctgatttgctgggatgctattattgcctcttcttatccatttcaggagtaaggggtagaagggaggaaaaaaatagaaataggaacagcatgaatgttgatcgacatcttgcattttgaagaggaaactcatcatctcctccaaatggtcatctactcaacgcctggagctctaaagaaatgcccatcctcttaatataaaacaaacacaaactatgtgttcagagcttccatgtgcatttgtgtttacagacggaaatacctgtgagactaaaaatcttcaagccttattgcagatccctggtttctgtgggattatgtaaaacctgtatttctgaaaccccgcctcccgtcttccttccatcttaaagcagggttgaaccttttattaaactgacagccaggaaatgtt

SEQ ID NO: 397540 - DNA, 468 bp, Homo sapiens
cccggttatcttcttctttctgttggcctgtctcagtctccttagtcagttcatcttcctctacctgaccattaagtgtggtatgctttaaaatccagtccgtaaaagggctcattttgatcacctcatcctcagcttcaactgccatctaaacactgaagactcttccccctagtaaaagatgccaggccaggcacggtagcacctgcctgtaatcccaacactttgggaggccaaggtaggaggactgcttgagcccagaagttcgagaccagcctggacaatatagcaagaacccatctgtacaaaaaaaatgtttcaattagcggggggtggtggtacacgcctgtagtcccagctattggtgggtgcggtggggggtactgatgtgagcaccagaggtcaaggctgcagtcagccatgatcacaccactatattctagcccaggtgacaaaatgaaaccatgt

SEQ ID NO: 397541 - DNA, 332 bp, Homo sapiens
cccggttatcttcttctttctgttggcctgtctcagtctccttagtcagttcatcttcctctacctgaccattaagtgtggtatgctttaaaatccagtccgtaaaagggctcattttgatcacctcatcctcagcttcaactgccatctaaacactgaagactcttccccctagtaaaagatgccaggccaggcacggtagcacctgcctgtaatcccaacactttgggaggccaaggtaggaggattgaggtcaggagttcaagaccagcctggccaacatggtgaaaccccgtctctactaaaaatacaaaaattagccgggtgtggtg

SEQ ID NO: 397542 - DNA, 370 bp, Homo sapiens
ctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatct

SEQ ID NO: 397543 - DNA, 601 bp, Homo sapiens
atggaacaattgtattaaatttctggaaagaaaataatatagtttcctttttgtagagatttctccaagattaaacagaaacgggccaataatgaaatccaatattccaaggatagtattctcatttagaaagaagactttcaatcagagggttaaaaaaaatcagtgaagcctgcttctgacaaataggaatgaggttaaatcacttagtctaggaactattctacatggttttactatttaacaggaaggggagaaaaggcaagtttgatttattgaaatggctatggaacccaaagaaaagttttacagcttgagcaaacaataaatggtcagaactgtacagaatcagaaagaggctctgaagatagattaccttggaaatggattagtagactattgaatatttaggttaaatacttgtctgctttggcaacattttcctatggtgtgtgctatttccataaatgccaggcagattgtataggagccatgtacggatctaatgacttctctgacgagagtagttaggacttgtttcccttctttctgatggataacctttagtgaggttattaactgatacagctggctgagtctt

SEQ ID NO: 397544 - DNA, 332 bp, Homo sapiens
cagaaacagttctctttttttctttacatatattttcagaatggcaactgtcttgtacatgttgatattggcctacattgttaataattagtgatatttttaaaagcccaattaaaaatatgttatttcataagtttcattttatccatgtgtcaaaattttatgcagacatttacgcaggtgatcctgtattttctttatgtttgtagttactgttcaacaatttaattctataatagattctgttatatgacagggtcattttattccaaataatgttaaatgaatttcaaagatttttataaataaagtactattcagtctccttttta

SEQ ID NO: 397545 - DNA, 252 bp, Homo sapiens
taatgggaatcttttttttccaatcccaaaattggaatccattgtctgacaacacatttgtgtgttggacaaaagaggctgcctggaaagggtgcatgctgagtgataggaatgcaggaggtacttgagaggcttgaaacaggccgggcgcagtggctcacacctgtaatcccagcactttgggaggccgaggcgggcagatcacgaggtcaggagattgagaccatcctggctaacacggtgaaaccccgt

SEQ ID NO: 397546 - DNA, 288 bp, Homo sapiens
gtggttgcttggatccaatgaaataaagccacgagggcatcctataaatggtaagagggctgtataaatagaaggaattaaccagcacccatttgtgctgttgcagctgctgcagatacgtgccttgtaaaattaccctattatttagagaccgagaaatatttggatagtggtaatgtgctgctctgagaaaagcagtcgccagtgggatttttatcacataattagagggtttgttaaatgtgctagtgaaaagaagctgtttgctgctgccttgttttaacatgg

SEQ ID NO: 397547 - DNA, 713 bp, Homo sapiens
ctggagaacacagtaggagaaggggcaggaaatgattacatggctgagtaccataaaaccatgaagtttatggacaggctgtaaatctgaacatgacacccttctcccctttcctctctctcccagcaacccgcccaggtgggccactcttctgtcattcccacataaccctctcagtcagagacttgtccttgtagggccctctcgtccccttcaaggctgcccttggtgatcacacataattctgagttcacccagacatagatgctgaagaggtgaggtacaaagtgtgacttacccacacgccgcactgacaatagaccctagtgcctggttaggggcatcactggcatttattaggaaaatgagttaggctagccagccttctctaaagcatacttctgtcgcctaactactcccactactcttctcttttttttgagatggagtctcactctgttgcccagcctggagtgcagcggcatgatctcggttcactgcaacctccacctcctgggttcaagtgattcttctgcctcagtctcccgagtagtgggattagcaggcacgagccaccacacccagctaatttttgtattgttagtagagacggggtttcaccatgttggccatgcaggtctcgaattcctgacctcaaatgatctgcccacctcggcctcccaaagtgctgggattataggcatgagccactg

SEQ ID NO: 397548 - DNA, 113 bp, Homo sapiens
acaagaggatctgcagttgaatttgtgggaaataatatgaaatacagtcagatggtcctaatggaggaagatgcagaattttctctagcatctagcttgtaggtcttgtgttt

SEQ ID NO: 397549 - DNA, 145 bp, Homo sapiens
tttccctgtagcagaccctcttcctgcttctggtctattcttcccaatttcagatgggcttaaaaacccgatacccatgttaataggtctagaattaaattaaaggtaaattctcagagccagggctgacacactaggaggacct

SEQ ID NO: 397550 - DNA, 357 bp, Homo sapiens
taagtagacagtctattgaggtttaggtttaaagtcttcctccagatactccagattgaatgtactaattaaaatagcaactacagtggtggagcattgagaatgctaatgaatgttttaaccctttggaaacctgatgcattcccataggttcatatggtcattctccaaaacactgggcattggttagaatggagtagacagtagatgcttagcttgaggtgggagtgaagctggctcctcaccattttttatatctcaagtcactgtggaaattactgggtgctttgtaaagtcttcctaacactggagctctaggactttgttgcttcctttcttccactcagccatgtttac

SEQ ID NO: 397551 - DNA, 250 bp, Homo sapiens
caataacaaacttgaatgtaagtggtttacattcccaaattgcaagatacagactggctgaatggatcaaaagaaagactcaactatttgctgcctccaagaaactcacttcacctgtaaagacacatatagactaaaagtgaagggctgaaaaatatattttatgcaaatggaaaccaaaagcaggcagcagtatataagttatacttatataagtcaaaaaacataaacagggacaaagaaggtcatt

SEQ ID NO: 397552 - DNA, 142 bp, Homo sapiens
gggactacaggcgcccaccaccactcccggctagtttttctatttttagtagagatgggctttcacagtgttggtcaggctggtctcgaacttctgatctcatgacccgcccaccttggcctctcaaagtgttgggattata

SEQ ID NO: 397553 - DNA, 600 bp, Homo sapiens
atcccctacttccctggtccaaggggagtttcggtacctcttcctggcaaagctctctctacttgagaccttatagctgcggacctgcttgtctgtgtcctccaagggacctgactgttttaacagaaatacccggcagaggaggcatttgatggtaaggagacagcttctaattcacattgctaaaatgagagacaaacaaacaaacagaagacaacctgtggaaaaggcttctgaataataaaaagagtcttccaactggcactcagcccaagagtccacagatcatcaccacagcaacagacagtatttggaggcaatgaggagcacaaaatgcagatctggcaaaggcattagcaaaattattcatttcaaggagactatataagctcctgaatttgtagcattcgcttctatatgtatattagccatcagaaacagaaagagctaatgagctgaagtgctggtgagaacagtcagggtaccacatacagctagctctacttggaacagacggctgatggcctaaggaacctgtagccacgtcagctccaaagcagggaccggttcagtcatcagtgcagccaatgttcatgaaat

SEQ ID NO: 397554 - DNA, 465 bp, Homo sapiens
acaacataagtgctatagatatgacacactgttaaattttatctgcattattaacattttctccattactttcctaggtgtctagacaattaagaaaacaaataaagccctgatttgtagcatttccgaatttccatggtaataaatacttccaccatggccaattttaagctaccagtgtgaaatcactgaatgtggatttgagaaaaaatgcacagtgacaaactgtaggggagggaacaaaaatatttttgtcttactcttccaggttctcaggctggagcttgtaagttggactaacaaatgagagattaacaaaagaaaagcatacacatttatttaatatgagctttatgtgacacagaagcattcataggaaaattaagacctgaagcaactgttaagcctgagtgtttttaatactaggtttgatgaggagtggaaagtcaatgaaaaacatgacag

SEQ ID NO: 397555 - DNA, 316 bp, Homo sapiens
tgctgggattataggtgtgagccactgtgcctggcctcaacaatttataatttggttttttaaaggatattgactattttaggctatatatgatgactagctttcaaaatgcttttctagcttatataaacaatattgaatagatgatttagtgatagagaactccacttaaattcagttccccacttcaatctttttccttgtaaaaattaaaaattattcaccttaacagttaaactacctaggctgttctgtctttccttctcttgtctttttcccactgtcttaataaatacataagttaaactgaattctt

SEQ ID NO: 397556 - DNA, 502 bp, Homo sapiens
gctcaccataaaggagaaatgcgttggctacttagtttccgtacgtgcctttgtgcacatatttgaataccagtacaacaaagcaactttatttttgctatggtctgaatatttgtgttcccctcatgcccccaattcatatgttgaaacctaatctgatgtgacagtattaagaggcagggccttaaggagaaggtgattagatgatgccctcatgactgggattagtggccatatgaaagaggcctgaaggagcttgttttcccctttcaccacatagggactcaacaagaaagtgcagtctattaggccctcatcagacactgaatctgctgacaccttgatcttggacttgctagcctctagaactatgagaaataaatgttgtttataagccatccagtttatggtatttttgttatagcagcctgaatagaagaactgagacaattttctaagaagatacagctatccttgcagggaagaaattcttacccatacc

SEQ ID NO: 397557 - DNA, 405 bp, Homo sapiens
tctgccttactcctagaaatatacaattgtggatctcacaaactgtcaatgtgcacaggtcactttctatgcaggtaacattttttagggatggaaagatacgccaaatgtccatattttgaaaggaactgatgcacattaaaaacatcttacaaatgccagaacattacccttacacattctggcactacacccctatcgagctagcgtgacaggtccctatctccttcaactcctaactctagtattcttacaagaaaggtctctgcagatagaggcctgaattctgatactcatgtgactacgtcaacaagtaacactgaaacaatttcaataatgctaaataaagtatagaagcgtttctaagcttgtagtcagagtgctaacgtgaatcaagtaagtcag

SEQ ID NO: 397558 - DNA, 339 bp, Homo sapiens
ggggcagggtcagaccccaccctttctggagccttgacctctcgcctcttgttagtccccacaagctgagggctgccatgcaaattcactgaaatcacatctaagcagtgcctaggaatacatttcagttcctcttcctctctgaggtcatcagtaagacattaattggggtcatacaacttagccctggtccgacatatgtagcctattcctgttttctcctgtgcaagtaacacagagattcattgtcattgtttacatcagcttttaataaaactgctgagcaatttcaccatagaatgtccattttctttcctttcccatcccctcccctcccct

SEQ ID NO: 397559 - DNA, 277 bp, Homo sapiens
tggtttcctagtatcacctactatcattagctttacctagttttacagccatgagaatatacctctcagatctccaaatacacagagaatgagtgaatggccccagctactatacactcaattccagtctgtcactccacatgagctgctttccataggctactcttacctccttcaggtctttgctcagatgttgttactttgtcaatgacacattccctgattactctaaaattgtcactagtctacttccttaccccacactactattccttta

SEQ ID NO: 397560 - DNA, 204 bp, Homo sapiens
tgtccaacagcatgtgtttactttgtgtctctatgtcacgttttggtaattgttgcagtatttcagatttattataattgtatctgttatggtgatctctgatcagggatctttgatgtttctattgtaattgttttggggagccatcaagcacacccatatgttgttgtgcattctgtctgcttcattgaccagctacccccg

SEQ ID NO: 397561 - DNA, 364 bp, Homo sapiens
cgaagaaaagggatggaagcaaaaattctttgagtgttatctcacatgattttgactttggaatcatgtaaatgtcttaaccatttgaaaaataaagttatatgtaaaaggaagtcaggtgtggtggctcatgcctgtgatcccagctactcgggaggctgaggcaggatcatgagcccaggggtttgaggctgcagtgggccatgatcataccatagagcaagaacctgtctccaaaacaaaacaaacaaaaccaacaaaacaaaaccccagaaaccaataagactattgcatagaatttgaaattcctttttgcctttagagtgccactgaaaaagaggaatcagagtgtactattataaaa

SEQ ID NO: 397562 - DNA, 286 bp, Homo sapiens
ttcctccccttcccttcctccctccctcccttccttctccatgttaagtatccatcaagggccatctggtttttacctacaaagcaagccttgaccactccagctctcactggctgctgaacttctataatagtccttctcagtgggggcagaggcggagctgctcttcaaggggaggacatgcatcagaatcactgtttgtggagtggggaggggcagtggtgttgccggctacatctccacccggagaaaacccctgagatggatggagggaggtatgccagag

SEQ ID NO: 397563 - DNA, 134 bp, Homo sapiens
cctgcctctagcatctttcctctctcatccaactctgtgtgaattcatcttcctgaagcacagacccaaacatgtgatgtctctctgcaaacacctataaaagctgccactggcttcagatgatgtcctcgtgt

SEQ ID NO: 397564 - DNA, 352 bp, Homo sapiens
gtgagccactgtacctggccatcaggaattattttagaagcaaatggtctgagtactacaattaaaagacaaagattggaagagtatattatttttaaaaaatgactcaagtaggccaggtacagcggctcctgcttgtaatccctttaggaggctgaggcagaaggatcacttgagcctaggagttcgagaccagcctgagcaacccagggagaccccatctctacaaataatttaaaaattagccaggcatggtggcacatgcctgtggtcctagctattcaggagctgaggtaggaggatcacttgaaccgaggaggtagaagctacagtgagtacagtgatcgaccaa

SEQ ID NO: 397565 - DNA, 501 bp, Homo sapiens
ggccaggttggctaaatgggaccacagcagaagcatgagccccagaatgtgcacgaaggaagagagagccgggggaggtggcgggctgggtgtgcagagtgggcctgagctccagcctcctccctggacgccctcccgtggccgcagccatccccgcacccactggtgtggcctgacccctcaccctgagcccacccttcgcggccactagggaacctcaggagaggccgccgcggtggggtgggcggattcccccggagcaggcccaggcccctgctcctgagctctcctgcagcgccgcctgctggccacagagagcccacgtgcgccggccgccaggcctgggcatctcccctcctgcagcgccgcctgctggccacagagaacccgcgtgcgccggccgccaggcctgggcatctcctctcctgcagcgccgcctgctggccacagagaacccgcgtgcgccggccaccaggcctgggcatctcctctcctgcagtg

SEQ ID NO: 397566 - DNA, 288 bp, Homo sapiens
tcctcttggggcaattcagcagacatcactggagcacctggaggtgctcagaggctggcatggccttggaggctgaaaatggaacccaaagattgaggagatgctctggacggggatacaggaagggtttgctttgagctcccaggacggacaactcggatccatcaacaccactcacatgtcctgaacgctcttctcttctgccaaggatgaagataaatatttacctttgaatgcagaataatgtctgaagctacataatgcgtgaaaggccttccttttaatcag

SEQ ID NO: 397567 - DNA, 559 bp, Homo sapiens
  misc_feature (505)..(505): n is a, c, g, or t
  misc_feature (542)..(542): n is a, c, g, or t
  misc_feature (550)..(550): n is a, c, g, or t
tcgcctgtttatgctcgtagttaatacttccgtgctccgttcctttgtgtagatccatatttccttctggcatcattttccttctgcctgaaggacttcttttaatatttcttgggcagccaatcatctggtggtaaatcctttcaccttttgtgtgtctttcaccttttgtgttttgccccttttttgaagtatgtatctagatctagatatatatattttttgagactgagtttcgctcttgttgcccaggttggagtgcagtggtgcaatctcagctcaccgcaacctccgcctcctgggttcaagtgattctcctgcctcagcctcccaatttagccaggtgtggtggcacatgcctgtaatccctcgtgccgaattcggagaggaatttaagataaaagccctgacccaaaggcccagattacattaaaggctgtggtgaaaaaagcagaactacttagcagagaacagaaatatgaagatggaattgctttgctgaagnacgcactggctaatcagagtgactgtgtcctgcatcngatcctangagaattcc

SEQ ID NO: 397568 - DNA, 607 bp, Homo sapiens
ctgtgcctgccctgaacggggatggaggacacagggggtggaggacacacttcctttaagaaaccagaggcctatcctggcacacaaacccagggctagtccatccgattggaaactaattatacagcaaatcgtatttgctgcccccgccccagcctgtggtggccctcctgccttttgttggttgtatgtgtatgttttttaattgctaaacagtgactcattctgactggtccccccacacaggaaacagccccatctccaatcatgccctgaacagagcttcctcatagccagcctccgcactggcctccactaacctccagggatccccacccagagacactcccagtcccaccagagtgcagcctagcccccagatatcacacccaggccccaggccccaaggtggggcttcagagaggactcctcggtgtcaggccaaccccttcattttggtatgactcaaccctgaaagccagaggactggggagggacctaggaggagccccctccactgaaggggacggaagtattgcctcagtccagctccaaaaccaggcccagaggcctgaggggggaggcggtttgacattggccgcggccg

SEQ ID NO: 397569 - DNA, 543 bp, Homo sapiens
gatggggaggagaaggtgttggcaggagttttggaaggctggatggccaggactgagttgattgactacggcttgtgagggaggagaaatctaggtgactcccatctccctgctggagggactgggtgaatgagatgccattgatgagacagggatgtgagagcaggagatctagggaggggtgactttagaccaccgagggtttctcagcctcagcattatggccatttcagcctgataattccttgtcgggggctgtctgtgcattgtgagatggtcaccagcatccttggcctctactcatttgaatttaacatccctgaagacagccggatggagctgcccaatagatggttgggtgttggagcgggggagctcaggagacagctttgcattgtgttttccatagcatgcaagggcccttgctgagtaggaaggaggagggaatgactccttgtgagcagcgaggttggagttcaagttatctgtgcccatgccctggctccccaagcatcttgtgggtgccttgagaagaaaaagaat

SEQ ID NO: 397570 - DNA, 217 bp, Homo sapiens
taggcccagaataaggacgggaggaaattgggggattccaggctttgctcggatctgagaggattggggcggcttacagactggggcggggggggggggcgtccgacagccacaagttagttttctgagaaaaaccttacacagagatgttaggaaacctatcccccattctcatcctatccatcaactcagacatcattgccgggaaatcctatta

SEQ ID NO: 397571 - DNA, 534 bp, Homo sapiens
aaaggttagcttccttgcccaaggtcacagagagaagaacaacaaaaatagaaggccttgtagagtgaccaggccagagtagatatttgctaaatgctggacttgggactattgcaattttatttagggaaggctgattcctgtgtaaatgagaaattacaccaaacagttaagaacagtttgttctctggtttcagagccttctgttgcagatattttctttgtagaattcccatggaagcccaatatggttacagaaaaacttctaatgtgtgcagtcagagagaacctttatctttattgagcgttatatggtgtggggcatgttagaatctaaagaaatctttgtaagaaatatgttcttgttataggtctcaagataaaaaaaagaagtaaataatatcatggcctgttttaacagtttgcagcattcctcatttattttgttttatttataaattctatttatcttatagtgtttactttttctcactataaaatgcttttagttgaaaatatgtaatacaaacagca

SEQ ID NO: 397572 - DNA, 326 bp, Homo sapiens
tgagtacactggatggaattagacttcggagaggaaaagagtagcaaaacgatagcaatagaaactacccaaaaggaaatagaaaaaaagaataaaaacagaattgtaggacaccttcaaatagcctaataaatgtgtacttggaatccccaggtagaggagagaggaggaaaaatatttgaaaaatcaggggctataattttgtcagatgatgaaaactataaatccacagattcaagaagctcaatacatctcaagcacagggaatataaggaaaactgcacaaaagcatactatagtcagattgctcaaaaccagtgatgaag

SEQ ID NO: 397573 - DNA, 212 bp, Homo sapiens
ggattcctgaaagtgcccagatctcctgacagagaatccctaagggcaggcctggaatctgcatttgtgatcagtctcctaggtggttctgcacactgacatttgagaagtgctgatccagggcccaggggaggactcaggcccatccctgatgagcatttggaaatgttcgagaggggagggatgcagggatgctggattcagctggcgca

SEQ ID NO: 397574 - DNA, 281 bp, Homo sapiens
atgaggctggctcagaaggctgcagggcccctgggaatggaggcagccctggggacaggccaacagccccggaagaaggccgagtgtctgaataatgaacgtgttctttaaatggagttgtggccctgtggcgtgctgagaactcattttccacagttcactattctcctagtcaatggggcttgacttgattatccctcctcccagcttcaggagatgtgggcaacattggagatttgttaaaaattagctaaataaaatcatcctctcctcctcagcaa

SEQ ID NO: 397575 - DNA, 187 bp, Homo sapiens
cccagagcgagatgcggtatgctttcactccactgcagaacctcccaagcactgcttcctgctcgctccataccttaagctgatggacatttacacccagcattctcatagacagtgtctggagtccatgtcatgactgctgagaatgctgggtgtaaatgtccatcagcttaaggtatggagcgag

SEQ ID NO: 397576 - DNA, 428 bp, Homo sapiens
acacttgtgtgttatgtaatattagtggtatatgaggtgtcttcacaaagtctaagtatttaattgtaagttcctggagggatgtggttgtgtctcctattttttacaccccataatcccagtttatggcatcatgcctggcatgtgaggcacccaataattatctagctgggtgtggtagacacacctataatcccagcacttattccttgagcctaggagttcaagaccagcctgggcaacaatgatacttcgtctctactaacagtaaaataacttaagcctggtgtggtggtacacgcctgtagtcccagctacccaggtgactgaggcagaggattgcttgagcctgggaggtcgaggctgctgtgagccgtgatcatacccactgcactccagcttgggtaacagagtgagactctgtctca

SEQ ID NO: 397577 - DNA, 441 bp, Homo sapiens
cagatcttgttagcactgtggcttcaggcctagttaaacattcaagcccaatgcggttggagagcacccatggcacgcccattgtgcagcagtgtgtttaatacatgtgctgcttttaatgggtgtgaaagatcagagagcttgggtgtgtgttttaccaaccactttttaaactcacatagtaaaatttatagtatataaaaagcagaaaatatggtgtatcttctaaatattcacatttaaaacattttttagaaataatgtatgtcaagcaaggtcaagctaatgtgtttatataggctctaaattagagttgtgaaccagtatctcatcccacttatagggttttttttgaaaacgttcaaatgtttccagcctgggtgacacggtgagaactctgtctccaaaaacaaaacaaagcaaaacaaaacccacccaaaa

SEQ ID NO: 397578 - DNA, 519 bp, Homo sapiens
tgaggagactgtggcaaagggagatgaattaacttgctcagagtcacactaccagactgcaaactcaggtgctttttattatgcagaatacccgctgcagacctaatcctgccccaggctctggggccagctttgttcgcagggagattttaaggagggtatataatttaaggtgtggtagaaagaatactggactgggatgctggtttgctggactgtcatctcaaatctttgatttgactcatcctggggcctggatgagtcagcctttgtgtgtgggccctggttttctgacccctaagaaggaagctggagcttgaccttctctaaagctatacctggccctaacatttagtgatcttcatggttgggagtaaaagtgtgcgtgtttgcctgttcagcagctgctttgtgcagaacctgctgaggtcagcagctgccctgtagctgttctagcatcagactcctacaggaaaaagtctcaatttatggaatgttctgctctggtaagttggatgg

SEQ ID NO: 397579 - DNA, 257 bp, Homo sapiens
agattgcgcctctgcactccagcctgggcgacagagtgagactccatatcaaaaaaaaaaaaaaagtccaactcccccacctcagtagtcaatgagttgtccctatcctactgactaaataatccgttctttcccactaatatgaaactcaaacttactgtgagccaggccctggtctgtcaagtttacctttctagtctcctgccgtaactcaatgaagcagattgataatattcccattcacagcaagaaaaccg

SEQ ID NO: 397580 - DNA, 338 bp, Homo sapiens
agcaacttcagcatataattttttgtttccttattaagtcaagaaattttcactttttcatggaaaggaagcagttttatggcttctctttggcatatccaaactgccagcatcactactcttgtgctttggggacattattaagtacaaaggtgacctgaaactgagcaatggggtactgtgacagttgataaccaaggtggctcctaagagactcatagatggggcacacctatagtgtggatttgctggacaaaggggagattcacatcctgaggaagatggagctgcatggcgcaagatttcatcatgctacttatgatggtgtgctatttaaa

SEQ ID NO: 397581 - DNA, 484 bp, Homo sapiens
ctggaatgcaatggcgcgatcttggctcactacacttcccaggttcaagcgattctcctgcctcagcttcccaagtagctgggattacaggtgggtcccaccatgcctggcaaatttttgtatttttagtaaagacagggtttcaccatgttggtcaggctggtctcgaacccctgacctcgtgatccacccaccttggccagagtgctgggattacaggtgtgagccaccacgcccggcccacccacttaaatgttaatccactcctaaaacacgcttaaagaaacattcaggttctttaaaccacatatctgggcactttggccagccaaattgacatataaaattaaccatctggcaaaattaatcaagaaaaaaagaaataagaatgacaaagggggaaccttagacatagcagagattaaaaagctaattaaattgtaattattacaacttaataaaaagataatccaatttaaaaaca

SEQ ID NO: 397582 - DNA, 745 bp, Homo sapiens
agtatataaggcaaaatgttctgtagccaagtgcttttgaaaaaaaaaaaaataagaaaggctgatgacagaacttctaccctagaagctaatttctctttaaagtactgtcatctaaacactccatccttggcaacatagatactgtcacttaaaaaaacaaaaacatagcctgggcaaaagaacgagatcctgcttctacaaaaagtaaacaaaaattgagccgggcatggtggctcatgcctgtaatcccacactttgagaagccaaggcgggcagaatgcctgagctcaggagttcgagaccatcctggccaacatggtgaaaccccatctctactcaaatacaaaagattagccagccatggtggcacgtgcctgtagtcccagctgctcaggaggctgaagcatgagaattgcttgagccctggaggtggaggttgcagcgagctgagatcgcgtaaacaaaaattagtggagtatggtggcacagcagtcctagctactcgggagactgaggcaagaggaatccctgaacccaggagtttcaggctgcattgaaccactgcactccagcttaggcttcagagcaagaacctgtctctaaaaaagaaggaaaaacctttttgctcttcctgtctcatggtgtagctgtctccccacataggaagctggaacgtcataggggattctctgtcttcccattatggacagtctcaccccttgccaggaccccatcaccacag

SEQ ID NO: 397583 - DNA, 513 bp, Homo sapiens
gtttcaggatacccaatcaacacacaaaatcaattgtatttctatataccagcaataaacaatctgaaagaataaaatacttagaatactttaccctaggagctgtaagactggtccactagaatctataaaacactgtgaaaggagttaatgaagacctaagtaaatagtaagataacctgtgttcacaggttgaaagacttaatattgtgaatttggcaatactacccaaagcagtttacaggttaatgcagttcctatcaaaataccagtgccttttttttttttttctgatcctaaaatttatgtggaattgcaagggatcctgaatagctaaaacaatcttgtaaaaggggaacgaagttggaggactctcacttcctaatttcaaaacttactaaaaccctcagtcatcagaatagtgtgatattggcataaggatagatatatagatcaatggaattgaattgaaaccaacccgtacatctatggtcagttgattttagacaaggg

SEQ ID NO: 397584 - DNA, 781 bp, Homo sapiens
  misc_feature (54)..(54): n is a, c, g, or t
tcctcgcctctcaattctctatacggtctccactattttcatcccaccactccnaaaaaaagaaataatatattcaatgtactaaaagaaaaatattgccagtaaagaatattgctttaatattctttattaaatataagcaaagctattcctcagaaatgaaagaaaataaagtctttttcagatatgcaaaagctaagggaagactagccttacaagaaacactcaagagagttttagatctggaagtgaaaagacaataaccaccaccatgatgaaaacaaatgaaattataaaattcacttgtagagctgatatacaaaagagaaagagaaaggaatcaaaccttatcactacagaaaaccactaagccacaaaaataaacaataaggaggattaaagagaaaggaatatacaaccggaaaaccatcaataaaacgacaagagttaagtcctcacctaccaataaataaccttgaatgtaaataaattaaattccccaattaaaagacgttgaatgaatgaatgaataaaaaaaccatgcaactatatgctgccaaataaaaactcacctcacctgtaaaagacacacaaagactgaaagtgaagggatggaaaaaaataatcaatgcaaacagaaacaaaagtgagcagaagtagctattcttatgtcagataatacaggctatttaagtaaaaagtgatagagacaaagaaggacattatataataataaaggtatcaattcagcaagaagacataacaatggtaaatatatatg

SEQ ID NO: 397585 - DNA, 370 bp, Homo sapiens
aaaagcacagcaaaacgggtgccacgctccatagccgtttcccaggggcctgccgtcttgggcagaagtgtcataaagggagatattgttagagggttttttatttcattttattatttatttgtttattgtgagacagtctcactctgttgcccagattgcagtgcagtgagccaaaattgcgccactgcactccaacctgagcaacacagcgagactccatctcaaaaaaaaaaaaatgcatattctggcttggcgtggtggcttatgcctgtaatcccagcagtttgagaggccgaggggggtggattgtttgagtccaggagttttagaccagcctgggcaacatggcaaaaccctgttgctacta

SEQ ID NO: 397586 - DNA, 479 bp, Homo sapiens
agctcggcacctattggactttcttccatgacctcagtcaaggtacagatatgcagtgactttttcactatgacacccattcctgccacgtttttttcatatccttaccactatctggaatttttatgtgtgccatctccagtaaaatacaacctgcatatgtgcatggatctggtaaaattgttacttttgctatccccttctttcctactaagtgcatcaataaatagcatccactctatatttgtgtcttcctcaagtaaatacatgaaaatgagatcctgcaagtttgtgtttttatagttagtgttaactccagagattacaacactgttcttgtaggatgtgtttttggggaaagcgttcctcttatggcagccctgttagcctgaggcagggcttaaacaaactgagcaggctcaaaaggacagtattgtaatggactggagtggccagatctttttacagaagaaagaata

SEQ ID NO: 397587 - DNA, 463 bp, Homo sapiens
aatgggaaacattggtggcgccacagctggctggtggcgacttcaagacccactggaaggctgggattggcagccatgactcataagggcggaataccacggggatcggtttgtctggcgaacttgagtgaagggtcaagatctggatttcacctttcctctgagcttcctgataacccggacgttccgtaaacccggatccggagccgaaagtggtgcccagatcccgtctcggaattcatttgttcagcatttaccttttgaacgccggtttcctgtaggaagtgtcgcctagctgatccgtgtagggctgttgggaattgggggtggggaggatggtgcgggtacgttctggtgtggcttaagaaagtggtaatagataggggaagaccagattatgcgaagccttgtaaattaattgatttttatccttaaggcaatgaaaagtctttgaagaatctca

SEQ ID NO: 397588 - DNA, 259 bp, Homo sapiens
attgacctgcttctagcagtggtactacattcagacagcaatgtggattgattctgcccccacgcttcatgtgccatccagaggcaggtgtactcatccattgagggatccttccagagagaggtgactgaggagcaaagccattgttgaaacaccgagtctgaggagatgagatggaggcacgtcccaaaattgataaacctctagctggtctgataaagaaaaatgacacaaattatcaatatcagtgaacatcact

SEQ ID NO: 397589 - DNA, 511 bp, Homo sapiens
caagttccgggtttgttaaaccacctttctatactcctaggtgaggcaaaagaacaggctagctagataaggctttttaactcctttccctgctatagtcctggtttactcaccaaaccttacattaaactcttatattaaacattataccattgagcactggtatctttgcagtattcacagtgatacccatggataccactagataccatttgaagtgcgcttgctgggagagaggaacttttcacgttttacttcaatttgcccctatactgtatgaacttttataatgagcacattttacagacagaaagacatgcatacggtattagaagatccttaatgattagtttataacttgtccctcacgcatcttaatccaactcaaaatactgtaaactgattggaaggaatatcaacatacaaaacaaagaatggccaagaaagcacatccctaataaaatattgctcatatcctagcaggtaaatctaaaggacatgaaatgataca

SEQ ID NO: 397590 - DNA, 300 bp, Homo sapiens
tcgagagctggacctgatgtgtgacaaagaccatgcttccatatctccttccactgtccccctcaactccctctctttgttcacccacaaccactcgggcctgtgcggctccctcccctgccaccttcagagtctgagccaggccacctcttgactgaccacactgtctttctggatgtttaatttttttttttttttttgagatagagtttccctcttgttgcacagctggagtgcaatggtgcaatcttggctcactgcaacctccaccttcagggtggttctcctgcgattctcctg

SEQ ID NO: 397591 - DNA, 381 bp, Homo sapiens
ttggagcaagtagtgagttaaatttaatccactcctttagccaagtgagtatggtgaagttagagtagcaaaagggaacttctgggtggaatgggtggtctatgcaagggaataattatattatatggctgtgggatttaagctggatatggaaagagtgaggatacaaggaaggtaagggacacagacagtggtcagatcaatggcttgtccttcctgataggtcaaaaacttttgggagtctgagtaccagaggtaagagtaaagataggaagtgggcagaggataggatgtttgagattatgtagatagtaatgaaaagggctagggtagaaccgtgggaagaacatcaataagagaaagaaatggagaggacagagt

SEQ ID NO: 397592 - DNA, 523 bp, Homo sapiens
acactgaagggtaagcagaagagaatttattgggtgaaaaggaaaagagaaagaaagcactcagcaaagcgagagggagtcctgccaacgggttctcaacacctgacactttgaataccaggccaccacacacgcgccgaagaggccaggttcctctcccttgcacaaggtgtgatcctcccatggctccactccatcatcccagtgcacaggcaggtccccaatccatgatggacatgtgcatacaagactctgggtggttccctcatctgcacaaatggatctgatgtgaacacttgtggggcgggtcagcgattctccgtgtaccccccttatctgcctcctgcatctatcattgggtatatattgtctttgcaaactgtctttgcatctatcattgaatgtctgtgttgtctttgcaactgttctgttaagataaaactatactaaaattaacaagttagttaaaaagaaaacttcaggacaaccatccacactagactacatagatagacaaatgatg

SEQ ID NO: 397593 - DNA, 460 bp, Homo sapiens
gaggggattggagctgtatagactggagtttgtgtatgatattccagctaaatgggtatcaattcaaaccatagtgttataaatttaggatgtaaaacataatctcctaggtaaacacaaagaaaaaacttttatttattcatttatttttagagatggggccttattctctcaccaagtctggagcatagtgttgtgatcatagctcactgcaacctcaaactcctgaactcaagggattttcctgcctccacctcccaagtagctgagactacaggcataagccactatacccagttacatttttaaatttttttgtagatacaaagtctcgccatcttgtccagactgatctcagactcctgggctcaggtgatcctcctacctcagcctcctaaaaagtgttgggattatgagtgaggtaccatgcccagccagaaaataatttttttaaatacac

SEQ ID NO: 397594 - DNA, 740 bp, Homo sapiens
tctactaaaaatacaaaattagccaggcatggtggcacatgcctgtaatcccagctactcgggaggctgagacaggaaaatcgcttgaacctgggaggcagaggttgcagtgagcccagatcgtgccattgcactccagcttgggcaacaagagcgaaactccatgtcaaataaataaatacgtacatctgtgttaaaatgtaaacataaagtgaaacaaagggagtgataaataacaaactcaggctaattaataccctgatgagctgcagtggggataggtttagggagagtgaagcatgaaatcagggagaagcaatgcaaatataatgttctatttcttatgatacttctagagcttttttgtatataattgctactactatggcttgagaatgtttgtgtcactcccaaatccttacgttgaaacttaatccccattgtggtgctattaagaggcggagtctttcgggaagtgattaagtcatccagtctccatccttgtgactgggattaaagacttcctaaaagaagcttcggagagctgcctggtccttccatctcttctgctacatgagggcacagcttctgtcctttccaccatctgaggtaacagcaccaaggcaccgtcttggaagcacagagcagctttcacgagacactgaatctactggcaccttgatcttggacctgccagtttctgtaactgtaagaaataaatttctgttgtttacaaatta

SEQ ID NO: 397595 - DNA, 343 bp, Homo sapiens
cacctttgtagccagccctggaaggcctgaatgcacaaacacagtgccctttcaccggagcctctcgggtctcctgtttcagtgaggccgtgaaagagagcactgtaaataaaagaggcctgtttgacctgcccctctggccgggacctccttccactctactgtaacagagctgccggccagcacagcctcggcccctctgctcagtcctactgcccacgcccactgggcaccgaggggcagcaagacaaaagggtgaggcccagcctggtctaagggtgtcagtgagaaggggcgcacaggcctggtcattccaatgactcgtaagcatcaaagcacttgt

SEQ ID NO: 397596 - DNA, 366 bp, Homo sapiens
cacgcctggtccataggtttacttttgatggataaaattcagaagctatgttttgtaagaccttatttctaaaattaatttctgtgatgcttgacaacatcctgtataaaataggtacattcctgatgagctctttcccatcagccagtgctaaattatgtctcagctggttctcagtattcttgcagcagagtattttctccttacaagtggaatgaatttagcttattagacccttgcagatttttgagtacctgacttacagatttttaatagtagatagttgactattaaattcctttttccagtttcatagcagtttatttcattactgcttggaaaagtctttacttatgttaatatatg

SEQ ID NO: 397597 - DNA, 361 bp, Homo sapiens
taaatataacaagtattcacttggaggctgtctgctgtgataaactttaaatcgctagagatttctttccttaaaaatgtattaccacttcttatgttataatctgtgctaactttgggaggccgaggagggtggatcatttgaggttaggagtttgagatcagcctgaccaacatggtgaaaccctgtctctactaaaaatacaaaaaaattagccaagtgtggtggcacatgcctgtaattctggctacttgggaggctgagacacaagaatcgcttgaacccaggaggtgaaggttgcagtgagctgagatcataccactgcactccagcctgggcaagacagcgagactctgtctca

SEQ ID NO: 397598 - DNA, 505 bp, Homo sapiens
ctggagaaaaaaattgtaattctttctgataactaaaatgggttataaagcacaaaatcaatcagaccaagaacagtctgttttactacaacatccatttctgctttcatagctcttatcagaaaatactccaacagtaacatagtcaaaagcagaaagaatagggtgtaacaattatgtgatttttgctatgggatactagcagccctttttaaatgcactagaaatatatatttaaaaacaaaggtccttccaaagatatgacttgtagaaatctagattctaaataactgtgatttcaaagatatgactttagaaacaatatgaattttctttataaacatttaccaattcaaaaaatggtgtctttattcaagaatttttaaaataagaataaaatcccttaatgctgcaattttgcagggcaagatcaaagtgcttggaaaatccgtatattagaatgcaaaagaacttgacagatgaactaattcatctgccaaatgcc

SEQ ID NO: 397599 - DNA, 682 bp, Homo sapiens
ggaaagaacaaaggataccaaaaaggcaatattttaagatagtgaaggatggtgtaattattcagtaaatggttctagaaaaattggttgaccattttgaaaattagattattaatactgacaagtctcatatgaaaaccagagagatacagatgaaattgagataccattttcttcctgagatttccaccgtgacaaaaaaatatgatgattattgttggtgaaggtttggggaaattctcaaacactgctggtagcagtataaattgctgtagacttttctagaggacaacactatgtacttcaaggaacacaccttaaggatttcctattggacaggtccttaaagataagaataatcattacagtattatttatgtaagtgaaaaactgatagcaacctaaatatatgccaccatgggactgcttatggtacattcatatagtggaatgctaggtagaaaagagatggagacaggaaagtcatgtttattgacataatacagtgagtttcaaaaaagtccaggattaatgcttttgtttggtttaaaaacctttatgtcggactgggcgtggttgctcccacctgtaatcccaggactttgggaggccgaggtgggcagattgtgaggtcaggagttcaagaccagcctggccaacatagtgaaaccccgtctctact

SEQ ID NO: 397600 - DNA, 403 bp, Homo sapiens
gaagaaaggcatgcgctggggtctaggaacattcccaccctgctgggaagctccagtgtgaggaactctccaacacagctgtgtgcgtaagctggaaaaattaagggcaggtcagcatccaccccaaattcacagagaggccgtttatggctctgctactcacatctccctttcttggaaaacattttaatttaggtctgacctcttgcatggtgggaaggacccaaggtccttgagtaactcagcgaaggcaggggtctctaccttcccatcctagggcagaccctgaacacaagctccttgagctctccaaaaacaaacccacaccaaatgaagggactcaggcactggctgcactccccacaggacggatcagctgctctagaggggcggctcttctctg

SEQ ID NO: 397601 - DNA, 380 bp, Homo sapiens
gaagaaaggcatgcgctggggtctaggaacattcccaccctgctgggaagctccagtgtgaggaactctccaacacagctgtgtgcgtaagctggaaaaattaagggcaggtcagcatccaccccaaattcacagagaggccgtttatggctctgctactcacatctccctttcttggaaaacattttaatttaggtctgacctcttccttgagtaactcagcgaaggcaggggtctctaccttcccatcctagggcagaccctgaacacaagctccttgagctctccaaaaacaaacccacaccaaatgaagggactcaggcactggctgcactccccacaggacggatcagctgctctagaggggcggctcttctctg

SEQ ID NO: 397602 - DNA, 122 bp, Homo sapiens
ttgggcaaatcacttgtgctttctgaccctcacaatgggagagctccctattctttgtgcctcactggaccataagcatcaaaggaaatatcatggaagggaaagagcttctgggatgataa

SEQ ID NO: 397603 - DNA, 581 bp, Homo sapiens
cttgtagctgacagtgtacttcaaaatcgtacataggaattaatgtggcttttgacattaaaaagcaaattactagaccattagaccatacactaaaaggttatcagctcagttaacaaaatgaaaagttgtatctcctctgagtacatttgtggacaagtgtacttaattgatgttctttaatttcatgtgcctgggaagatttttttttaaattgataatcaaagagggttaaaatagggaattagtcatgaaagcaatggcaacatttcataaacgaaatcgactctaggtttgaaaattggaaacaattaataactgtaggcttaacggcatttccttttaatttccttctttttagttacgtaaaatttaatttactgcctgtgtgcctcagtccaactattattagaaaattgcccttaaacttccaaggtattatacataaaagctctctgcaagccataatactaaatctcagcaaagagaataggaaagctaaatgttctgaaattgaagtcattctgctactgagcaggagagtaatttagcaaaccccgattaaatctctctcaataaaa

SEQ ID NO: 397604 - DNA, 407 bp, Homo sapiens
taaagttcagtatgagtcctagggcactggaaaccccaaatgactactgaaccttcctacttggaatttttccatgtcaaaggggtcagaacctgcgacagcagccagactcacatcctttgcactgcctgtccctcagcataaaaagtgcattttctttctttttttttttttttccagagatgaagtctcactctgttgcccaggctggagtgcagtggcacgatctcggcccactgcaacctccaccttctgggttcaagtgatgctcctgcctcagcctcctgagtagctgggattacaggcatgtgccaccatgcccggctaatcatgcaaaatcatgaagacccatagtgccacatttcctacaaaacaggtcaatcgattgtcaaaaggaaagcatcaga

SEQ ID NO: 397605 - DNA, 214 bp, Homo sapiens
taaagttcagtatgagtcctagggcactggaaaccccaaatgactactgaaccttcctacttggaatttttccatgtcaaaggggtcagaacctgcgacagcagccagactcacatcctttgcactgcctgtccctcagcataaaaagtgcattttctttctttttttttttttttcccacctggggacaacagagttgagacgcgtgttcctc

SEQ ID NO: 397606 - DNA, 489 bp, Homo sapiens
tgagctggggggaaaggaaggctggccctctgcttttggtgtcaggattactatttaatgcagtagtcctctattttccttcttcccccaaataaagtgttagtatatgtaattttcaaaagacattttaaaagagcctttccccacacctcaaaaaatttgatgtggaaaggcagattggcggttacacccctaatttttcctacccctttaaaaaatgaaattatatatatttccttccctttccctttccttcatttccttctttcttttctcgtttccttcctttccccccgtcctttcttacagtctcactctcacccctcgaacttctggcctcaagcaatcctctggctttggcctcccaaagtgttggtattacacgcatgagccactgtgcccagccagtctattccttttaaccaaaattcataggtagtgcccagagagagtacaagctctgactcatatggcagtatttacttaaaa

SEQ ID NO: 397607 - DNA, 409 bp, Homo sapiens
aagaagagggagacaatatggggggtcggcagctatcagtttctgctgtaggggaccactgagggctccaagcatagaaccatcatggttcagatgggagaattacatgggtccttagctcatagcttttgcttgatttatgtgatcaaatcagaaacttcggccccacacccaagcccactaatctcaggctccaacagccagcccctgctgcttcagaggtcttggtacttttgtttttccctctcacccatcacctccttttcttctttttttttatttcttttttggctgggtgcagtggctcacgcctgtaatcccagcactttgggaggccgaggcaagaggatcacttgaggtcaggagttcgagaccagcctggccaatatggtgaaaccccatctctaca

SEQ ID NO: 397608 - DNA, 586 bp, Homo sapiens
tttaaagggctcggacaaaaatagtttattctacatatagtcgaaaatctgccaaagaagtaggagagaaattgttggagttacatgtgaattattatgttttagaagaggcatggtgtgttgtgagaactaagcctggttgcagtatgcttgaaatctgtgatgtggaagacccttccaatgcagctaaccctcccttatgtagcgtcctgctcaaagatgccaggccttacttcaccacagtatttcagaatagtgtgtacagagtattgagggttaactgagaaggaaactacccattacactatggcacaatgtggtgtgtcaaaaacaatcaccctttggcttatttacattaataaaaatcacaagctttaataacagacacttaaaaataagataaaaatggattgaaagtttctctgattactaaaaggtaaattacttttctgttcattgaatgtcagccttattaagcttgtcatataagttattaaatcattcatgtcatactgcataaacaaatgttcatttcagaattttaaagaaaaatgtatataaaagaacaatgaattttaataaaaaa

SEQ ID NO: 397609 - DNA, 675 bp, Homo sapiens
gagcgagactctgtgggcgtaggaccctccgagccaggtgcgggatataatctcgtggtgcaccgttttttaagccggtccgaaaagcgcaatattcgggtgggagtgacccgattttccagatgctgtcttcgcaggtgccatgcctacaatggcaagcgtcaagctgtctacacttcatcccattgtgaatcatccactttacgaagatgcagacttgaggcctggttgcagtatgcttgaaatctgtgatgtggaagacccttccaatgcagctaaccctcccttatgtagcgtcctgctcaaagatgccaggccttacttcaccacagtatttcagaatagtgtgtacagagtattgagggttaactgagaaggaaactacccattacactatggcacaatgtggtgtgtcaaaaacaatcaccctttggcttatttacattaataaaaatcacaagctttaataacagacacttaaaaataagataaaaatggattgaaagtttctctgattactaaaaggtaaattacttttctgttcattgaatgtcagccttattaagcttgtcatataagttattaaatcattcatgtcatactgcataaacaaatgttcatttcagaattttaaagaaaaatgtatataaaagaacaatgaattttaataaaaaa

SEQ ID NO: 397610 - DNA, 1606 bp, Homo sapiens
gattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggtttgttttctagaaagcaatttttaagaaatagaagaggctgtagaggaacaaggaaatatactcatcaaaacaatatttaattgtatactacttatgacttcacaatattttaaagaccctcgtgttgacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttcttattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatacacctgtgctcccgaatttgacttcatggaaaaagcgactccactgagatacacaaagacattattgcttccagttgttatggtgattacatgttttatctttaaaaagactgttcgtgatatttcgtgtgttttagctacaaacatttatctaagaaaacagctccttgaacacagtgagctggcttttcacacattgcagttgttagcgtttactgcccttgccattttaattatgaggctaaagatgtttttgacgctgcacatgtgtgttatggcttccttgatatgctctcgacagatgctgtcttcgcaggtgccatgcctacaatggcaagcgtcaagctgtctacacttcatcccattgtgaatcatccactttacgaagatgcagacttgaggcctggttgcagtatgcttgaaatctgtgatgtggaagacccttccaatgcagctaaccctcccttatgtagcgtcctgctcaaagatgccaggccttacttcaccacagtatttcagaatagtgtgtacagagtattgagggttaactgagaaggaaactacccattacactatggcacaatgtggtgtgtcaaaaacaatcaccctttggcttatttacattaataaaaatcacaagctttaataacagacacttaaaaataagataaaaatggattgaaagtttctctgattactaaaaggtaaattacttttctgttcattgaatgtcagccttattaagcttgtcatataagttattaaatcattcatgtcatactgcataaacaaatgttcatttcagaattttaaagaaaaatgtatataaaagaacaatgaattttaataaaaaa

SEQ ID NO: 397611 - DNA, 429 bp, Homo sapiens
ccggccaagtttcatacacacacacacacacacacacacacacacacacacacacactctttctctctctctctcatccctgcaagccagccaagtttcactccttcctttctgctttcttataaaccccccagtctttatttgtcctattgcggcttatttttcaccccaaggatacttctgatggtcatttagttttcaatgatgtgaagtcacttctcggaaggagaaaaggaaggcatcttatagtatgactgtcctgttcctgaggactcccttaaacattaaaaaatacttctttctttggcggagtgtttatataaatgaatcagagcattttaaatattgcagtattccttacaaaagtttcattgatttgattctattcacagactgttcgtgatatttcgtgtgttttagctacaaaca

SEQ ID NO: 397612 - DNA, 583 bp, Homo sapiens
tttgatgtttggaaattcaatgtacttatcttcttcttattcttcatctttgttaatgacgtgggtaagtgtttagttcataaagttgggtttttttaacctgccaaatagcatgttttcctgtctaaaacaggtataagagaataaataggccctttcctgattatcactcaacatgacaaaattcttcccaagcaaagctttttatctatcttatccttgaaaaatattatagtaggaagtttttctttttaagacagtgcccaagtaaatatttaaaaatgatcataaagtaataagacttactttaatcatatcccattttatgacaaaaatgacttcttttctcctaagtcacttgaggatgttaagtactcattgcagtgacactgccattgcccagaacatttttggaacttctctgagtttccttcacagactatggcacattctttagtatgtcttgcctttcaagagtgggtttgatctttggaaatgaccaaaattttctgaatattttgtgtgattgggctgggtaatacagatcttgctgaaacgatggtgtgacagtaaagtcataaga

SEQ ID NO: 397613 - DNA, 1403 bp, Homo sapiens
gtggacaccacctctccatgaaagtttttcctatcctttccttgtacttcagatgtatattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttcttattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatacacctgtgctcccgaatttgacttcatggaaaaagcgactccactgagatacacaaagacattattgcttccagttgttatggtgattacatgttttatctttaaaaagactgttcgtgatatttcgtgtgttttagctacaaacatttatctaagaaaacagctccttgaacacagtgagctggcttttcacacattgcagttgttagcgtttactgcccttgccattttaattatgaggctaaagatgtttttgacgctgcacatgtgtgttatggcttccttgatatgctctcgacagatgctgtcttcgcaggtgccatgcctacaatggcaagcgtcaagctgtctacacttcatcccattgtgaatcatccactttacgaagatgcagacttgaggcctggttgcagtatgcttgaaatctgtgatgtggaagacccttccaatgcagctaaccctcccttatgtagcgtcctgctcaaagatgccaggccttacttcaccacagtatttcagaatagtgtgtacagagtattgagggttaactgagaaggaaactacccattacactatggcacaatgtggtgtgtcaaaaacaatcaccctttggcttatttacattaataaaaatcacaagctttaataacagacacttaaaaataagataaaaatggattgaaagtttctctgattactaaaaggtaaattacttttctgttcattgaatgtcagccttattaagcttgtcatataagttattaaatcattcatgtcatactgcataaacaaatgttcatttcagaattttaaagaaaaatgtatataaaagaacaatgaattttaataaaaaa

SEQ ID NO: 397614 - DNA, 282 bp, Homo sapiens
ggagtcgatggaacagaggaggaatagttgcttaaactcctacctccattacttgtctagttgatgtgcatggcggacacctgtgcagaacagacggtggaatggcttggagaactgggcagcaacttgcagggtcctatgggcagctgctgcttcttccttgtggcaacaatcttctgggcaacctcctggaagtccctttccacgttcagcccatacatagcacacgtctcatagtacgtgcaccgcttcaggtcgttggagcacttccttaccctggca

SEQ ID NO: 397615 - DNA, 429 bp, Homo sapiens
cacaccagcctgggtgatagagcgagactctgtctcaaaaaaaaaaaaaaaagtaaatggatccaatgttactagcagcattattgattatagtcaaaaactaagaccaatccaaacattcatcagctgttgagaggataaagaaaatgtggcatattcatacaatagaatatcattcagcaataacatgtaatgaagtactgacacatgctacaacatggataaaccctgaggacattaagctagtgaagaagccagacataaagtcccacatattgtgtgattcatttatatgaaatatccagagtaggcaaatccatagagacagaaagtataatagattagtggttgccagggtctggaggcagagggaatgaggagtgactgttaataggtaggggtttcttttttgggtggggaaaatgttct

SEQ ID NO: 397616 - DNA, 280 bp, Homo sapiens
ttagttagttcatcagtatttttaaagcaacgtatcgtacatgccataagaatattcaaaaaggatggagttctagggatactaccagcctacctccaaaaagaccattttatttgctgtgatttaaaggtatggagaaatgtgtaaaacctcccttactacccaacaataaatactgtttatgaatatagctacaataggcaaaaaattaaaaatccctttattgagagaaatacatcctagggattacaatcacagattctggatccagacatggttt

SEQ ID NO: 397617 - DNA, 447 bp, Homo sapiens
ctaacatacctgctctcatcactaaaaatatctgtctttagatgtcctttctgcatctaggtcttgcatctagatgcaacatgctcaatttgccaaatgcgtaggtagctgagaagtgccacattttaaagactgctctaaattcaagagacacatagtcatggaactgctggaggtttgggctttcgacacactctgaaatactgcctctctcctcaccacccacacttcctgctgataatccaagtttttttttctttgcctttattacttccaagctctagttcttggctgagacaaactgcagtccccaaatgctgtgatttaatgagaggaaatttactcgacttaatgtacaaatttgccaggggaagtgattttgataaggataattacattcacatcttagtgtaaattatagcaaatatcttacactgtgagcagctg

SEQ ID NO: 397618 - DNA, 416 bp, Homo sapiens
caaatactatttaatcaaggggaactaacatttattgtgtttttatatgccaggcactttacataaattcttgcagtcttcacagcaactccatgaggatgaggtggtgttatgaaattaagcagccaggcacagtggctcacacctgtaatcccagcactttgggaagctaaggcgggcagatcacttgaggtcaggagtttgagaccagcctggccaatgtggggaaactccatctctactaaaaatacaaaaattagccaggcgtgatggcacacacctgtaatcccagctacctgggaggctgaggcaggagaatcacttgaacccaggaggtggaggttgcagtgagccaagaagatcatgccactgcactccagcctgggtgacagagcgagactctgactcaaaaaaaa

SEQ ID NO: 397619 - DNA, 411 bp, Homo sapiens
gttcattatactatcccttgttggttaaagaaaatcatccttttattctttgacctgattgaaccaaattcaatttgctatcatagttcatttgtgttaacaacacagtactaataacccacgtactgtgtatattcatgccgaactcttttaagaattactaaatgctgggaggctgaggagggcggatcacgaggtcaggagatcgagaccatcctgactaacacggtgaaaccccgtctccactaaaaaatacaaaaaattagccgagcgtggtggtgggcccctgtagtcccagctactcgggaggctgaggcagaagaatggcgtgaacccgggaggcggagcttgcagtgaaccaagatcacgccactgcactccagcctgggcaacagagcaaggctccgtctc

SEQ ID NO: 397620 - DNA, 172 bp, Homo sapiens
ggatggagacaaaaaagccttgcttacattttttgcctgttcccattgggcccccaaggagaggctgaccacagatccatctaggctgagcagaattaatttcctaattaagataaggagaagctgtgctcattcaaactccaggacaagctgccagccaggtttgctgttg

SEQ ID NO: 397621 - DNA, 711 bp, Homo sapiens
catgcggtaccaaccgtgaatgttgccaaatacagatttcattagctgtcagagcgattgcatcatcacgttattcagcctctagaaaactataccacatacttgtgaaagagtgggagttaaaagggcagacaatgtcttagtattataaaaataactttgaccccacaggtcccctaaaagggtctcagagattccccccagtggtcccttgatcttaccttgagaacctctgccatatactaaataaacttattactgtcttcagttagaagaaactctaagactaaaattgaagatctagaattgaatatttcaatggaattcttaggtttcaataacaatgcttattaagggttatctaaatgtattagatactttcagggatgcagagatgaaacaaatacaacttcttttctccaagagctttcttgttacgaaatgtggcatttacacatcgagttgaaatagagtgaaaaggggtgacatgtttgttgtcacagtaaacaaactacataccactagactcacctttgcaatttataaactaagttacataattctataaaatatttttgactattgatgattctcttgacatgtgattaactataaacaaaaatgacagcaatctttagagatcattgcattttgctttaggctagtatatttaataacttgctctgaaagatttgggcaaacagggtaggg

SEQ ID NO: 397622 - DNA, 326 bp, Homo sapiens
atatactcctctctctctctctctatacacacacacacacacacaaacacacacatactatatattatagtttataacctagaagagaaaattacacattaaacatttaggttcttaatcatacaaggtttgtagttctactagagctgtactcctcatctagcttccctggaggatttattagatttttttttctgtttatgaaaggtattgggaactgacacataacgtgtttgctctggtttctatagctgtctatttctatattatagctattagaatgctagcagatctttctgatttgttctaagctaaagattccactg

SEQ ID NO: 397623 - DNA, 321 bp, Homo sapiens
cagaaaacggtgatctcgggaatgttactggttacagtataagcaatggatttctatcaagattttagatattccacatatgtagtagtattatcaatgtagggtctcagcattttccatagtttggaacaagaccatattcttaatttgtctagtgggaaaaggaaagctgaagtccagagcagttagactgtgactgactttctatattattaacatagggtacagaaaatggaatgccatttttctggtctaaatcgtttgctccccatcacatatttggagcttttccatgtctataaatggccagttgacttagag

SEQ ID NO: 397624 - DNA, 482 bp, Homo sapiens
cagccaagaacagaaccaggactggatgcccatttcgtcattcaacaaatatttactgagcacctacaatccctcaaaaactgttctagagtctaaaccgatggggtcgtaaccatgcccccagcccactcccttgcaggaaagaccgtggctccaggtcccccacattactgattaaaaaaaaactccagtgctctggccatgggcgtgaaggcaaggacagagaccgggaggataatgaggccaaacagctttggcccaccgccaccgggactggcaaagaggccagacctcctaatgctcttccttggaggaaggagcagtgtttgatttggtcaagaggccaagactaaaagtaagaggataaacacgagctggctggacgcgaggctggctcagggcagtgctgtcgggctgaggattcagggagctggtgttgtccaagcttcacatttgcggaaactacaactcccagcgtgtcc

SEQ ID NO: 397625 - DNA, 174 bp, Homo sapiens
tattgccctgatacaaaaccaaagagagttcaaaactatagacaaatatttctcatgaatatagaaacaaaagtccttaacaaaatattagcaaatagaatttgttaatataaaaacatataaaaagaattaaacaccacaaccaagtgggttttatttcagagactttaatat

SEQ ID NO: 397626 - DNA, 495 bp, Homo sapiens
gagaagtctacatggtctttgaagaaacaaattacctatgaccccatgtatttgcatttgtgctcttcctaactatatagtagtctgaatttagtcccccaacgtagggggatgttttaatggacaagcacttaattcatttcaaggttttgaggatttatcttataagcacttactaagcagtggttatgtcccaaggccagggctgcaccctggagactcagggaggcacaatacttgatttcatggatctcataatctagtgctatggaaacattaaaatattaaaaccacagtggagaagagcagtggataggtcttagggaagaagacttgtatgaaaggtgatgcctgaaatcatacttagtcatctttacataggacgatttttatggaagaatgaaatcttcaggattgaatgatattttcattttagcaaactggccatctcttttctttgagcttataaacatggttgaatgtgtcaagtagcga

SEQ ID NO: 397627 - DNA, 303 bp, Homo sapiens
ttcaggggagttaaaaaaaaaaaaaaaaaaaagacttgaacaatgaggctccactggatggatttaggggaattacaggaagcaggacctgacggtgcaatgccacactccacctgtccagacttggacctcaccaagggaggtctgtggggacagggagaggccctctgcctccaccccctcctctactccccaaaccctgagtcaggctgaatgtagtaaacctggaacagaaaagttcagtttggcaataggtatctgaaggactccaggtgcttctcccttgattcaaaattttactta

SEQ ID NO: 397628 - DNA, 386 bp, Homo sapiens
gtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctgg

SEQ ID NO: 397629 - DNA, 279 bp, Homo sapiens
taaattccttcacagaaaaaatattctttaacctcttaatggctgtttccacaagggcagaaacaggttcacaatcctagactcacttgtgaaagatcaattcagcagctgaatgctaacacatgtcttcaatcagaatctgctctgtttaggtccctatgcccatgattccccaccacttctccatcttctcaaaggagcttcaattcaaaacccagtaattctctgctttctactgtaccacctcccaggggccactttcatgttcctcggaaataa

SEQ ID NO: 397630 - DNA, 299 bp, Homo sapiens
aactcctgtcacattacctaagtgtgccatcttttacctgctggtcccaatgatccaggcagtaagctaatttgagggccaccactagaaagatccttaggctattcattgcttggggcctctgtgcttctccagaaatcttagtgaaacctggcctgaacaccaattccgggttctggatgagttcaaaagcctccccaccccattacttccactactacgttctctctctttcttcagctcctcagctcctgagcctacatcttttttttctttccttttttttttttttttttttt

SEQ ID NO: 397631 - DNA, 149 bp, Homo sapiens
cactatggaaaacactttggtagtttttcagaaagttaaacgtaagaattatcatatgaatcagcaagtctacgcttagatatatacccaagagaatcaaaaatacacattcactgaccgggcgcggtggctcacgcctgtaatcccag

SEQ ID NO: 397632 - DNA, 225 bp, Homo sapiens
aagagagatggttgcggggtatgaacaagagagagatccactcaaggaaactggggtgggggaggtgtttacattcaccaagaacaggttttcctgggctacgtagcatgaattttcatcatgcctctctaccttctctactcaacttcaatcacttcactcatattagccaacaattacttgatgttgaaatcagtatgtgctgatagcattcaagtcagaagg

SEQ ID NO: 397633 - DNA, 411 bp, Homo sapiens
tagttaaaaatgcaaattctcagccccaccctagacctactgaatcagaaactgggggtatggctcagcgttatgtgttttcacaggccctccaggtgattctgatgcgtgtccaagttgtaaaactgttggcctagaagaccaggcagaggactgggaagcaggaggttcccaaatccactactgacctgcagtgtagttgctgagtcagcaggctgagagcttagttccaagatcacacctgtgttttaagcccagctctgccacctatagattgggtgacttggatgagctccttaacctaagtgtcagtttttgcccatgtaaaatgatgataaaaatacccacctcacaaggcatgtatgagaataaaaaggcacaaggcctgactctatgaaataattgagttcc

SEQ ID NO: 397634 - DNA, 264 bp, Homo sapiens
gcgggcacctgtagtcccagctacttcggaggctgaggcaggagaatggcgtgaacccaggaggtggagtttgcagtaagccaagatcacgccactgcactccagcctgggcaacagagtgagactccgtctcaaaataataataataatatccgttcgaattacactataacaagaaattccttctgtaccttccctatgcctatgataagtctgatatttctattcccattttaatgaagataggagctcaaggaaataacc

SEQ ID NO: 397635 - DNA, 544 bp, Homo sapiens
caacagaaatattcaaaccacatatgtaattttaagttttctagtaggcatattaacatagtaaacacaaattaattttaattattttaaaacctagaatatctaaaatatcttaacatgtaataaatataaaagaatcattgggccgggcatggtggctcacgcctgtaatcccagcactttgggaggccgaggcaagtgggtcacaaagtcaggagatcgagaccgtcttggccaacgtgatggcacatgcctgtaatcccagttacctgggaggctgaggcaggagaatcgcttgaaccagggagtcggaggttgcagtgagctgagatcatgccactgcactctagcctggtgacagagcgagactccgtccccccagaaaaaagaatcattaatgagtctgagcatggtggctcacgcctgtaatcccagcactttgggaggctgaggtgggcagatgacttgagattaggagttcgagaccagcctggccaacatggtgaagcccgtctctactgaaaatacaaaaattagctgggcg

SEQ ID NO: 397636 - DNA, 936 bp, Homo sapiens
attacactttggcagaaacatgaaggctaatacttgaatccaagcacccattccctctgggcttaccacactgaaggcaaaatgagtggggttggtttttctcctcaagaaatgttgttctgggacagtgagtcattggtttttgttcttgcaacccttcatcatctaacaggtttggttaactcaagaagttctaggaaatgttcaaacactgcagatatttatcaaggggcatttttaggagtagcagagtgtcaagaactcaaattgacatctagtggcaacacttctaaagattggggccccgtactatatacaatgctaaatttccaatgctgtgattggaaaagactatgagaaggcctctagtctcttcccactaccatcatctgcagcaggcccacaccacccaaatcaacacaggtatggaagaatcgccccctgccacaggagtgggcagtaagcgttagaacacagattgccgagttctggttctcagtccacccaagtctggtctgtttccctaactgtagaaggaaggtgttagaaatggaaaatccttaatatattctttgattttttcaaaacagaataattgatttttatcatctttcttagtatacctttcacgttctgcacaattattctagattcaaactgaagattgtggttcatgtcaagagtcagtttggtcactgaacactgtctcatccagctgtgggacactcatatgagcttggtcataggtggctcatcttcccccacttactgggtttccataatgccattctcttgggctgttagataaaatatttacaacccatccctccatcatcatcaaagcaatttatttgcacaaactccactgtcactaaatcacatgaatgcatccatctttcttattttcatctttttgaaaattagccagcatgaaaa

SEQ ID NO: 397637 - DNA, 524 bp, Homo sapiens
cagtgggcataatcctaatggcctgatccaacttttctccccctttgaacagcaccaggacaaatcgtaagagatttggggacaaacagacctggttgaaacctcaatatgtgaccctggagaagtatgccacctaacctcttcaagcccacaaaatgaggataagcccttccttttgtgtgtgctgtaaaaattgcatgaaatgtacccagtatatgagcaattgctcagcagtgtttggatatagggagtggatagctattattaattgcagattattttggaaggaaaaacacacagagaattatgtatctttcagtgcaaatgttagttctaaaaacaatcatattatttacaaagctgcagttatagaacacaattctgatttctgcctcacccccacggttaatactgtaaaacatttcctacgtttcatctgatagtgttattaaaaatagctgttatttttaatagctatactaaaacataaaaatgtttaggtcaggcgtggtggctcatgcata

SEQ ID NO: 397638 - DNA, 790 bp, Homo sapiens
gaccccctacctgagggagggatatcccaggaggtggtgctgggttgtagggtgagggatgcagggtcgggggcacctatagctggagagggcaggggccaaaaggcagccagccttgtgggccacgggcatcctcctccagggtctgcgtgacgtgacaaatgcgtgaggtgcccggcgcagaggagggcttcctcctcacccctctcactccctcccggcccctctcactacttcccaggtccaagcatcagtcatcacccagggctgggtgggctcagagaccagccacctttcacagcactggtcagctctgttattttgacaatagccattctaacaggtgtgaggccatgtctcactgtggcttcaatgagcatttccctgatgattcgagatggtgagcatgttttccacatacctgttggccatttgtgtgtctccctttgagaaatgtctacttggctcctttgcccgttttttaatcgagtcacctgttttctggctatggagctgggtttcttacgtattctggatgtgaacccttgtcagaggtatgcttcatgaatcttttctcctattctgtgggccatctcttcactccactgattgtttctctggctgtgcaagggtctcttggtttgacatcctgtttgtctatttttgcgtttgttgcatgtacttttgggatcatctgcaaaacagcattgctcaaactgatgcatagtttttcactatgttttcttttggtgtttttacagattcaggtcttacgtttgtctttaatcca

SEQ ID NO: 397639 - DNA, 435 bp, Homo sapiens
tgattaaacccttctagacttttgtctctgtgtaagaaacaaatcaggattcctcccagaccaagcggatacacagcttctcctatccaaggaagggattcatccgccccctgggaaagcaagaaagaccatcatgtgatcaatagaaattgtgcttcacttcacttatcagccttgtgtgtgttgctgagaagggttagagagatcgagaatctaagacaggaaagggcctcagaaggctttaacttgagactcactgctcaccatactggtgaggaaagtgagattcagagaggaaaagagacttgaaggggtgatgaggctggttgatggccaacttggggccagtttatgcctccaagggcccagtgttctttcttgggtccccacatcttaggaaatatatatatttttttcttttccttctttcttttc

SEQ ID NO: 397640 - DNA, 568 bp, Homo sapiens
tacacacacatgggcaatggagtagccactgcaaatctccagtgcgagctggtggggagaagtgtcatgagctgaatggccagtggtctcctgagtgaaaaaaataaatcttagagttttatttcggcctcatttagttattaaaatcattggtttctttgtcttggtttccccttaactatcacagcgttaaaactcacccttcagagtcaattcacatcaataagagactcaaaatcttcagttccttcatgttcatacacacacatgcacatgtgtacacacacacagatatacatccatgcatatggatgtatggatctcttggttcccccccacactcttggttgacacacacccacatacatacacatgggcacacacaagcatacacattcatacacaggcatagatatacatacatgcacatatgtccacacatgcacacttggcatgcatacacacacatgggccaatggcagtagccactgcaaatcttcagtgcatctttctggggggctgcagaggtattaattacacctctaacctgagcaatctacttctccag

SEQ ID NO: 397641 - DNA, 264 bp, Homo sapiens
tgaccaagtggcgctgctgggtcagtgtgcgtgtggcatggacaatggccaggtaacagtccatgctgcggcaggccagtagtagaataccaccgtagaagttgacttccttcaggagctagaccacctggcacagattgtgccaaaaatccagccattcatcttggaggcagccaagatgggcaatgtcagggaaaagaacaggtcggccaaggccagggtcagcaggtagacatcggtgacagtggctgactcagctgaata

SEQ ID NO: 397642 - DNA, 283 bp, Homo sapiens
gccatatgaaaatgggcaaatttaatgggttaacatattaattgtcttaacttaggtgccaggtgactaataactcctttttgtttttttttcttagcatttggtttctgtatttcctagacattttttgttgttgttgagagctaatatatattatttgagacattttagaattaagtagaatataaattcatagggaaaaattagcttaaatgtaaagtacttaattttccgcctagtaaatgacaacatcaatacaagtttgacagtaacattttagtaa

SEQ ID NO: 397643 - DNA, 297 bp, Homo sapiens
ggaaacagctggagcaaaggctatgaggtggggccatgagcttggcatgttgaggtgacaggaaggccagtgtgtggagcagaatgcatgtggtcaatgatgcaatcagaggtagtcagtgctcgatagtataggccttataggccattgtaagtagttttgattatggtctaagtgcaatgggaagctattggagggttttaagagaagaggtgatatgaactaatttgcactttagacagttcactttggctactggttgaagaatggacatcagaggaataaaataggaagctg

SEQ ID NO: 397644 - DNA, 411 bp, Homo sapiens
gcagtgtaatgtcttgctaagagaaattagtattcagtctgctcaggttccagcaaggactttcttcatgaagatcttcaagtggaatcaagcagccttgcccatgaagtcatgcctgtggctccactgagaaattcgattaagtattccaatactgctgtgaaacgaagtgatctgattccggtgagacaatttatcttgcaagcatagcccatctggattctttacactaaggcaagaggcaagcagaagacaaagagagaaagcagaggacctccgggaaaggaagcccccttttcagtcggcctaggcagaagtagatttactctgaggattcactccaagggtgaagttttaagggtgcttcacttgctctggtttcataaataaattttgatcttcttaaataca

SEQ ID NO: 397645 - DNA, 329 bp, Homo sapiens
aattctatttctttatgaacaaatcatcaaaaagatcaattgtaagatgaaaaggctttgcctgtgccctatctttcgcaaaggcttttggtctatgtaaagaagaaaatatgtgccttggtgacagtaaagaattatcttaaagctgtattgagaatgaacatcacttgttactttataaagtttgggctgaaatgtcttgtcctccattcctggaggcctagctaagaaacttatatctaatggcaagaagaatgttccagaatacaggatgcttgaattcttgatccagcttaatttctttcttttttttaggaaaaaaacaagac

SEQ ID NO: 397646 - DNA, 349 bp, Homo sapiens
gaggctgaggcaggaggatctcgtgagcccaggaggtcaaggctgcagtgaatcgtgattgtgactgagccactgcactccggcctgggtgacagtgagatcttgtctcaaaccaaataaataaacaagtaaaattatggcttaaattattttttcctatttttaaaatgtatgtgcaaatgcaataaactaagtaagaaagaggatacaaataaatagtagaaacatctacgaataagctatggttgccagactcaaatatcacaacttaaataaaactgagctttcttgtatgtatttcttaggattgaacacggtagacaggggttagagccagcctagtgagtag

SEQ ID NO: 397647 - DNA, 476 bp, Homo sapiens
taccaatactacttgaactcctcaaacaaaattgaagaggagagaatatttccaaacttagtctacaaggtgagcattattctcatatcaaaaaccagacaagagcacaacaacaacaacaaaactacacgccaatatcactgatgaacatacctgcaaaaattctcaccaaaatattagcaaaccaaattcaacacattaagaaaatcattcatcacaatcaagtgaaattcatcgtagaaatacaaggatggttcaacatatgcaaatcaataaatgtgacgtaccaaattaacagaaccaagaataaaaaccgtatgagatttccacagatgctgaaacaccatttgataaaattcaatatccctttttgacaaaagtccccaacaaactgtgtatagaacgaatatacctcaaaataataaaggccatatatgacacacccacgtccaacatcatactgaacagggaaaaat

SEQ ID NO: 397648 - DNA, 373 bp, Homo sapiens
gcagtggctcatgcctgtaattccagcacttgctgaggctggtgggccacttaagcccagaccagcctgggcaacatggtgaaccccatctctactaaaaatacaaaaacttagccaggtgtggtggtgaacgcctgtagttccagctacttgggaggctgaggtgggagaataacttaagcctggaaggtgaaggctatggtaagctgtgattgcacaaccctgtctccaaaataaatagttgaagaaataatagttaatgtcaataataaaatatcttacacatcaaaaatacatggtattcctaaatactttttttttttttttttttttgagatggagtttttgctcttgttgcccaggctggagtgca

SEQ ID NO: 397649 - DNA, 283 bp, Homo sapiens
aacttccctttcccttgtttgtcaaaggaatccgccccaacggttgtccccttaagggaagtcccactggggggagggggcattggttgcattaatgccctcttaaccagctcagaagtcagaaacttcaaaagggaactcaaaccattgttagatgacccttattgggtagcagatcaaattgatcaatttttagggccacagttgtatacttgggctgaactaatgtccattttagatattcttttctcaggggaggaaaggactgtgatccacagggcca

SEQ ID NO: 397650 - DNA, 111 bp, Homo sapiens
agagaaagggaacctggaatagtcaaagcatatatggagggtgtgtggatgatcagaacacagggtgttgagcaggaatcctgtgggaaaggcctggatttggaaagtgga

SEQ ID NO: 397651 - DNA, 497 bp, Homo sapiens
cttataaagtgtcaaagtccaaattgatccaaatgataaaaggaactaattgggttgttgtgtgtactgttgtaaacagtctcacataatccttatagccgtcctttaagatatgtacaactgtatcccattttatagttgaggaaactagtttcagtatgttaacttgctaggatcaccccactagtaagtggttggagtttggattaaaagtcagctagcctcacgcctgtaattccagcactttgggaggccgagacaggtggatgacaaggtcaggagttcgagaccagcctggccaacacagtgaaaccccatttctactaaaaatacaaaaagtagctgggcatggtggtgcacacctgtagtcccagctactcgggaggctgaggcaggagaatcgcttgaacctgggaggtggaggttgtggtgagctgagattgtgccactgcactccagcctgggcaacagatcgagactccatctcaaaaaaaaaa

SEQ ID NO: 397652 - DNA, 123 bp, Homo sapiens
gggtaacagtgaaaataaaaatagggttgttgtatgtattaaatcagataatttactatgaagcacgtaacagcattggtaaacattaagtgcctactaacataattcagaagagtgattcat

SEQ ID NO: 397653 - DNA, 469 bp, Homo sapiens
aagacctgtaccgacagtgtgcacatgctgaagggataggactggttgacgaacacagggtaaaattataagagtgacacaagtttactgaggtggcagagagaacctggggtataaggtctgccttcgactgatcctttgctgaatgaagaggttaaaaatgactgcacataaatttgtcgattgtgggatagactattcaacagactgaattcaatgctactaaattcatgctaggcttctatttttttctgctagggaaaaggaaagggcagaatggacaggttgggtagatgtctcaaacagaatctgaaagaacagttgaggggagtagcagaggagctgacgttcccatggaaggactgctggtggggctgaagactcagccagggtggcagaccacacacatagattggcatcaatctactcagctgcatgacttcctccaactgggcccacaacaacctgc

SEQ ID NO: 397654 - DNA, 406 bp, Homo sapiens
ttttctgttttgttaatcattaagcatttctaaaactcaatttagacttgagatatttgtaaagaaacagtatgacatctgatatcctgtatctgagacagacgctattttatgaattttagcatgtgtctttacattgtgttgagaagtgtatatttatatgtgttgatatccaaataagttatttaccagtactcagactaatctttaatatccacctggttattggtttggttaagattttggtaatcacaattgaggcttaattggaacagtttttttcatggagtgccacttgagtaaagatcaccaaaaatcaagtcctttgatttttaagattttccataccagtggaaaagatagtaattagaaggctttttactgatagactgggttatcagcaaga

SEQ ID NO: 397655 - DNA, 570 bp, Homo sapiens
  misc_feature (513)..(513): n is a, c, g, or t
  misc_feature (522)..(522): n is a, c, g, or t
  misc_feature (530)..(530): n is a, c, g, or t
aaaaagccataatacaagactctaaagatctggaatgaaacctaataagagactggtaggtcaaatgagagcaaagcatttgaatttgactggattgttttctcactggaaatagtgattctatgagttcatcattaacacattttttgactggaaaactgctataggatcccagggaggactaaatttgaacagaggaagtggacagtgttgcagtctctgttctagctcttggttctagaataggagagttaagagcaccaatttgggatgaagaaagcagaaagcaattatcgatatcaatcaagagagcagaacagcctctctccctccatcctccctctgccctcttctcccttcctccttctctgctttcctttcactctgtgtatgttagctttggccccattccataagccgagataaaaatgctaggcatgataaatttgtgactgttactaacatttaggattttttttttgagatggagtttcactcatgttgcagtgagcngagattgtnccattgcnctccacctgggcaacaaaccgagagtttgcttcaccaaac

SEQ ID NO: 397656 - DNA, 484 bp, Homo sapiens
ctgaaatgtatctgtaagtacaacatagtttttatcaaaatctgaagactttttgtagctgtagacaagcttattctaaattttatatggaaaaaaaaatttgaaaaagagcaacagaatcactctagtgagtgttaagacttactatatagctatagtaattggagagatagacatacagaacaataaaacagaataataaaacaataaaacagaatagagaagcataaaatgcataaaagcaactcaatggaagaaggatagtcttttcagcaaccattgctctatcaattgaacatccataggcaaaaaaaaaaaaaaaatctctacctaaattgcacacttatattaaagttaacccaaaatagatcatggaattaaatataaaattttaaactataaaactttagaagaaaatatacacaaaatgctttgggacctaagcaaagagtaggcaatgtgttcttatatgtgacaccaagag

SEQ ID NO: 397657 - DNA, 309 bp, Homo sapiens
gaggcagactctagaggatctcccacagtgcctggggctttccaaaggcacctcgcatgcctatttgagcctgtcagccccagcacaggacaacgtcttgttgatgcggatgacgtggaaggagtggagccacacccggatatggaagccatctttgccacagctttttaccatgtacttattggcacaaattcgggcagcctccagggcttcagaggacagctgctcaaattcatctgacaccatgtggccataaagcggaaactcatccacttttaccttcttccgccccaggtcaaaaatgcgaat

SEQ ID NO: 397658 - DNA, 173 bp, Homo sapiens
ggcatagtctatcatgttggactaggaaatgatcccagagttaatagaaaacagtctcaacagtatctatggctaggttgcataccacccagaagccaggaagactaaatgtgggataaagctcttactgtttcaatcccattaattatgttgctttatgaatgtttttcttg

SEQ ID NO: 397659 - DNA, 563 bp, Homo sapiens
ttttattgttgttcgtatgttttggaaatttccttgaggttcaagtaattttgggagatcatctggatctttcctttaactgcattttttagtttattgtcaaagcctgtagtttgtaccataaaaataatataatacaaggaagaaaaatgagttatttcactgagtggtttgggtatgtttgggtttaaaataatgtttacttgcagccgggcgtggtggctcacgcctgtaactccagcactctgggaggccgaggtgggtggatcactggatcacttgaggccaggagttcaagaccagcctggccaatgtggtgaaaccccatctctactaaaaataaaaaaattagctgggtatgctggcaggtgcctgtaatcccagctactcaggaggctgaggtgggaggatcacttgaacctgtgaggtggaggctgcagtgagtcgagattgtgccactgcactccagcctaggtgacagaatgagactctgcctcaagaaaaagaaaaaaaataatgtttacttgggattgaagcctagttataataagcaaaacaaaaaa

SEQ ID NO: 397660 - DNA, 433 bp, Homo sapiens
atgtatgcccaggaattttcaaagaaaatttcggggagactgtcattttgctgattgcataaaatgatgttagtgtacttcctattgtatcctgctttgtttaactgggcatcgggagtgtttcatgatttaggagtaatctttttttcctgtcaatacagggtctcgctttgtcacccaggctagagtgcagtggtgctaacatggcttactgcagcctcaatctcccaggcttatctgatcctcccacgtcactactcaggaggctgaggtgggaggatcacttgaacctgtgaggtggaggctgcagtgagtcgagattgtgccactgcactccagcctaggtgacagaatgagactctgcctcaagaaaaagaaaaaaaataatgtttacttgggattgaagcctagttataataagcaaaacaaaaaa

SEQ ID NO: 397661 - DNA, 861 bp, Homo sapiens
ttggtatcagctcgttgtcttgtgaactgcttttcacactcctctaaaacttggttccttgtgctctcactgatctttatcacttttaataaaagctacaataggactaagaataaataagcataaagcatttggctggaagcaacacacacttcaggaaatgaaaaccaattaagtatctggcaagacccttcccacagaagctgtagatgggtcagctcatccacagagccgtgcccacaattcaaaaactcagatcccaatgatgaataatttggttttcatggtttcaacaatatttgctaacccaagtccaaatgtcagcaattagatttttttgttcaaaaaatttttaagagactggagtctcactatgctgcccaggcttatcacaaactccttggctcaagttatactccagcctctgcttccccagtaatcgggattacaagtgcactgctgtgcctggcaagcaattagatttcaagagtcctccactgaaggagtggtgccttctctattctccaggtgagagaaacagactaaaggcaaaagaggatgatacaggagagaggacaataaaaggcagaaggggcgatttaccccaatctcagatgtcaggaccagtttgatggaacatggcaagggcagcattcttccaacatattctaggagccaggcactttacattccttccaatcctctcaaagacccatatggtaggtaggttattctcctttctcaatgaggaaaccaactattagagacattaatttagtactcttctaaggaaacagagccactaagaacaaggacttgggattgaccccaggtctgtctgtcctcctacaatacaatatc

SEQ ID NO: 397662 - DNA, 315 bp, Homo sapiens
tatttatatcctatacttatgtaacacaaacatgtacagacagtcccaactttacataaatgtacactgaagaatttcaatccaataggattcataaattcaggaattaactatttgcactgcctaataattccttcagaaaaaattttaatctgggcaatgagtgcatttttgatttatcagttctgaggaagagacatgactctaatgggttaaatgggttaagtcattacccctcacataaactgggcaatgacactggtggaactgctttcctacactcaagctctattccgagtgactcagcaacccctt

SEQ ID NO: 397663 - DNA, 355 bp, Homo sapiens
aacatatttaacaaaaagtgcaaaacttacactctgaaaactacaaaacattgcagaaagtaattaaagaagacctaaataaatggaaaaacatgccatgttcatggatcagaagagttaatgctgttaagatgacaatattcctcaaacttgtctgcagattcagcataatccctgtcagaatctctgctgacatctttgcagaaattgacaagctgatgctaagagttatatgaaatttcaagggacccagaatagccaaagaaatcctgaaaaagaataaagtagaaaaacccacatttcttcattttgaattacaaaacaatagtaattaagaagtgtgttactggcacaa

SEQ ID NO: 397664 - DNA, 531 bp, Homo sapiens
ttaatgtagtacagtacgtctttttaaaaacttcatggtttaaaatttttgtgttccttttaaagatacttctatagtaacaatttaggctgggtgcggtggctcatgcctgtaatcccagcactttgagaggccgagctgtctgaacccattcaaacccattcttcctctcttgagatggaaggagaacaataagaatgaaaataaaaatgacaatgaacataatattaatgatgagagtggttaggtcgtgcacggtggctcacatctgatatcccagcactttgggaggccaaggcaggtggatcactttaggtcaggagtttgagaccagcctggccaacgcagtgaaaccccgtctctactaaaaatacaaaattagccaggcgtggtagcctgcgcgtgtagtctcagctactcaagaggctgaggcgcgagaatcacttgtacccaggaagcggaggtttcagtgagctgatattgtgccactgcaatgcagcccgggcaacaccagcagaactccgtcttaaa

SEQ ID NO: 397665 - DNA, 172 bp, Homo sapiens
ccaaaaatcagggcatgagctgtcagagaggagtaaatcagagctgcagctgggaggccttctggggaacgcaggacttagcatgggtctcaaaggcaacagcctttgtacggtttatcgtttactctcagccagcaggcagaaggggtgagaggtggtttctacttgcatc

SEQ ID NO: 397666 - DNA, 277 bp, Homo sapiens
accccagggtgctacctgcatgctaccatccagtcccagtgacgacactggtgccaacggtcccagggccgtccctgtatcctggaagctggctcacaggggagctggttgggtgttgatgggggttccccagtcacagggtgtcgtggtttagacatggccaagaccagactggctttgatcccattcaacaccgtgcagcatcctcgtaagacgcccgtggactggagtgggttgaaaatggtaaatggagtggtctaggagaatcactgtgctg

SEQ ID NO: 397667 - DNA, 572 bp, Homo sapiens
gcctccaaagtgctgggattacaggtgtgagccacctcacccggcctcaaatgtgaagtatttcaaatcgaacttgttcacagtcaaggcaagcatggcatgcttgctttggccagcacatgtactaaaaattcgaacaacacagagacgattaccatagcccctgtgcaatgatgacatgcaaatttgtgaagcattccatactttaaaaaaaacacacacagattgggacctgctctgcaaggcatcagatgccttccagtcagtaagagacaagagatacacagggtgctcccattcccacagcaagcaccaccctgcaccactagtattagcaccacccacatggaagggtgccagacacatacctactagctgcctgccacgcatggaaaattctttaggcaataccctccgcacccagaaggctaccagacctgttaagccttttcaaccagtttttgcaagcaagagaaatgcaattcttaagagcgggaacacccctttattacatgtaaagatacacaagctggatgaattgaataggggtgaacagtgatgacccatgacca

SEQ ID NO: 397668 - DNA, 400 bp, Homo sapiens
ttttactaacacacaaaataacaagttctagttgtgggacctaatgacttctatagttttgaaatggtgatgggcataaatgatatttcacaattggcaacaactgtgaagtgatataaaaatacaggtatttctgttggagacaaggtcatagatactgccaatatctggtgggtggtccatacattcataattgaaggaaaatgctaaattgtagaggctaatgcaaagtaaaatgtaattattttcctgtcccagtccccaaaacaagagcttgtggatctcagattaagatcccctgggttagaagaacttggctagaatattaacatagccttttactggctgtaccaccttaggcaagttaacctcaaaaagtctatttcctcatttataaaag

SEQ ID NO: 397669 - DNA, 414 bp, Homo sapiens
cggcacgagggtggtaatggcagaggcctagtggggagcctgaactcccattcttgcctagcagtatctaggaacaccaccctttccagatatcaacagatgccaagtagaggaactggacttctactttgatctagcagaaataaggcaatgtcccttctttttagttggagcattgtcacaggaggcctgctaaaacataagatccagagtcttacaatgctaggtctcaatttttaaaaaaggcattgtaatccaaagaatcaggaagatttgagaaaagacaagagaagccaacactgaaatggaacggctgttacaattatctggcaaagactttaaagcagtcatataaatgcttcagcaagcaattatgaacatgctggaaacgaatgaagaaaagttgtctcagga

SEQ ID NO: 397670 - DNA, 492 bp, Homo sapiens
cggcacgagggtggtaatggcagaggcctagtggggagcctgaactcccattcttgcctagcagtatctaggaacaccaccctttccagatatcaacagatgccaagtagaggaactggacttctactttgatctagcagaaataaggcaatgtcccttctttttagttggagcattgtcacaggaggcctgctaaaacataagatccagagtcttacaatgctaggtctcaatttttaaaaaaggcattgtaatccaaagaatcaggaagatttgagaaaagacaagagaagccaacactgaaatggaacggctgttacaattatctggcaaagactttaaagcagtcatataaatgcttcagcaagcaattatgaacatgctggaaacgaatgaagaaaagttgtctcaggaaaaaataagagatgtaaagaagaaccaaatggacattttggaactaaaaaataaagtaactggtccacacaaaaatca

SEQ ID NO: 397671 - DNA, 274 bp, Homo sapiens
tcaaattttgtagcttatctccaagacggtctctatcaatttcttcccttgtatgcaggaagctattttctgattaagaagtgggtccattcctcttaatgatctgcttaaccaaaagcatgtgggagaagcaattttctgggattttgaagttacatcctaagaagtctttaagtttcgcctgagtttcttgaatatttgctttggaggtggccagctgccatgctgtgagactgccatgttgaaggatgcctaaactaatcacatgaagagg

SEQ ID NO: 397672 - DNA, 451 bp, Homo sapiens
tataaatagcagagcaagcaattcctctgtcatcctgcaaaacaatgagcctcttccttcatgttgcttgaaggataaatagagtccccttcactcccccaccacacacacagggaagtaacttgagagccgtgtccaacagcagaggaggaactgggagtgtgctggtgggggctgattcttcagctctggtcccctggagtctgactgggaggcctgctgtgcctagcccagcgaagtcccacccaggcaagctcctggacaagcctgcagtgtggacttccaggagggggtatagggacctgccagctcctgggccccaggcttctctgacaagggagaggcagagaaacatcattatccatggatttcaaaaacatccctcagagagcttgaggctacaatgagctgtgattgtgccactgcactccagcctgggtgaccctctctc

SEQ ID NO: 397673 - DNA, 280 bp, Homo sapiens
cctgtacgtggaggtgtggcccagagctcaacacagggcctttgttctttgtcctcactttctttgttattgtatcctgtctcatgactttaaatactatttttgtgctgaggactgtcagatttgcatctctcgcctgttcttctctggactctaggttcgtgtatacagttgcctacttgacatcttcccattttgatattgaatattctcagacaatgtctccaggacaagatttcccccactttccaaacttgttctacatgtaatctgccttctc

SEQ ID NO: 397674 - DNA, 586 bp, Homo sapiens
ggttgcagtgagctgagactgtgccactgcactccagcctgggtgacaaagagagagagtctcaaaaacaaaacaaaacaaaacaaaaaaaacaaaaacgagagagactggccaagaaacagagtaatgaggcaaaagaggtggtgatgaagaaccttatatatgtcattcagaataagctttgatcaatattgcctgacttcaaataatactaccaggctattgtaaccaaaacagcatggtactggtataaaaacagacacatcaatcaatggaacagaatagagaacccagaaataaagctgcatacctacaaccaaaatgatcttcaacaaagtcaacaaaaacatacaccggggaaaggacaccctattcaacaaatggtgctgggaaattggatagccatatttagaagaacgaaactagacccagacttctcatcaaacacaaaagtcaactcaaaacagattaaagcctaaatattaagacctgaaactacaaaaaaacctagaagaaaacctagaaaaactcttctggacactggcttaggcaatctaacaaagtgctattatccagaactttaaaa

SEQ ID NO: 397675 - DNA, 450 bp, Homo sapiens
ctgaaaatggcagaataaatgtttcacattctttttttctcagatatattcttagctcctcttacctatatctttgtaccttcaaatttaagatttgcaatatataaagactttagaaacaacggagagagacttctagtcatacatttaagcttcagtttcaactcttcgaaaaatcatctcttaggaagcatcttcaaagtgtgaaaatacttcaacagtgtagactttttatcatgcttttcttcaggttacattattatttttgttaggttatattattatagacagtaataatcatgcattattacaatagtgatcaatttctattttaaatctcttaacagttttcggtgagtatcaagacagatgggaaagaaatgggtgtagtcattcttcccttcttaattacatcatagtgatttctttactgtatttacaaaatattgt

SEQ ID NO: 397676 - DNA, 910 bp, Homo sapiens
cactgtttttactccacagattactctagcatgccagtgaaatccaaatcctggcagtaccgtgtatatatatatatatgtttttcatggtctatttaatttaaaatttacttttttttaattcaaaagctttctgatcaaaaagggataaagatctagaaccactttgaattaaagtggcaggacagtctggcagtaatatgcaggacttgttctctctagtccacaggcacgtcttaaacaaatatttctagatttaagaaacacccagtgttcattgcttgtaatttcttaggtttctgagattacttgaagaattttaaaaattaaatattctgttatagctaacactcctctaaactgtgtgtgtgtgtgtgtgtgtgggtgtgtgcgcacacgcacgcacgctgttggggagaaggagggaggtattttttaatgagacttctaaaaaaggagggaggtttttttaaatgagactttgttaaaagtatagaagcaatcataagagacaaacttttcccttctattaataaaaaattatacattttgattatataaaagttagtaatttatagagaagaaagttaaaattctccatgacctcacgaccaagagatagtctagggatactatcttgatatctgttagaggcatttaaccttttgagagtcacagatatctttgtgaatctaatgaaagttataggtctccctgactacctgacccatttacttctgaaggattcgccgatgccagctgatgaggccaactttccagtaccgccccgtgtatgtatcccctcgccaaggtgtgtgcgcacaccacatgtgtgtgcagaccctagagtacaaagattgttcttgatcgacttctattttttcggacgttttagtgtggccccgcgcgc

SEQ ID NO: 397677 - DNA, 283 bp, Homo sapiens
ttgacccagtttggaatctccaggctctcaggggtctaagaggggacttattatggttttaaaattattactctgtttctaaaaaaaaacagaccttggaaaaaaattgtaacattaactgagtatttattaagtattaggttatttacgtaagtcatcttttcaacactcaaagttagtgtattgtcatttgtattttttataaatgaggacattgtgaggttaagtaggttaagggagttacctaaggtagaattgtggaacgtggtggggagagagaaga

SEQ ID NO: 397678 - DNA, 524 bp, Homo sapiens
aggtggaccctggctgctggtggaatatttgacatgaccggtgcccacgcccctctcccattcctctttcttgaaatggagagcaggcaagatgggggcagtggtggaagatgctcctcctccatgcacccagcagccctggggagcggcagggtcgcaacccaagagatgaacccccagtggccccgtcacgagctcccaacggaagggatgtcctagtgcagaggcagccaccacgctcgccccctgtactgggaaggccgccacgctcgccccgcgatggggaaggccgccacgctcgccccctgtatggggaaggccgccacgctcgccccctgatggggaaggccgccacgctcgccccctgtagggggaaggccgccacgctcgccccctgtactgggaaggccgccacgctcgccccgcgatggggaaggccgccacgctcgccccctgtatggggaaggccgccacgctcgccccctgatggggaaggccgccccgaaaaaaagaagaaaaaaaaa

SEQ ID NO: 397679 - DNA, 347 bp, Homo sapiens
aaatggaatgggggatttcctacattcattgattggtatggtagcaggtgtacacactgctaccctttgggttttttggctcacttactctattaactagagttcagtgtggccattatgcagaggtcatcgaggaatgtcatagttttatgattcaggctgaactattgagggagaggggatgaagtgtgaagagtattttcagatactttgtttttttctcagttcctatatagattattgtaaattccacatgcagtataaattaatgagactttactgtagtcagagatgcttagaccagaaatcagtttgttcttataatactgtaaaaatttcctgactga

SEQ ID NO: 397680 - DNA, 128 bp, Homo sapiens
gttttatttcatatagccagttttccaccgaaaactattctaggggtaagatttcaaataataattgttatggctaagaagaatttaagttgaatgtactacttctttcttatgtaatctctaaaaat

SEQ ID NO: 397681 - DNA, 601 bp, Homo sapiens
ttgtggagcctcacatcctgaactttctgaatttacgctgcagattcgtatgcttcagcacttggctctggctccaacagctccagaaaacatgtcattaattttcaaagcattttgttttaaagtaattaacattacctactgaaacaaacaatgctaaaatctcagtggaagtacaagatacaagtttatttctgttcacacaaggtcctgtgaaagttgggcagctcttctccaacaggggaaacagtttgcactgtcatctcagagtcctccaattccagctgttaaagaaataccacagaagagggacagactggacatgtgacatagcacttatcagcctattttacagaggccagagctccgttacaggtctgaaccaactgcaaggacatccagacgtgtagaggagcacatgaatagcgtgaatattaatactttctgccccactgttactactgggcatttgttcctgggctaagctcttcatctttttaatgtttttttccccacctgaaaccagaacttatttgaagttccaaagtttcttctcttcagccccaattcagtggcatctatgatgtgtgtgtgtgtgtgt

SEQ ID NO: 397682 - DNA, 124 bp, Homo sapiens
tggatcacaggagcggtttcccccatgttgttctcatgatagtgagtgagttcttagagatctgatggttttctaagtggcagcttctcctgctctctctcttttcctgccacctggtgaagaa

SEQ ID NO: 397683 - DNA, 423 bp, Homo sapiens
cggactgctgggtgaccggctgggggttaatcagccccagtggcagtgaggctggggatagaccgggtggggtgatgggggtgcggggtgagcattaccctctacccctgttcccgctacacaagcacagcagccccctccttggtctggggctgcaacctgcgcccctcctgctctcattctctcctcacttgcttttctgctctcactgccacctgtcagggcagggaccaaacacccagttcttcccccttccagggactgtgggggccagcaggacagtgtgagagggaggccagcttggcctgggcctgaaggagtgagggggagttcgggaggacctggtgacagaagcctcaggcaatgatttttaaaaattgaggcaactcacaaaccataaaattttcaagtgttcagtgttga

SEQ ID NO: 397684 - DNA, 689 bp, Homo sapiens
ctaatgatctttttcactattcataaaccagcataatttggtcaagctctagtattcttctgctaaaaatagaacaaactcacactgaatttctttggtgtcctctgtaatgtgctcctttaccgtcattcattcacttcatttcttcattcaacacagttttaccggacacatattttgtgccggagatcttgctggacacaaggaatacagagatggtcagaacagagtcctatctttccaagagatctcatgcttctctgagctgaacttctttatcaggattcctaaccacagggtgaactctgctctattccacaaacaaaggtgcatttattggtatccctggtgtcacttccctgcctgtgatgtcagttctctctctggacccattccagatcacacccagcctaaaaggttacttggtgtacagtggaaagtgtgacagtccagggacaagctagaattgatgggtaaactacctccccactctgggcttcatttcttcactgtaaagcacaggttagtgggtgggctctggagtcagacagcctagggccaaatgactttgggcaagtcatttaacctctctgagctttaatttcctcatctataaaataaggattggccaggcattgtggcttacacctgtaatcctagcactttaggaggccgaggcgggcagatca

SEQ ID NO: 397685 - DNA, 280 bp, Homo sapiens
aaattaaatcttctgatccatgaacataggaagtgtttccatttattaggtctttatttctatgttgttttgcagttttgaatgtttgtcttgcacttcttttgttaactttatttataagtataatgtttctttttgatgcggttgtaaattgaattttttttaattcaatttttgattgttcattgctattgatagaaacacccttgatttttacatattgattttgtatcttttgtatcttgctgaactttttattagctctaatagttttttttgt

SEQ ID NO: 397686 - DNA, 397 bp, Homo sapiens
  misc_feature (132)..(132): n is a, c, g, or t
  misc_feature (138)..(138): n is a, c, g, or t
aatgaacctataatcccttaaaaaccctgcaattctacagccaggcatggtggagaacacctataatctcagctaccagggaggctaaggtaaaaggctcacttgaaggctgggcgtggcggctcacacctnataatncccagcactttgggaggccgaggcaggcggatcacgaggtcaggagattgagaccatcctggctaacatggtgaaaccccatctctactaaaaatacaaaaaattagcgagcatggtggtgggcgcctgtagtcccagctactcaggaagctgaggcaggagaatggcatgaacctgggagatggagcttgcagtgagctgagatggcgccactgcactccagcctgggcgacagagcaagactccatcaaaaaaaaaa

SEQ ID NO: 397687 - DNA, 155 bp, Homo sapiens
aggtctaagcttggcaagaaaatgagaaaggctgtggctggctggagctgtggggagtgtgtggagagcagtcggagagttgccagggcctgcttagccttggtaaggtcgtttatctctctattccagcagctgtgggaagctactgaaggttt

SEQ ID NO: 397688 - DNA, 320 bp, Homo sapiens
tggaaaacagggtataagcggtgagagattgtccaaggcacatgttggctagcaggagagctgtgacttgaactcaagtcatctaaaattcagcgtacctttcaaatgcctaggattttctcaggaatccttcctaaagaagtggattttcagtcacagaaatctatctcttgaagctccaaagccttttatttcggttttggatagacatttattggtttcttttcgaatagagatcttgctgaaatgtatcatatacatccctattttgtcttaaagcatacctgaaagataatttagtcaatgactcagagtcataa

SEQ ID NO: 397689 - DNA, 187 bp, Homo sapiens
tatagccagttggttggaagtacaggacacaacctgggacttctggcgtctgaagtgggagcagtcttacgggactgaacccttcacctgcaggacctgatgcttcctctgggtagatagtgtcagaactgagttgatacccaattggtgtctgctggaggatttatggggaacccccacccccaca

SEQ ID NO: 397690 - DNA, 168 bp, Homo sapiens
gattaactcctcttcctcttaaattgccactgaagtggccacagaactataaaaacaggtaaaataaaacaccgtctgcagcagaaaattatgaaaggataaccagaactttctgagaaatttctttgcagtgggataatacacagttaaaagaagtgtcaagcagtc

SEQ ID NO: 397691 - DNA, 270 bp, Homo sapiens
attcttttggtggactctgtatatctgatgtgtactttgtatactactgaaattatcaatattaaataaaaaccactccatctcttaccctgatttaaaaatctatagttcattttcattagtaggataaaattcacagttttccacatagcttagaagaatcaacacccttttcaatcttatctcttctttaccatgactctattgctttgtgggaatatctcctgatacctccttaagattataaacagtaattcctatattgaaaat

SEQ ID NO: 397692 - DNA, 804 bp, Homo sapiens
ctctgtaacctccccaacactgaaaccaccatcaccctgacttccgcagagcagctggttagacctcgaggcctctctatgatcctataatactccatttctctccttgagatcattcactgcaccttggaggtgtttctgtacttttgttacaaaataccatacctatgatgggaggatctcatagctgctgagtccatctaagggtgtaataacaagaagtccacagtgaaaagggacagtcattcacagagtgttgtttactcagaaggggcagggtctcacttgcagacaaaagagacagatgagacctgtccattgtccaaaggcaatacaaaccctgtgtatctctatgtcaacaaaaaagaactcctcaactactatacagtgacaaaaaactgacacatactactaccaaaaataaaattccagacgttaaccacttattctgaattctaagtaaaatccagctgtgatgtcactcttgaaacaaatagcacttaaaactgtggtctggaacatcacaatcctatggaatcaccggggctgagatttctctgctccttctggttccattcttctgcatggcctccatttttctgtaagaataaatgcgctgggcgtggtggctcatgcctgtaatttcaacactttgggaggccaagacgggcggatcactagaggtcaggagtttgagaccagcctggccaacatggtgaaactccatctctactaaaaataaaaaattagctgggtgtgatggcacacgcctgtagtcccagctactcgggaggctgaggcagg

SEQ ID NO: 397693 - DNA, 332 bp, Homo sapiens
ggcatccaatcccttcccacccgcatgatgacactttgccagaactggcagcaaaactatcaagaataagggaaagattctgttaacattgctactggaatatcgttttttataggttaagtgaacagaggaagtaaaaaaatgttttaccatgagttcatattaatatgtcctatacaaatttaacattacagagtgtttacatttattttatttgcatctcctttctctcctaatcaaaaccttggatcttaataatattagcattcattaaaatttttttgttttttaataagagacaaggtttcagtgttgctcaggctggtctcaaa

SEQ ID NO: 397694 - DNA, 812 bp, Homo sapiens
gctttctgaatttacatgtggtccccgccccatccttaaggattctgaataagaactactaactttgtccagccctccagttttacagataaagaggctggtactctttggaaggctctactccatcaagagttatggtagagaaaatttcttgtggtttttggttttctctgtttttcaaaactggaaatcaggctaggctgcaaagaggatgttcttcaaccttgttaacccatcttcctcccttctaacttgggcttaaagtttgacacccaaaacagaagcaggtggtaagcccacttcctttaatcagcatttcacttaatctaagaagccattggtttttaccaggagacatcactatttttattagcattaaaaggaaaaaaaatgatgccaataaaatgatgatatgatgctttcatatcacttacaatttttgttttatttattcagatagttttgttaggtttatttgaacctagatttttgtaatttaatcacttttgtttgtatacactcagatgtatatacatatggacataaatgtattttacacatacacatatatatgcattaagtatatacacacataaatataaaataaaatatataagtagaatacattaattgaggtatctttcacagatacctgtattttccacaggatatggcatggggctgtgttccactgatattgcgtgtgcaaggtttgatgctggtgatttcttgatcccaccaaaggtttcgggcaatgacaaatcactgggtccatagtgaatgtaagatgttatagattataggatgcagtt

SEQ ID NO: 397695 - DNA, 497 bp, Homo sapiens
gggcaagcagagtaaaggatgaattacctttgggtcagtctgagcacatgtgcaattctcatgtcaagtatggagtagactgtctaaatctgaagctcaggagagagatccagcatgtgaagtcaccagtggctacaaggccaaggagttagaagacactgcccaaggagagtacagattgaacagagagggatatcaacactggacttacatattttaaatgaagaaactccggaatattttgcctcaaaaactgtgacttctgtattccacggaccactacattaatttttctcttctattgcagctttttatagtcttcaacaacaaccagtccctacatttaagaaggttaataactgagacagccttcctggtggatccatcatttggcccagcttgtagaaagattcccaactagctctaattagttccatcttatttggaggcagaggtattcctcatcatacccatatcctcatataaattgtccaggt

SEQ ID NO: 397696 - DNA, 780 bp, Homo sapiens
  misc_feature (780)..(780): n is a, c, g, or t
aaggggattgaaattacttaccaacatcacaataatataggatgctatatttctctatatatttgctttacaacagagctttatagtattctatggcttttttggtactctcattttttaatctcaaaggactttctagcatttcttgaagaacaaacctagcggtcataaactccttcatagtggtcataataaagggtattcaattatggaaagaggaagttaaattgtccctatttgcagatgacatgatcgtatatctagaaaaccccttcgtctcagcccaaaatctccttaaactgataagcaacttcagcaatgtctcaggatacaaaatcaatgtacaaaaatcacaagcattcttgtacaccaacaacaggcaaacagagagccaaatcatgagtgaatttccattcacaattgcttcagagacaataaaatacctaggaatccaacttacaagggatgtgaaggacctcttcaaggagaactacaaatcactgctgaatgaaataaaagaggatacaaacaaatggaagaacattccatgctcatgggtaggaagaatcaatataatgaaaatggccatactgcccaaagtaattgatagattcaatgccatccccatcaagataccaatgactttcttcacagaattggaaaaaagactactttaaagttcatgtggaacaaaaaagggccacattgccaagtcgatcgtaagcaaaagaccaaagtggaggcattatgctactgattcaaaatatatacaaggtacgn

SEQ ID NO: 397697 - DNA, 420 bp, Homo sapiens
tgatacagggggcaaaataaatatggttttagaaaagtggcatggctgctgatctatcagtgcaaaaaggagcacacccacccactacatggccaaaaatgttgaaggcaagagactagatggcttgtgaataatatcaaatgaagttgtctttctgtaggaagtcttagacaatgtaatcttgggaggcgggtggatcacaaggtcaggagttcgagactagcctgactaatatggtgaaaccccatctctactcaaaatacaaaaatagccaggtgtggtggcatgcacctgtagtcccagctactcaggaggctgaggcaggagaatcacttgagcccaggaggcagaggttgcagtgagctgagctcgtgccactgcactccagcctgggcaacacagcgagattccgtctaaaaa

SEQ ID NO: 397698 - DNA, 426 bp, Homo sapiens
ggtgaaagttgcttcgtaattcgtgtataattggccacagctagcaaataacaggatgattgaatccaggcctgttttattccaaaaatcatattaccctagggtacagtgtgccccatcggagaacacaccaggaaaagaaatatgacctcctttattaacagtctttcatactgacctttaatgaaaacactgactttaccgaccattgggaaagtagctcataaaactaagttatctgtatgagtcaataataagcactaaaggggttaagcttcttgcactgaataaagcaggtggcatattttttagaatttctagtttaagtagcttgtacttccctgtactggggatcacacgctaaagaagctttttgtttttttgttttttttttgagatggcgtctcgctctatcgcccaggctgg

SEQ ID NO: 397699 - DNA, 584 bp, Homo sapiens
aaaatactataaagctaaatgtgattgtcaatgtatgctataggtatgagaataaggaaattactatttcttttttaaaaaaacttttataacttcattataacacactggtcccaacaagtataacaatttaaagtatttttaaaaaatgtaaacagatgcagatttagtgagaaaatgaacgttttttgatagactgttctccgtgagtcttttgcatttctgcatgttttgtgagcaaaggcaatgactgccttgttctggattatctttttgaggatatgtcaagaaacatacgcctgcaaaggtcttcctctgaagccaaaggaagatttgttttttccagtacaaaaaagataatgtctctttctgggggaaatgtcaggctggattattgcctattttaaaacactggggttccccaaacttgtagtttccctcctgtgatacaagctacttcatgtgcaggtgccacctgaactttttacatcatcttttgggaattgggattcaattagccatcaaaaaggctaatactcttgttaatgcaattgctatgagtaataaactgcccattgtctctg

SEQ ID NO: 397700 - DNA, 299 bp, Homo sapiens
caaataaatcagattggcattttaaaagttagccagatataagaagacacatcagatgtgttctgtaccatgacaattttatagtgttgaagaataattaagacatttactcaatgaaactgccagataacaaatgatatagagaataaattgctgcttcagggaaaaatcaccttccatttctcaaagcatcttccatttctaagaatactgaaagtttctcaaagggcccccatttctaagaacactaaatcacgtaacttaatacctatctgtattagtttcatgggactgctgta

SEQ ID NO: 397701 - DNA, 395 bp, Homo sapiens
ggtggggttcactaacctgtgttttaaacaagccctttagggaattctaataagtttgagaaccactgttgctagaggactgcttatggaaagagagatggatataggggatgagaacaatttaaagagaaatattattttgtgtttcttaatggcacttttatgggtcctatatgtaaataagtgtattatctgagcatctactgtgtataacgtttgtgctagccactgtggataaagtggcgaacaagtcaaatgtggcccctgccctcacaaaattcacatcctggccagtgagagaggctccaaacgttctattaagtttgggggtggggtggggatcagagaagaaggcttctttgagccttttggttttatgactgtttctgaaaagc

SEQ ID NO: 397702 - DNA, 402 bp, Homo sapiens
caagaaatttgtgaaataggaaggatatgattattagacccgttttcctgatgagaaaaccgaggcttggataaggtatatcggttaggctcacttggttaatgtgtggtgaaggtagcaatccaatcacatgaatcttgacctagtgctcttcccatggtgtctccttaggaaagctcagatgtcctggagaatgacctttaaagatggtgccacatgcgccaccaggctagagctccacaagagccacatgtctttcttcactgccacatccttaatacccagcacagcacttggcatgcagtaggtgcccaacagccttagttatggaatgaatggatcatctgtgccagactctctttctgacttggaaccctccatacctacatctttctgatttag

SEQ ID NO: 397703 - DNA, 451 bp, Homo sapiens
ttcagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggaggtatcattattggtgatgataatttatcttaattttttaaaatttatgtacaataaaattttatttttttttaatttta

SEQ ID NO: 397704 - DNA, 114 bp, Homo sapiens
tgctgggattacaggcgtgatttgttcttttttgtgttatttttatagctatcctagcgggtatgaagtagcatctcactgcggcttcagtttgcatctctaatgacggataac

SEQ ID NO: 397705 - DNA, 400 bp, Homo sapiens
ctcacttattcaaaacttttttttactaagactttgccatcgattcaacacttctgccttcaaccatagataattgtgccacactggtcctgctcccaggataaatgttgccatggccactttttttaatctgtggaagatacacctttttacatagaattggagaagcagacaagtttgggatatgtaggccgcttactgtatttggaaaaggtagctatgtttttctgagataaactttggagtaaaataaaagtatactccagatccctgttcattcagagtttataaacagggcctttatggtgctttccttttctaggttgtcaaaagtaatactacatttagcatattatcttttaagtatgtgcattaggaaacaattatgtgattctgcgtt

SEQ ID NO: 397706 - DNA, 389 bp, Homo sapiens
gggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttga

SEQ ID NO: 397707 - DNA, 314 bp, Homo sapiens
cacatggttagggagtgctggaggtgatggtgggagggttggtcaggaaggttttacatggtggaagtaaggttttgcatggtggcttgtaagcatagtcgttaaggaagtgaaagcttgagtcagaggacacccgagggaggagcattccaggtggagggaggagtaagagcaaaggcctgggggaggaacagcaaggtgcccagggatgggggaggagcaagctagggagaggagtgggagatgatgggcccagagactttgatgggaggacagtgagagggaggctgagtagaagcagacatgatctgacc

SEQ ID NO: 397708 - DNA, 267 bp, Homo sapiens
cttccaagatacatctgaggtgaatacgggaattaaatttaaaagacacaaacaagacaataagaacagcagagccttgctttattaataagagcaagtcttcagggaatggctataacacttcactaaaccttctctttccagcaggttttcttcatggtaacacaggcaccaggctttagggttagagacaaaggcaaactatagaatttcttctaaattttaaatgaaccactatgaactcactcctgctcagcacctaaacaa

SEQ ID NO: 397709 - DNA, 171 bp, Homo sapiens
aaaaggaggcaatcagtattggagggaccattagcagtttctgccacggtccattttggccacccagatatctgtatacacctgtcttgacctgcataaaacatctgctttccacaagggagataggcctgggggcctaatcagtcacttcctttagggcaaatctggtat

SEQ ID NO: 397710 - DNA, 277 bp, Homo sapiens
tgggagctgagaggaggaacaaaatccatgcagagtttgttggaggaatgccaaagtgatcatagagtttactaagattttgacttactcttgcactttaatcataatatatttgcagcatgggggattagaggcagtctttggagggaagaggttgcatagaaaataattccttatagctgcagagcaccttgactgaacaaaggtgttttggggctgggtgtggtggtggctcatgcctgtaatcccagcactttgggaggccgaggcgggcaga

SEQ ID NO: 397711 - DNA, 382 bp, Homo sapiens
atgaacgcatgaaacagtccggagtggggaagctgaagctcaggcatcaggatccgggagaagcatccagtccaggcggacggggtggaaggttcagagcaggggccccaagtcaggagtagggaggcagacggcaagacctccttccatgaaaggaggctgggaccaggggaccaggtagtgcaacgcggtgagggggctgtcagggcgactggccggaggagtcagaggcaggaggcaccaccaggttacagacaaggaccttctacaagagggaaacgtgtcatgggctctggagcccctgtccaggttcaaattgtgaccctgtgccagggacagcttctttgtgcctcagtttttcccataaaatgaggataataat

SEQ ID NO: 397712 - DNA, 442 bp, Homo sapiens
tgttctccagatgaatgaagtacccaagatagagcatctactttaatttaaagtaccccaaagaagacgctgaacccttggatagcaatggaatatccccccttattattcaaagaacagaaataagcaaaaacatgaaataaaacaaaaagacccaaaatatcaaagtagctactcaaaatgtcaaaactagcattttggtgtgaatccttctgggttttcctcctgttttggtgtatgaacttaataaggcagcatgaaaattgctccactaaagaatgcaacagtaggtttatattggacagttgcatagcttggatgtatcagagtttattttaccaataatttgtgaaaatggacttttgaatgtggttcccaagtcatgtcagtgtaggataggtgtttgtgacacaaataactttccttcattattgaatactaa

SEQ ID NO: 397713 - DNA, 417 bp, Homo sapiens
cagatcccatgctggctcactcacatacccctcactgctctgcgcctggctcgcccttggcaagcatgggatccaggctggtagcacaagccgagcgcagcctgccaggctgagtgggcagaatgagcctagcaggtgtgagcaaaactcaagcagaggtgctgccggccacagaggtttccagctggcgaagcaacacctgaaggatcctgtgacattttgggatgagtgagttctctgaattcactggtgatctggttgtttaaaagtgtgcaccacctcccaccgaccagtccatctcttgccatgtgacactgcttgctctccctttgccttccaccatgattataaactttctaaggtctcaccagtaaggcctgcagaactgtgagccaattaaacctctttttaaaatag

SEQ ID NO: 397714 - DNA, 362 bp, Homo sapiens
gttatactgtgttttgtaatgcgtactagggatgcatactgagtgatgtcatgtgtcagaggaaaaagggggcaaggactagaggaacaagaatgacagaacattcgtaactgttgaagctgggtttagggtaggaaccggtatgttacatattccctctagttgtacgtatatttttcacaacaaaggaggtgggcggggcttccggtgggcccaccagttgcattctccatgctacttcctggctggaagtgtctgctctggccagcacaggtgagagctctaaactgtaaattgtatctcaaaagtctttcttgacatgccatttaacaacattcatatcatgcctctgattactctga

SEQ ID NO: 397715 - DNA, 456 bp, Homo sapiens
caatcaggtccacctcttattttccattatgaccgaaatatcttggaagtaagctatgctcatgcccctagggaacctcaggctggctctggtgtgcaatggattgttctgcagagaattccatcttactccagagattcagtggaaaaaaccctagatgtgataaatgactctgggcctcagtaatacggaggatgctgggcctgcttcagtagcccagcagataggaaagaagcatgttctaatgagatagctatggcattctgaggctacgtcagagctaggcattcttgatttctttctcccctgtcattgtgcaactttctttgtctttctcatggtcctcattgataatataatataatataactatataataatatataataagaaggtaataatgctttcatgtgtaccattggctttctttgaaaatcacacatttgtaaattttga

SEQ ID NO: 397716 - DNA, 195 bp, Homo sapiens
attgagccattgcactccagcctgggagacaagagcgagacttcatctcaaaaaaaaaaaaaaaaaaagtaagctgctttttgatttcttaatcaaactaatagcagtgcatcgtttaagtagtacttcagggcttacagtgaaaaacagtcccatgtgcttcccttctccacctctgattcttaactttcctga

SEQ ID NO: 397717 - DNA, 160 bp, Homo sapiens
gtcacaccaaacttcccttgaattagctgattaactgctctcttctatatatttaacttaaaaacattaaaaaccattattttaatgatatagaacatgaaattagaggactattacattattcagcactcttcaaagacccatgaccaaaaaaaaaaaa

SEQ ID NO: 397718 - DNA, 404 bp, Homo sapiens
aagtgctacattatgtgatttttagtgtttcatcactaagccttagtaaagtggattgcataaaatgaaaatgcacagcctctgaaaatcgctctggaaatgatggtgatgcttccagaggggaaagtgatgacccagtgagttgccgatatgaacagctgacgggtgtgttgcagaaatcagctatcaaaatagtttccggtcgccttgccagctgcaggtgacatgtaaactcgaaataactaaccccggtggagtgtcactaattcctgcagattttcctgtctcccgctaagtgatttcacctcttacttttgtgcagttaaattttatttcacttttaaaaactgattttaatcgatttattttcatttaacatatcttctgctcgttgagatcagttt

SEQ ID NO: 397719 - DNA, 287 bp, Homo sapiens
aaaaagccccacgatgttagtcaagttaagagaacaatcaactgctttcaaaaaaggctgttcgtttgagtttacaattccctaatttagaagcctagaagtgcaatctcccagcgattttttcatctcataaattttttcatctcatgaaattttatgccaaaggaagaaaaatatgacatttgcaatgtaatgccacctttatgcagcggtgtttgaggggtaggtgaggtgctgaggaatgtgtgcgtgtgggtacgaggcgtgtgggtagagaggtgggatac

SEQ ID NO: 397720 - DNA, 343 bp, Homo sapiens
gttatagttctgacgtgaggtgtgactgatcttactctgtcgcgccaggctggtctccaactcctgacctcaggcgatctgctggcctcggcctcgcaaagtgttgggattacaggcgtgagcccggccattctgagactgtgttgcaggcattgtacatcttcgcctgatgcacagcaggtatctcctgccacaaggaaaacctcctgcagaaccacagtagggatgcaacacgctaccccctgtgttgaccttgatgctacactctcacccaccgcaccaaccttgatgctacactctcacccaccgcaccaaccttgatgctacactctcacccaccgca

SEQ ID NO: 397721 - DNA, 385 bp, Homo sapiens
ttcctttaaatagaacattggcacacagataccccacaatctggcttattgcaactgttctctgttggtgaagtggcacgtttgcaatccccataacagccatcttaaccatttcacagcatattattcaaatgtacatctctaggtggcaacaaggataggcacttgggctcagtagcaaggggtctgtggggaaaatcctaggacgagggataggaacctgcaaatggcaagacaaactagaggatactcaaccagaggcttagattgggcagctccattggctttctgactgcctacgaggaaaacctcactggaaactcttttgaggttcttgaggaatcctagaggcaaacggactcctctgccttttggaaaggatttg

SEQ ID NO: 397722 - DNA, 732 bp, Homo sapiens
agggtttctgctgcaaggtgaggaaacatccatggcttgtacagatgtgagtctttgatgaagcccccaggcaggcaccaaggtgatgggactcagggccttggcttttagatacatcccagtccctgactgacatctgaccatgagggctggatgggtgggaacaaggaggagtagatggcaaaagtacctgagcccacttcccagccacagggtgaccctggcactgtaaaaaccctttgtcagtcatgccagaaggttctagaactgcccacctcttccatttcagtcctgctgaaaccccttagcctatttccgactcctctgtccatgctctgagttcagctgggcagtgtgtgggctatcacccctttcatttagacctacctagctggcccccatctgcagagccttccttagcaccattaggccttctacttgtgtccatttgaagcaggaggggctggatttggaaaagtctttgaagtgagagcaccacgcttgtcttcgttagaaactcttaactgcagaaaaaagttccagatggcaagggagcccttaagtggagattaggttgcattagactccaaaaccagaaaggaaaaagggtgatgggagtggagacgtgattggattcaggcccagaacctgtgaccatgctctgagctcagacttggggagggaggggtgtggctcccaccccttccagttaagacctgcctagcagagccc

SEQ ID NO: 397723 - DNA, 507 bp, Homo sapiens
gcaaggatatctgcccctagcgttgccctagagatcctagacagcacaataagacaaggaaaagttttaaaaaagaaaccaacacacaggttagaaatgaagaaataattatagtctttatttacaaatgaccttatggtctgcatagaaaaagatcccaaagaatctccaaaaaagctactagaaatactatgtgagtttagcagagttagagaatgcatggtcaatatacaaaaacaaattgtatttctgttagtaatgaacaattggaaattgaaattcaaaaaagattttacagtaacatccaaaaatatgaaacacgtggggatacatcacacaaactatgtgcaagatttgtatgccgaaaactacaaagcatggttgagaaaaactgaaagaagacctgcataaacggagagatatatcttgctaagagattgaaagattctattgttgtatgtcagttctccaaattaatctgtagaattaatccagtctaatcaagat

SEQ ID NO: 397724 - DNA, 464 bp, Homo sapiens
gaaatatagattacgttgcttacttgggttcacctagcaagctattggtaggcggcttccttggtacaccaggcttcagagatggaagtgctcaatgtaatgactcgatacttcttttctaggagatcctaaaatgttagtgttagttgcagagatttttgtagttgttgatgtctgcccccaaagaaggatattagttgagttagaaatgagatggctaaggacttgattaattcatactatcacctaatatcacaggactcaaactctgacatgggtgtttaataaaatcaacagacctgtaagggttttccagttacagcttccccggtttttctcccatcatccctaatcaactgatggagtcatcatttctatataacacagcttcccaggggcttcactgaaagcactcaagctcatcaaatggccagggcagcctgtcatgacaaattagtgcatgg

SEQ ID NO: 397725 - DNA, 559 bp, Homo sapiens
ctccagaatttggtgtggtttctttttacatattctatctctttttttaaattttaattttatcattttcttaattttatttttgtatttatgtttttctttagttctttaacaatatttaagaaagctcttttaaagtctttgtcacataagtgcaatgtctgaactttcttgtggatgttttctgccagtttatttgttcctaggagtgggctatgccttcttgttttcttgtatgccctgttatctcgttgttgttgaacactgggaatttgaaaaaacctcatctgccaatctttgcagactggctctgttcaggagcagttcttaacagattaccagagcttgatcttagcgtaggaatgagatgaaaagctaagatcttctcaggtattttctgagtatgcatcttgcctgggcctgtgtgtggctttctcaattccccgtatacatgactgtgtttcattgtcttaatttcacaaccagtctcatctttggaactttagctggtctgtttttatgtattgacttgtaatctcttgccctagccttctacatg

SEQ ID NO: 397726 - DNA, 314 bp, Homo sapiens
tctacacatttcttaccctaccacctctcattcacttatgtcccagccacactgccttctttctcttccttgaacacccaagcctggcagggtgctgtggctcatgcctgtaatcctgatactttgggaggccacagcgggtagatcacttgaagccaggagttcgagaccagcctggccaacatggtaaaaccccatctctgctaaaaatacaaaaattagctgggcatggtggcacatgcctgtaatcccatctactcaggaggctgaaacagaagaaactcttgaacccgggaggtggaggttccagtgag

SEQ ID NO: 397727 - DNA, 433 bp, Homo sapiens
gctgtaattggatgggaacctgtgaaaacagaaggggaatgttgtggtgcatgtgcttcttccttgctagtctctcctgggtctcggttgagcaggatcattacccatgaaggctcaatgccaaagccactaactatctttcctctggttggctagtttgcccccaatggtgccctgctgagtttatacattcttagccccaatttcactcccaccatgcccttaattccctacgagtattcctgctcctggctccaggaaaaagggagaggtaggagggtggggtggaggtgaacatccacacagtccccaagtggactcagcccatgtttagcactgaggggccctggagagggctgggctaagcagaaggtcgaaaagaccctcaggaaggcagaggcctcctgaaccaattccatacagcatcctggat

SEQ ID NO: 397728 - DNA, 549 bp, Homo sapiens
ccaacatggtgaaaccctgtctctactaataatacaaaaattagttgggcgtggtggcaggcacctgtaaagcgagctacttgggaggctgagactggagaattgcttgaacccacaaggcagaggttgaagtgagccaggatcgcgacacttcaccccagtgtgggtgacagagcaagactctgtctaaaaaaaaaaaagaaaaatgaaatactggtattgacatatttagaacaattgcctacacagaaccatattcattcatttaaacaatacttatagagtgtctaatatatgtgaggcagcagtgattgtaatcagtgctttgaacaaaatacacaaaataaggtaatatttccctaatgagttggcttttgaacagagacatcaaggacgtggggaggaggcattgtgaccatcggggaaggatatgctaaacaggctgggcgtggtggctcacgcctgtaatcccagcactttggaaggctgatcacctgaggttagaggttcaagacaaacctagctaacatggtgaaaccctgtttttac

SEQ ID NO: 397729 - DNA, 455 bp, Homo sapiens
gggccatcttgaagaatggccaccacagcctattaagagtggaaagagcctcgaatgagaagtcaggggaccctggttccagttctggctctgtggaaaagtcatttactctctggtcttcagtttctccttaaaccagtgctgttcaatagaaatacaatgcaagccacattgtaatttgacattttctaggatccatgttaaaaaggtaaaagaaatgggtgatgttatttttattttattttatttttattttttttaagaaatgaggctttgctatgttgcccaagctggtctcagactcctgggctcaagggatccttctgcctcagcctcacaaagtgctggaattacaggtgtgagccaccatgcctggtctatgatgttaattttaatattttaattaacccaatatataaaaatatcaatataaagcaatataaatgttttcttga

SEQ ID NO: 397730 - DNA, 504 bp, Homo sapiens
agtctcagccccaaatcaatgattcaccagccattcgacctggcaacgtcatgaacaaaaccaaacctcaattttctcctccacaaacaactaaactaacggggccctgcccgggtggctgatgtgaaagtctcgtgtggaaatgctcgggcccccgtggcagacaatgtgggggtgagtgacccgcacagcacgggtcggggcagcctctgtcttgggcacatgcattctacccgcctcactcttaccaccatgcagtgggcactgccatcgctcctgcctcacaaacaggaggctgggcacagagaggttcagtaacactcacggggccacacagccagccccgcacaggcccatgtcaaagccaggcagcccagctcacccccaggcttcctgctcactaccctgatgacacccacggaggcccagaggcttctggggagcaccctcaccctccttggatatagctgcccgtggcactgtgtctgcccgtggtgctgagtc

SEQ ID NO: 397731 - DNA, 486 bp, Homo sapiens
tcttccaacccagggtcttcttttttcccttgactaatctggctgctggccctggagaagctccatcttctctatccagcagttgttgcttctatgggccaccctggcctcctcctaaaggaagggaatttaggactggaaagataggcataggagacaacatgttctaagtaagacacgtctgcctcctctgtgtgaacttgctaacatctattagatatatacctgctagtttcaaagcagaaacattttttcaagttgtcccttgaacaatgtagggattagggcttctgaccctgagcagttgataatctgcatataatttttgactccccaaaaacttaactacttaatagcctactcttgatcagaagacttacggacaacataagcagtcacttaacacacatttttgtgttatacatattatatactatattcttaaaaagtaagctagagaaaaatgttattaataaaattataaaa

SEQ ID NO: 397732 - DNA, 701 bp, Homo sapiens
cggacacacacaagggtgaggtctagagcagaactgtaataggtgaaagaaagaggatagctctctcctacagagaggggtcccaggaaaatgggttgccaatctctggtgaaatgcagggggtttttatagatgagctaatgggaagatggtgtctgatctacatagggcatgaaaatctggttaggaccaattgtgccatttgcacagggcatgaatctctggcagcccccaccccaatcttttattatgcaggtgggtagctactccatgttgcttatttctttcggactgtatacatggtaacaaaaaaagggaaggtggagccccatggtggacatgcctggccccaggtagcccttttctgtgggtgtagctataggcctcccccagtgcaagcttccagcttccttatcaatgcttgcagctcaatctttcaggcttctctttgttaaaaaaggaatgatttcttgggctgctttttgttagaagggaagttctgtcaaggactcttttgccctcactatctgcctaaataatttctttctatctcctgtatcaagagctctcacttgatttacacacacaccaaaaataagaattataggggagaaaaatcatatgaatgtcagatatgtgggaaagccttcagtcaattctctgactatggacaacctgggagaacctacattagaaatgta

SEQ ID NO: 397733 - DNA, 269 bp, Homo sapiens
ggctaagtcacgctgaaccgccatgttgaaaggccaacagccaagactgccatgtggagaagcagcccgggccacgtgggaagaccatgtgtaggtagctgctccagttgacagctgagcccaggcaccagacttatgagttgagaagcttccaggggattccagcccctcataattcaactcactcccagctgttggagggccttcccagcagaggcccagccatcacagagcagagacaagccatcccttctatatcctgtctgaat

SEQ ID NO: 397734 - DNA, 512 bp, Homo sapiens
gatggcactgcttgtcagttatcaaaataccaaaatatggatatacttgcaaagtaataattattcattcactattaaaatgtttacttaagcccaggcacttctgtaggccaggggtctgcaaacgttttccgtaaagggccagagagtaaatatttcggactttgcaggccacacgtggtctccgtggcatagtcttccttgttttgtgttttttacaacccttggaaaaagtaaagaccattcttagctagaggaccaacaaaatgagccagaggatttggccattgggccagcctttgccccagtcctgtgcacctggggcatctttccatttattttcttacatttgtgtattgctttagagttcctagaatgctctcacacatagtaccttatgtaccttgaagcaaccttgaaagtagctgcatttatcatctccatttccagatggagaactaagcctaagaaagacaaacgtgccgaatgaaggtcaggtggcaaattaatgg

SEQ ID NO: 397735 - DNA, 280 bp, Homo sapiens
atgtctagcagaagcaagtggaacccagttggcccccatccaatttgggaacaagacactaaaccctggaagcctggcagcttccaaaagccttcatatgtcccttccaatctgcctgcctacagagtctcactccattacaaacagcatattagattcaaggagacagctctgtatcccagctctgtgcctggtaggttttgtgatcgcaggtaagtcacttaaacattttagggcttagtatctttatttgaaaaggtggataattctgtcaaagtgt

SEQ ID NO: 397736 - DNA, 926 bp, Homo sapiens
tctctccagtcgaggattctaacctgctcagaagagccctgcttcccctctaggtccaggatacaacaagtgaccctgatgacctgcaagcttcctatacggctggtgctacacctttataagcttctagaggccagtctgaaatggacagatttgacctcagcctgaacagcttaggacctctcattcccagggttcccctgctctgaaagctccaaaggggtggggactgcttattcactgctgtagcccctggcttgaacatacctagcatttatatggtgtcccataaatagctgaatgagtgaacctgctgttttctttttgccctgactaggagagctgaagcccgtgagaagaacctaacaggctcatggtctggccctcatggacaccccggggaccaccaggtgaagtggagtcaaggcctgctctcaaccctgggcatgggtggagacatgagtcagcatgagtggcctgagggggagggtcagcagccctgtccgaggcaatgggaaaagcactgaattttaaggcaaatggcccaggttgagtcctggctcctccctctgccttcactagttttgtaatgttgaacaagtcaatacatgaatttcataatctataaaacagggacagtaatgcttgtttggtgatctagtgtcttcacaggacagccatgaggctcaaatgtgaaagctcatggcactagaaacgggaagatggcacgtctgtgtgtccagtgtacacacatgcacctccacacaccaacacacagactgctgtttagactgagcagagcagtggggggcagctgcgtgcatggaccaggccttcctcatctctgtatctgccaccacactgagctcaggcttagcacccactaggcgtcagcaagtgcttctcaaatgaatgaaccaatgaat

SEQ ID NO: 397737 - DNA, 697 bp, Homo sapiens
accaccaccacccctcccccgaggactaaatgagcagcagggagtgacaaacagtcaggtgcacctaagttccagccaagctctaccatcgacactctatgacttggggagagctgaagcccgtgagaagaacctaacaggctcatggtctggccctcatggacaccccggggaccaccaggtgaagtggagtcaaggcctgctctcaaccctgggcatgggtggagacatgagtcagcatgagtggcctgagggggagggtcagcagccctgtccgaggcaatgggaaaagcactgaattttaaggcaaatggcccaggttgagtcctggctcctccctctgccttcactagttttgtaatgttgaacaagtcaatacatgaatttcataatctataaaacagggacagtaatgcttgtttggtgatctagtgtcttcacaggacagccatgaggctcaaatgtgaaagctcatggcactagaaacgggaagatggcacgtctgtgtgtccagtgtacacacatgcacctccacacaccaacacacagactgctgtttagactgagcagagcagtggggggcagctgcgtgcatggaccaggccttcctcatctctgtatctgccaccacactgagctcaggcttagcacccactaggcgtcagcaagtgcttctcaaatgaatgaaccaatgaat

SEQ ID NO: 397738 - DNA, 905 bp, Homo sapiens
ctatgtaagataatttttaatgatgtctaaatgtttagattgttttaaattcagaaatcagggaaaaataataacaaataattttttagtcgttgtaacactttagtgatccccttcaaattgtcaaggaagaagaaagttaacattggtgttgagacaccaatgaagaaattaatggcttgaaaataaaattggaggaaattattaaacttatccttaaaactaagttgtatagtagcaacttaactgccacagtaacaatgtgactctcgtaggtgagagcttaggatcccttggaggacactagcaggtttataacctatgagtcatatcacgagaatcaccggtccagaaaataaaatctttgacattccttgaataaactctatcactttaatatggaggatccaggaactgtaaaattggaaatatgaaatcatcctggaatggcttctaagaagccttaaaatatgccattaagtatgaagtcttgactataatatctaaataataaaatatacagaccttggttttgaaaatgcaagtagagttaatattttgctgggctgtaaccatatttattattacttcacttgtaccaaacacatatacttaaagaagctgaatttgtgcaataaacattcagcaaatccagttatgacattgtgcccagatgttcctgaagggtcatttggggaagtagtgaattctgttggtttccacaaagtctcctttcctcctgttggagctttgtttaatctagtttatccttaccttatcctagtctatcctacctgaagaggcaggtaatcataaaaacaaatgagacttcactgatttgtcactgacttccttacaaagctgtatgaacagcagcagggtaaacagaattgatgcaattatct

SEQ ID NO: 397739 - DNA, 1398 bp, Homo sapiens
caggcaggagtgtgctgctgagacgctaaaggggtcacctccctatccgcacacagtgtatggggtgttaggcctgagcagatgaaaggaagaaagggatcctcaaggagaacccgttggcagtgagcgagccccacataccaaacttgaggccccaggctttagccaaccaatgacccagggtcagtctggtctcccaggggagggtgggccagggatcagcactgtggcttccagtggccccacagatgcccttagctgcagtcccagcatgcctatatatggcaaagccagggacatgcatgccagggcttccgtacagccccttgcttaactcttgggctttgtgagtcactcagacctaggcttaaatcccaagatggccatttactgctctgtgatattggacaagttattcagtctccctgagcaagttcccctccctctaaagtgggaagatgataccacctcccttggagggcaactgtgaagagccaatgaacgaacacttaacacagcacccggctcctcgtgaatactgtgtaatattatggtatttcttggcttctgcaggccacatgccattggctttctatctaagctgcttgctctctacagggcctaatggagtgcccagggcctgggaaggcattggtgagcttcactgggactagattctccaaagcctggagtatgaagggtgcatgggctgcgtccagctacctgtgagcccctgtaggccctcacagtctgaaatgcccatggaggtgcctacaggttctcttcttaaagttgtcaggagatggggacattgcaacttgaaggcaagcctggccctgggtttgcttatcttggtggatctttcttacatctgatctttttacattcggtccattcactttggctggccatcaccaaagacaaagacagtggccaccatctttctcatcagtaatccaataatgaggttgctctgctacttaccaagccaagcaagcccattcctttagcctttctgcgtaggatcttatttcccatggggacctggggtcaaaccctgcctctgctgttcactcatcatgggaacacaaacacacacttcccctttgtctgtgcaatggacaggttgggtgacgtggtctcagtgaggctgaccaccctcctctgaaggttaattccatgatggtgtttccctagcttcagtcatttgcttatcacctttgtgatctctgcagtgtctgcctttcataatatttacttatttttttctttaaatctactcattcttttatttgagtatgtagatctttaaaaggaaactttttatcgctgtcattagtggaaagccagtatcacttgtcataaatagaacaaaaccataaaagaacgtaacaggaa

SEQ ID NO: 397740 - DNA, 251 bp, Homo sapiens
cgcacagtgttcatggaagccaagagacagtagggaggcatttccggtccactcccaatctacgatcccccaccacgcaaatgcccctggatgcaacccccattctttgtacagcagctgggttggtaaaatagaaacttcaatatcctgccacctgggggaccactcattccccaaacatttagaggggactgttctgtataacgggttaaatgtcttctgggtgacagagcaaggccctgtctcaaaaa

SEQ ID NO: 397741 - DNA, 395 bp, Homo sapiens
gaaggcagaaccgtcttgagcatggaccatactggtgatgccagcagcttctccgcaccatctggctcagctgtaccacccagcactggggtcaccctgggcgtggcctgaaccccaggacacactcgtttgtggtgctggtgctgactgccatcctcacgtttgtctgctcagggccagagccaaggccctcaggttcttgagtaactgggctggtggctttgggagtttgtcacttgtggtgagcatttgctcttggcttctgaatatactgtggatcattgtctgggggcgttggtcaggccagggcactgctctttagtttttgaaactttccttccttttcatgtcttgaggtttggtgcttggttgatagcacagctcgtgagggtgga

SEQ ID NO: 397742 - DNA, 499 bp, Homo sapiens
aaggacattttttctgaagatatagctatggtgttgattgggtagggcactctggccttgattctagatgcatgcagtagtgtagtctctgtatgagttcttcagttgtaaacagtgtcagtggtgtctgtgatttccttagtggcttagagtgtggctgttaatggaggctgtggggaagttttgctggggacaggggcaacaggtgggccagtcctcaggctctagtggtggcagcagtgggccaagagcatgcctgttcttgggccccagagcagtttatgctggtcctggggttagtgattccaggcaggctgattcttgggcctccaggaggcttgctcaggtgctggaaggggcagtggtagtccagttggggaggggctcaggttcctaggcagcaggcatggcaggggcaatgacggcagcagcagccagatcatcctctagcttccatcctatccatgctggtgttggtggtggctgcaatggcctgggt

SEQ ID NO: 397743 - DNA, 798 bp, Homo sapiens
tttcctttgtcttggtggatgactttaatgcgccaccctcctaccctatctggtacctagtgagtggcctagatgttaatgaagagacatgagctatttttttttttaagtaacttttaaaaattgacaaaagttacatgtatgtattatctaaaacatgatttggaatacgtatacatttagaacataaggttttagaatatgatttatgagaatgcataaatcagtctaattgacatatgtattacctcaatacttttttttttttgtgataacatttaaagtttcccctcttagcaacttcaaagagatttaatcttattggcagccagttgaacggtatagatcaagcctatgactttctcacctggaaaatcagtcacaaaaaatgtttcagatgccttcaggaagagatacaagaagagtctcctttgctaaatgccaggaatatcaaatcttggacttcagagactggccatataaggaaagagatttttatagacaaagagggttgaagtaaaataatgggatagaataagcatattaagctggataagtgttatgtaatcctaggtcatctcttaatggccatgtccttgacattgttgcattaagaatgagagctcggagaaatagtccatgtgttggcatgctagtctctaagttagaatagatgtgatcacaaatcatgagtgctcttaaagggtggatcctgcattcactcatccacttctgccttcattcaggctcaagcaagtggtggtgactttggaaagataaggagagaaaaggaaggac

SEQ ID NO: 397744 - DNA, 328 bp, Homo sapiens
catccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagt

SEQ ID NO: 397745 - DNA, 544 bp, Homo sapiens
tacattctagcacttatcacttaatgacagggacacatatgaggaatgcattgttaggcaattttgtcattatgcaaacatcatcgagtgtacttacacaaacctatggtatagcctactacacatctaagttatatggtatagactgtttctccagctatatggtgtagactgtttctcctaggctacaaacctgcacagcatgttactgtattaaatgctgtaggcaattgtaacacaatggtatttttatacttaaacatatctaaacatagaaacggtacaaaaaactttacacattatatagatgtatcaaattattcatatgtgctctgaaaatgtctatatctgttatgtatcaattttttaaaaagtgaatgacataattcatttgaaaaaatgtggacacacaaattggaaaagaggtataaatgcagtattataatctaatgggaccaccatcacatatttggtctgtcattgactgaaactgcaatatagagtttttcttaacatttgcatattaaagactctgactatatat

SEQ ID NO: 397746 - DNA, 578 bp, Homo sapiens
  misc_feature (1)..(1): n is a, c, g, or t
ngagtcggtaccgattacgctcctaacgggatgatgatgattttgtgcatgtgattacatcacgtaagattgtagcctatcgtgttaggagaccctggctggctttgaagaagcaggctaccatattcccagatgtcataggaagagagccaccggacaaggagctgagtgtggcctctggccaataaccagcaagaaattgagccctcggtgtagtagtctgccaggaactgaattctgcaacgatgttgagtttgcaagcagatccttcagttgagcctcagatgagactgcaaccccaactatcaccttgattgcagccttgtgagaccttcaaagcagaagaccaagctaagtgatgctcaaactccagatccacagaaattgtgagataacaaatgtgtatagtcctaaaccactacgttagtgatgatattgttatggaacgatagagaactagtacaatgtcctttctagaagaagacctctaacaagagaatgaagagttcaataaaaatgtaaggcatccgaagaggaaaatgtggagataaaagagctcagaaaattaatggaagagc

SEQ ID NO: 397747 - DNA, 352 bp, Homo sapiens
tttctttctgtcgggttagtctgcctgtcagcaaaaggggaaaactcgttctgagatagataaagggtggccgggtgcagtggctcatgcctgtaatcccagcactttgggaggccaaggcaggtggatcacaaggtcaggagtttgagaccatcctggccaatatggtgaaaccccgtctctactaaaaatacaaaaattagccaggggtggtggcaggcacctgtagtcccagctactggctgaggcaggagaattgcttgaaccctggaggcggaggttgcagtgagccgagattgcgccactgcactctagcctgagcgacagagcgagactccatcttaaaaaaaaa

SEQ ID NO: 397748 - DNA, 558 bp, Homo sapiens
cggccttagagaatcctgcccttcctgtaagttctgggaggtccctagcgtggctgtaaggcccaggtgacccctcgcttcatattctggtggtggtcgtggggaagggtacaaactaaggctagcgcattgaggtcagcagtggaaggagtctttgggggtaaccaggagtttagtttagaacccagagcaaagactgaagggattttcttcccagaacaaaggggacccaacagagtaccactactatgagccttggtagcctttcagcatgactctcggctaaggtatccctcaatttatccttagtggtcacagggtgatgaggacatagatttgatagggcagtcagtggcaggtcattagagggaggtgactcaggcccttatggaagtcaaagtgaggactgatggggctaggcactgcctctgtggtcagccttgggaagccctgggcagatttgtcattctgaacgcaccccaccccctccctccaactgcatactctgggatatcaagtggaagagggcctttctctgattggtataggcctcaagtc

SEQ ID NO: 397749 - DNA, 564 bp, Homo sapiens
tccaaggaggaggttcgtggctacatcccaaggcagatagccgtgcttccccaggagatgtgctgaggaaggggaggccaaagtggcccagagacaacaggacccacagtttatgggcacaaagggtggagatgcagtggtgaaggatgctggaaggaaggaaaagtgcaggagcaggatgcagggggccgcttctcctcattccctagaaggcttctcctcctccctagccagagagggctccgtgagaactcaagggttcaggaaaggccactgcattctccctactcaggccggccagaggcacactggctctgtatgagccagaggcacacaggctcagtgggatggggagggagcctgcagcagagggtggtgaccaggctcgcaggaaaggatgcctgaatgtttgaactgagtttccaggcagcagaatgttccctcctgcctcctggcggccctggggtcctggccaatccccaaaaggggtccggtggttctggcaggtcaaaccgggggaaggaaggagaaaacacttccacatcgtgaacccaagtgatgagc

SEQ ID NO: 397750 - DNA, 337 bp, Homo sapiens
atgacattctggaaaagataacgctatggggatgaagagctgacagtggttgccagaggttcaggataggtggaggtggagtatttgaatataaagaaatagtctttgttgtgtatcactggagttacactgtagtctgattgggaaagtagctacatgactctagccatttgccaaatctcataaaactgtatatcagtctgggtgcagtggctcatgcctgtaatcccagcactttgggagactgacgtgggaggatcccttaaacccagttggaaatcatcttatgcaacataacaagacctcatagctactaaaatacaaacaaacaaacaaa

SEQ ID NO: 397751 - DNA, 341 bp, Homo sapiens
  misc_feature (33)..(33): n is a, c, g, or t
cagaggaccccggatggcgcaaccgggcgacanttcaactctgcctaatcactcactttggctgggattacaggcgtgagccaccatgtccagccacagtatttcttttctaattactacatactttagtttcttcaagtgatttaactttggttatgcaagttcttttcaccacttcaaccaaggcttattagcagtagaaaataatattctagacaggttttttttttctggccataagatttaaatattctacacgcatattttcccttaaggtttggcttggcatgtggtagacatgcaacatgtatatgtgaatgatggaaagggtcgccaatcga

SEQ ID NO: 397752 - DNA, 934 bp, Homo sapiens
taggagttacttgtggctcagggggaatctgcaggtcggtggactatggaaaaaggggaagtcagcaagttccacatgactcaggagagcctggaggaggggcctacggggcaggtccatgttttaaccatcaccaagctaacaacctacccatgccaatgtgatttctctacacataagcaaccactaccccagccttatcatacctggttataaaacttcagtattgttcaggctgacctacactgcccaatccttccatcaatggatgcccctcctaccatgtccttgacgatggtcactgcccacttttaccaaaaaatatcaaaaaattctatgctgttttggaggaaaaaaatacattgaattttactagtcatatcttattttcttaaattgcataatttgagttgccaagttgtgaggacctacagtttacgtgcagaaaaatctcaaaattaataataagtaatacctaccatcagagtgcgcaagggaataaacagtgtcaagtagatgttgttactgttagccatgatgaccctgccagttggcgagtgagcccattatacagatacagagccagactccacagggaatcactgtccaagtcccacaattagcagacagtgtgattatcagcaagctcaggatgtgtgaccccagagctgatgttccttccctcccactgaactgcctacacagcttccctgaagagaatttccccagagagtccatctagatttttaactgtaatgttcaattatgaatatcaaggttttatccaaaaacaaagcatgagacaggctttggagaggagagttacgatacatttgcaccagcagagagcctcctgatgcaaaaaggtttttcccaacagttggaaaatagctgggccttagaatgaagatcacaaagaaaagcaaatgtgtta

SEQ ID NO: 397753 - DNA, 311 bp, Homo sapiens
aacgggctcgattgcacatgttccctgtcagaattgttcagcgatccagagctcccgtctctaaatatttacaaagtactacttatcagaatgaaagagaatgtttctgtaccacaatgtcaggcatatggtagcagcatgaaatagaagataaatcgtgtggggtgattccaactggatttaatgccagcaataattatttttaatcagatgcaaggttcccttgatgataccagaccatgtaacatcgggaaataattttgtcagttttcattgtctgatgctgtttctataaataatcttgtaggacc

SEQ ID NO: 397754 - DNA, 445 bp, Homo sapiens
caaaacaaaacaaaacacccctcttttctttataaattacccagtctcaggtttttctttatagcagtgccagaatggaccaagacagggagagaggaagcaagctctctgatgactcttctcaaaaggctgctaatcccatcaagtgaattccacccttataacctcctctcaacgtgatcacctcccaaacttctcgcctccaaataccaacacattgggagttaggagtttgacatatgaattttggagagtccacaaacattctgcctgtaacactagaaaagaaattttgatttcattttatctatttgtttgagacagagtcttgctctgttgcccaggctgcagtgcagtggcgtgatctcggctcactgcaacctccacctcccaggttcaaatgattctcctgactcagcctcctgaatagttgggactatgggca

SEQ ID NO: 397755 - DNA, 247 bp, Homo sapiens
tgaggctacagtgagctctgactgtaccatttgtactctagcctaggcaaagagggagaacccaaaaacaaacaaacaaaaagttggttggggcgggttggagaagaaagtatttctgaatttctgggtaggttactggtagtgtcaggccaaactagctctacagtcatattcattataaataaaggcaactagaagatctccatctagctattaaaattggttaaaatctacagagataaaggac

SEQ ID NO: 397756 - DNA, 389 bp, Homo sapiens
tcagctcaccagcgtggtcaggtctgcctgttctcgccagtccagccctgcgcctcctgcagccctgccactttctaccagcagctcttatctctcattgcctgttcatttgtggtgttcttgtaatccagtggttagccctactactcttctgaaatgatttactcagatgctttcctgccttccaaagccagagtgttcttcaggcctcactctacctgtattgttattgagtcatgtaagagttacttggagatattgtaatttcatccataaatacctgaatatgcatctcatctccttaagaacaagaacattctcctgtctcaccacaataagatgattgtactttctacctcatacataggctacattcagttttccttgtc

SEQ ID NO: 397757 - DNA, 844 bp, Homo sapiens
  misc_feature (600)..(600): n is a, c, g, or t
agcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagtttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcanggaagaaacagtgaagctcttcatctgtgagctggtcatgggccctggactaacctgcagaaaccaggcatcattcacagggatatgaagcctgacaatatttacttgacgaacatggtaaccggggtcctcctaacaagtcccactgggattggggtgtcggagaccgaagcccagggcattgtgttttgcaacctacacctggggttcgttatggcggttacacaataaagcgccttcgtgg

SEQ ID NO: 397758 - DNA, 771 bp, Homo sapiens
agcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatggtaagaaatatgggatagtggcatataaaaaatagaattttgcaaaattcaagtatatgcttctagtttcataagttaagcataagcatggtctgtagggccttgaaggaaaaaggcaaagctgcatgagtgagtctgaggactttgtaggctcatagctaggttttaccttccactttccatgggacctttggcagctttcctaatctccactataccaatgtcctttgtccaaagggagctgcagttgggcatgtggtggatagttaaatgatttgtttgtcctctgtgctgttccttggcagttgaagttacccccattgctcattgttacagaaaatacattatcaacatgtacatgaatgataaccagtgctcataatattatagaatgaagctgtgccttctgaatttccaactgccaagcttttgtgtactagacaaatcccataatgctacgtcatagaaaaaaga

SEQ ID NO: 397759 - DNA, 511 bp, Homo sapiens
ctggataaagctggagattgttagtctaagtgaagtaactcaggaatggaaaaccaaacatcatatgttctcacttatgagtgggagcaaaggcattaggaatgacataatggactctggggccttgcagggaagggtgggaggggggtgagggacaaaagactacacactgggtgcagtgtacactgctcaggtgatggatacatcaaaatctcagaaatcacacctaaataacttatccatgtaaccaaataccacctgttccttaaaaaattgaaataataataatttgaaaaaaatagtctattcaaaaaaaatgttcttttgtggattgatgaggacataaaacaaaaatcaggtagggaagaaattgaaattggttcttcacatgatacacaaaggtaaattccagatggaaaaaagtacttaaatatcaaaataaaatgcttggtagaacatatggaagtgaatatttttctgattctggggtgtggcgggaattcttaaacat

SEQ ID NO: 397760 - DNA, 251 bp, Homo sapiens
caataaacataggtatctttttgatgtaattatttcttttcctttgggtacatacttggtagtgggagtgctggattgagtggtagttctattttcagttatttgagaaatctttatactgatttccacagaggttgtactaattgacattctcaccaacagtgtgtaagttctgcatcctcaccaatatctgttttttttgtcttcttaatagccattctgactggtatgagatgatatctttttgtggt

SEQ ID NO: 397761 - DNA, 351 bp, Homo sapiens
tcttcttccttttcctttctcactttcagtttaaagtgaaatcagcttcccaaagaaaggattagagaaatgggtgcctttttcttcagtttgatcatagtgtcctaaacatccagattaactctaccaggtaattctttttagacagctcttcagaggtcacctaaatcatattttattgtcaaataagtggatggattaatgaatgaatgaatgccacatgaacatttcaggttatctgagaaacgttaaggtcaaccacttttcagtgtaaattaaatctgatttttaaaatttccaaaatcaacaaataacaggttcttcttgaaatgatactagcttgagaatgtg

SEQ ID NO: 397762 - DNA, 447 bp, Homo sapiens
ggattcaaagagatagggcatgtaaggctccccgcacagggtctggctcacagtaggcaataattacaccagtcctctattgttgccgtccttatgcagccccagggaacttggagagcccttggctgaggcatccagcctctttgctgccctctggtgctgaggctcagtgtggtcttgcgtggaggaggctgggatcgtgaccctctagttccctgtgctccaacctgcctgctctgatacacctgctgcaggggtaggaatcgtcggggaaggagccttagcctcaaggcctggcttcttggcttcctgactgtaatgacagctccacacgttccacagaggtgatggtgttgacaggtatttgggaaataccagttttctttcccagcatatttgtccttattttttcaggacatggtaaacattttattgtcatcctagctt

SEQ ID NO: 397763 - DNA, 595 bp, Homo sapiens
agatttttcaattaaaaaatggttagtgggtttaatggtaaacaaggcacaaaaaacagtatagaggaccgtctacgctgtcaggactccacattgttttgtttgctcaattgttcttctctgaacctcttttctcatcttaatacggaaattgctaatgacatctgtctctttagattgttttgaggattaaaaatgtaatatatataaagaacacagaatattgtcttcaacatagtaaacccagaaaatgaaaattttaaagccattgcaatagacgagaaacacaataatcagaacttgctataatttgaacttctaggggtccaacaataaaaaagagtatttttaaaaagtgcttgttattgaaaattaggtaaattttggcataaacgaaaggttagtagtgcaatgacagtgacagtaatagcgactgggaagggggctacaatatgtaaagccagctcaagttctatttagggtgtcctccctcaattaccttagaaaacatgggcaggaagtagatcttataaacatttttagggtggattttttttttttaaggcagaaggattcaaggtgaatatgtaagtac

SEQ ID NO: 397764 - DNA, 632 bp, Homo sapiens
cgttaccaggctcatacaactcatcagctagggatacaagctcgtgctaccatcgatttttcctccactacactgcaggaagctaaagaatcggtctaactcatcttgcactcaacccagacttacggtcctattggtcaggacctaatatccatttcccaataaactgccaatataaagtgaacccaagggggacccacctgagactaggtttcagggcctttagaactgaagctatcatgctagtttccttcaacagtaccgttcagattcttggctgatgtcaccacagccacctccacaaaaatgaaccacaaacatgcagtcgtatttattttaattcataaatacattaacatagcagattaggcaactggtaaggtaaaattacaaatacattagaaatcatacaaaagtggccgggcgcagtggctcacacctgtaatcccagcactttgggaggctgaggtgggcagatcacgaggtcaggagatcgagaccatcctgaccaacatggtgaaaccccgtctctactaaaaatacaaaaattagctaggcatggtggcgcgtgcctgtgttcccagctacctggaaggctgaggcaggagaatcacttgaacctgggaggcgga

SEQ ID NO: 397765 - DNA, 210 bp, Homo sapiens
aaacttttatacagagttctgtcctcagatgtgaggaaaggacttttcaaagatgagttctaaatgtttgtttagagatggcagcaacaagccacaggctgtaagaggaacgtgaatctacctttttttgttgttgttgttgttttgtagcaacaggggtcccactctgttgcccaggctggtctcaaattcctgggctcaggccaccta

SEQ ID NO: 397766 - DNA, 470 bp, Homo sapiens
aatttcaaatgtgacagtgatggatcaatgctcagttcagatcatggtcaagtagatcttccccgagatgtagtgctgatgaaggaagctttcgggatggtctaaagttctttttctccctcttgtctgatacttcagccgtttgggattttgattttcttttaagccttgatttttggatttcaatttatagtagtgacttcaagattgtttatctgacttggtggaacaaaactctgagagggccatacacattcactggggctgtcttgagctgacagcttggaaaggcataattagcttgtgagataggaagaaatgataagatgttgctctttgccatgcatttgatgttctctattaatgttttaccattttagacagataactttcagtggttctgatttctataagttggacagcacagtgaatagagagacctgtattatcaccctcccaaattatcatga

SEQ ID NO: 397767 - DNA, 880 bp, Homo sapiens
atgaccagcacctcacttggcttttcccgtagaaagcttttggaagcctggaaatgagtctgggtaacaactgcagaagtgcccaaggatttaaacagggcagtgacatggggaagcatcatttttatgaggaagattaatctgacaataacatgtgggacccactggagagggaagaggatgctacagatcccagcacctgggtggggggaccacgggacagagagaaaggggaggttcccaaagaatggctgaagaaagcattgacagaacttagtgagcaactggccgaggaaggagaggaagaggaaggcacattgagactgcaagcctggtgggtagagaggaaaatgcctcactgacactgacaatagcaaagtatgcaaaaggagcagagatgacggagattctttttagatatataaacttgtatcgggagatggacaccaatagcccccaactgttgctgagtgggaaacagtgtgtctgtagcaatgagacactttgctgagtagacaatttattaactcttactttttttactcatgagtccagtagatccatgaacacaatgaccgcatttaggtttttccaagttttctcagagcccaaagtctaggtcttgaactcatggagatagggagtaaaaggatggttacaagaggttgggaagggggaggggttggggggtggcaggtgaggatggttaatgggtacaaaaagtagttagaaagaatgaataaggtgggatgcggtggctcatgcctgtaatcccagcacattgggaggccgaggcaggtgtatgacttgagctcaggagttcaagaccagcctgggtaacatggcaaaaccccgtctctaccaaaaatacaaaaaaaaa

SEQ ID NO: 397768 - DNA, 374 bp, Homo sapiens
cttttgtctttctttttttttttttgacaaggtcttactctgtcaccgaggctggagggcagtggcgccatcacggctcactgcagccttgacctccctggttcaagccatcctctcacctcagcctcccagagtgctggaattacaggagtgagccactgcgcccagcctgtttgtattttctgtgttattacaacagttatcaatcttcatcactggtaaatttataattatatacatacatatgtctttgtatagatatatactcacatatatcctattgattgttgtcacattaatactgaaaaatgagtaattttaaaactgatcttttacattaaacatctatatattacaacattattacatattaa

SEQ ID NO: 397769 - DNA, 439 bp, Homo sapiens
ctagaaagtactactaatcaaacgcacataatcttacaatgcacccgcaccaataggatcctcccgaatcaaccctgacccctctccttcataaataattcagcttcctacactattaaagtttaccacaaccaccaccccatcatactctttcacccacagcaccaatcctacctgggttaggtctacctgggttaggtctacctgggttaggtctacctgggttaggtctaccaggtagatctaattggggatccctgttgtatagggtagtcttattccacttagtgtaaaaaggacctaattcccacccctttttaaaaacttaatacagttttgaaaatattcataatagtagtttagtacatccttttttaaaatttatcctgaatttatgcctaaattgtgtttgacaaaggttttgttagtctctctcata

SEQ ID NO: 397770 - DNA, 342 bp, Homo sapiens
gagggaacatctggtaccaaagtaccaaatgtgttcatgagtgtgtgtgtgtgtgtgtgtatgtgtgtgtgtgtgtatgagagagagagagagagagacagagagagagagaagagagagacagaggaaaagagattggtcttccctttttactttttgtagctttcttctttctaccgcttcttgtgttttgggaaaggtgggtttcctcccttcaattccgtatgtctccttgctcaaaaatcatgctgacaggaggtcatggctcctgatacagtaaacctcaggatggtctttgcccatgcaagaggtttggctggcaattcacgttaatttcttctc

SEQ ID NO: 397771 - DNA, 521 bp, Homo sapiens
agccagtgcataggaaatagatggaatgcagactagatacaactacatacaattgtctctatttttggatgacacacttgtatatataaaagtactaaaaagaagttccactgaaatgctataagaacgaataaaagagtttagaaatgtcattggagacaaaatcaacatgcaaatatcaattgtgctttttttatagtcgtaaaaatcacataacattagctctaccctcttagtaaatatttaattgtctagtacagtacaatattgctaactgtaagtgcaatgttgtatagtaaatctccagaactttctaatctttcattactaaaactttataactattgtcaaagaatctttagagtgtcaccttgccagccagaaacctctgtggctggtggcgcccctgcttgagttttgctgatgcccactgggctcattccacccactcagcctggcaggctgggctcggctcaggctactggcccccatcccatgaccaccaagggtgagccgggagc

SEQ ID NO: 397772 - DNA, 480 bp, Homo sapiens
caatacaataagagatggggaattcagtactccattttcaggattagacagaacttccagatagaaaatcaagaaagaaacatcagatttaatctgcactgtacagcaaatggatctaagaaatattacagagcatttcatccaatacctccagaaaatacattcttctcctcagcacacagattattctcaaggatagaccatatagtagacctcaatacaagtcttaagatattcaaaaaatggaaataatatcgagcatattttctgatggactaaaagcagaaagcaataacaagaggaattttgaaaactatacaaacacatggaagtaaaacaatatactcctgaattaccagagggtcaatgaagaaaataagaaggcaattgaaaatttttttgaagcaaatgataatgaatacacagcatatcaaaacctatggaatacagtgaaaccatattatttcttcatactgaaga

SEQ ID NO: 397773 - DNA, 624 bp, Homo sapiens
tggttatcactaggctcttgcttatggtgtccggctcttgcactaacttacataggcggttttccccagagtggtccaaataggggaatgagtatacaaccctgtgttttgtaaaaattgtaaattacctaagcacatttcagtttcaggtgacactatttaagcatgacaggctagtgatctgcagtatcatttagatttgaggaaggagagatgagaaattaatctctgccacccttgttttgctttgtttgtgatacattgtgaagattgccttatagcattttatatattgttaaaactttcgcattgagcatcccatgctgactttgtaatccagaaagggcctaaaattgtccagtcataggagcattagatgctccagatttgcagtaagtttgtgtaaagcagaagcaaggcagcgctttggtctggatatgctgccatgccctgctttcttgctctttattgtgcttcacagacactgggttttttacaaattgaaggcttgtggcaaccctgcatcgagtaagtctttctctccataccacttttccaacagcgtgtggtcactttgtgtctctctgtcacattttggtaattctcacaatacttcaaacattt

SEQ ID NO: 397774 - DNA, 1152 bp, Homo sapiens
gagatttttctccaagagtggggaagccttggtagcctgttcctactatatagcagaaagattattgaaattcagtgcccggttttggctttctgatctttcctttcaaaagttcaagcagttcatcccttttgctaacacatttgctatacaaggtacaatacatttgattctgttgaagctttcatagtaaggattgcatcgtagttattcctccttcagactgtactcgttgatcctatacctccttggtcacttttgcagctcatttcttgagttgctgttctcgttttttccatgtcccagtttttgccagtgtactgttattttcgaaggtttctaggccctgtgtttccctgtatattgacttaattcatacctatttgtccattggtcatttattcatactttgtgaggtcctgatggcgattcagatgttaagccttctttaaattcaggtttagtgtcaaggttcttcttggttgtagttgcttgttgagaaattttttgggctattaggtcatgtgtaattggaggccatgttttggctgtgtggtgctctattttaggagtctacttgagtattcaagcctcattctagccagctgacttttaaaaaaatgtttgtttgtgattatatgctgtcccttagttgtagccagctctttcaaatgctagcttaaaaatggaaactggtcaggaatttcagtggcttcagcgtgacccttctgtacggaatacatgtggtatggagggtgagacagcacttaccagaatatgtgtggagtcctgtatgacaggcatagttttgggtattcataagtcaaggatgaataagacaacagaccttggcttgaagtgccttgcagcctggaagaagggagattgtcaacagctggattgagcatcgtccaaggaaaactagaaagagtgtgtacacagtatgaatctaaggaaagtatattcagctttgtgaaacggagggggagtaataggagagggagtactcttgggtcagtttttgaagtagtagtgaggactccctggacaaagaagagagcatttagacagaatgaacatctgtctacaaaggtgtgaacttgtgaaacaacctaaactgccttgggagtggcccattatttggtttcgctg

SEQ ID NO: 397775 - DNA, 519 bp, Homo sapiens
cttcccattgaccgaagcagaaaaattgaaccgaatctacgccccttgttctgattcctgctagaggaaaacagaaaatcatcccgcaggtctctttcagtccctggatggcgagcgcagcccctgggaggccacacttagttctttattgtgaatctctcgctactcaagttcgttcgggaccagggcctcggatggcctcggttgcccgtaagtacgcgaaagaagaggtgaatccaatcgctggcctagaggatagtgatcagacaacccgaggattactaaacaaggggcggcggtgtccctgtctcatggggttggcgtggggcggggggtaggcagcaagatcctccaggctcctggatgcaaagagtgagaaagaaagcgcagcctctggcagcctgcttataaatgcagcctttcggaagatgaaacttgcagtcttaggttgtcctcctttatatccatgttccaatcctctgggctttcctcgaaatgaataaaattgtggaaatgaat

SEQ ID NO: 397776 - DNA, 610 bp, Homo sapiens
aatttctgatgcccccttctcttagggtgggttcatacaacgagactacccatctcgctggctgtctaaataatcttttctccccatattcattttgaattattggagccttaattgcactacagacatgctaaattttgtgatagcttaagtagtattaagacattaagattcctggtgttagttttttctctgcaattttcttagaaatattgacttactggagccagagggtctgtagagatgagccagtacaggtttcttagagtatgttccaaggaacactgcgctatcaaagatgctctgcataaaaggacttccatggcaagtgaatgtgaggaatgctacataccttctttttccccttggagattaatgacacatgtaggtcttattagaggctctgtgctgtcctgtgataaataaagccaactaacttgtttttatcaagtgttccctgatttgcagaatcattagatgtttagtattataggattgttttttttggttttttttttttttttttttttttgagacagagtctcgctctgtcgcccaggctggagggatctcagctcactgcaagctccgcctcctgggttcatgccat

SEQ ID NO: 397777 - DNA, 500 bp, Homo sapiens
ttataccattttatttaaggaacttgaccctcagtggattttggtatctgcagggggtcttgcaaccagttccccatggatactgagggacagctgtataatttcttggcatatgatttcttggccgtctagttggggcaaggggactttgcgcttagaaatgttgggtttcacagggacctcatcaattagtatttctatcccagtttcagtcctcagccagaatacctgcagtaaaatgcctcatgtgagaaccatgattagttctttcagggttttgctatttgagccagagattagttaaacagtttctaaaactttctatttaatgtagttgtcttttaaaaagtcatattataaatttattgatcacttttcatctgtcaaagaagggatcagttacagctgtgattttcagttactagtaaggattgaggatatggcagactctctaggttctgattctgattcgctattctatggcaagtttattagtttcc

SEQ ID NO: 397778 - DNA, 401 bp, Homo sapiens
ttacctggatagacatgaacttgatcagtaattttgccttagatggttctacaagcagcctggaggggttgcctataataacaaaatggtgacacctgggcccctgcggcactccttgctctgaagaaaagacagacagttcaggtcaactccataggacgatgccagacctcagttagttgggtagaaacatgttgagtcacagggagcaggcaggagtccccagtggtaggaagggaagacctctctctctgtgttatactgacaactagaccaaacgacttttcatgattatccagacaatgttttataaaggtcaggtaggagactggcaggacttgttttctggtcacaaccctgctgaccaaaacaagtccaggcaggataaaattcaaaaaaaa

SEQ ID NO: 397779 - DNA, 282 bp, Homo sapiens
gctgatgtatatgtgtgtggataagtgtggagtgacaggagttagaagtaggggaggcgtatcagcatctgtggaaagggacttctagtcatatcaattgaaggaaagtttggaggaaagctttggagctctattcctgtcttttgatactaacttaagaggataattgcccttccattcattatggaaatccgaaacaagaggccaggttactcaatgatactgagtaaaaccaggacagcataataacattaatgtattaatgtagtaaggagctgatac

SEQ ID NO: 397780 - DNA, 269 bp, Homo sapiens
ttatgttctgaccaccaagcacacctatgccattacgcccatgaaacgccaatggaggagggcggggaggagaagtcgcccagcaaaaagaagaagaagattcagaagaaagaggagaaggcagagaccctggggctatggtgtctgagatgtttgtggggtgttgagtgtggaccctggaccagtgtaaccttttgtgagggtgcaatggcatctgatgagagtgaactctgctgagatgatgtgactttaggtgggaggtggagagg

SEQ ID NO: 397781 - DNA, 314 bp, Homo sapiens
cccttcccattcatcaccttcctagaggcagtgggagtaaaaaagtacagccaagagcactgtgtccagagctctgcctgggttctaagaatgccccaagggaaaacaggtccttcctttccatttctccatcatccctcagcttcttcatccccaatactttcatgatggcccaagaaggaaagaaaggaaaagaatctttactcatgcctcctgtgtaataggtaccatagaaggcaaattctccttagtgctcccatttactactcacaacaatccatccaagcagcacgtctcctttttcaagataaaaa

SEQ ID NO: 397782 - DNA, 478 bp, Homo sapiens
attccttttgaaaatgccacaaccttgtggttcttggtttggttggagttgctcttctctccgctttgcctgattgaaggactgcttgttctaattgcctgtttctgaccatattgaaattaaatattttaagtagttcttcttacagccaactgatactccattcaaaggctactgaagggccatactcagttgctagcttggctgcctaccagttttaaagccacacttaagtttctggtttggaaccgtgtgagttgtgggtaacttaagtcaagaataggaactgctcacttcaaatttgtagccttcattcttttccataactttgctttggggttgaagtaaatgggtatcattggccctagagaggaagtgatagtgggtttcaccagcagtcttacttaagtgctcgctgcaggaagtctgtagtacatgctagaatatcataggtgtttctcttctcccctctaaaata

SEQ ID NO: 397783 - DNA, 196 bp, Homo sapiens
ttgcctttttatgtttcttaatctggggaaagagagccagagttcttcgatttgtgtagcttatctataaatgtaaaaggaatgattttgttccctgcaatagatttaggctgataatacatttacctgagaaaatataattgcttttctgtttatacttcttatagtattgttctcgtactcatttcctataact

SEQ ID NO: 397784 - DNA, 282 bp, Homo sapiens
cctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctccc

SEQ ID NO: 397785 - DNA, 1082 bp, Homo sapiens
gctctgcctcaccccgccctctagagcctggtgctgccagacacgggctgcaagatctccgtgggcggatggctttgcttctcatggccactctcttctgcaggctccaaggctgtaatttcactctctctgccagcagaggtggagagatgtctgttgctgctccctcgcggttcactttctgtcttgcaggtggaatcgttgcccgctcttgtctgccactcactcctttgctgctttgccatttctgactccagggcagttccagaaccggaatgaccctcataactgaagccattagtatgtcggatacaatatgtatgcatttatgtctcattttcaaatgtgcaccactgagctggcaggaaagtacagaatacattgagcctaaaaacagtgaaactggagaccctgggaccctgggcgcaaagctggcttttgccccaagggtttcctacgcctggagaccttgagttttattgttgataacttcatggaactggaggtgggggggtgggcaggagatccaataggagacacctctgaatgctgtagctacagatggctcacactaaaaccgtgactgagacataagtccactgcacagagagggaaggctgaacacatgcctccctcaatctggtgcttggtggagggggagagatgttgcctagaaattgacagcctttgtgctggaaacctccctacctgtgtagtataagactcaggagaataagttaattccatgtggacccaagatgagttcaggaagtgtccagtctccaggcaatagaccttccagaagttactgtagcacccgcaggcgctgggcacaggcaaacagacgtctctctggagaaattcaccttcaatccaggctgctccgaatttctagacgtgacatttaaggaaaatgagaagctcagagtccagtcataaaacatacaaggaaataaggcacaatgagtcagaaccagcaaaaaaaatacagtagacgcagatgtgaaagctcaacacagaatagaagataagtgttcctaatacactgaagtaaattgatgagaagctcaaaaggtaagaag

SEQ ID NO: 397786 - DNA, 795 bp, Homo sapiens
ccggaatattggccacaggcatctatgtatttgaatcatatccatttttgagctcactcctagcagaggagtcaaaacttacgttctggcccccaggtacatttccagtctcttactcataaaattgtgacatacccccaggggtgcccaaaggggtttgtgaatcaagatagtttgaggagaatcgattttctgatcctcagtttttctatgctctttttcctaaaagcgatattcctaaaaaggcatccaagacaaggcatcccctttcccatttgctggggaagacagctttacaagagaaagctgcccctctcacccatgtgaccccccactctggggcactgccctaggggtagaaatctccaaggcatcaaacaaagtgactcctgggggtcaagtgacagaggagcaagtctttctgcaagtcaagtggtttccagctctgctttcagcaaaattgaaagaggcactaatcaaattgccagcggatcataaaaaaacattttgataataatgttattaggcatataacttggaagaagttcaaagaattgaatggcatcctcataacaaactcatcggcttccatttatttatttatgtggacagtgtttctcaatgtttaaacctacaaaagactaaacatgggagtaaacttcatgttgaaccttgtgtgagtctagcaataagtcatccacatatacatacactaattgggaagaaaacctgtcccaaccccaactattttattaagagatgcatttccaataaaaatttaccttttatgtttaa

SEQ ID NO: 397787 - DNA, 337 bp, Homo sapiens
tagatttcctcccctttgatatcccatgcacacctcaaatgtgacaaactcacggcagatctcacccgcatcctcctgtaaatctacctcttctctgactgccctacgctggtgactggcaggtccccctgagtcataaacttgggctttgtccttgactcccatgtctccccggtttcactgttccagcaacatttgatcagttacttaatccttcctcttaaacatctctctgagtcatccagcctctcctggatattgcctttgtcactgctgagtctgtcttgatttaaatttttgatattttaataataaaatttttttgatattttgttca

SEQ ID NO: 397788 - DNA, 233 bp, Homo sapiens
cctggcacccagcatgtcccggcctcacccacccctctggccggcagtgagcagctggggtgacctcccagaaagaaaatgccagtgggtttggctaaagcagctggtcaggcaagccctgtggcttctggtcccctcaaaatgcccagagctgagaatttccagagcatcccatgctgttggcacccaaaaatcagggtggtcttccctctggggctggaggtgtggcaccc

SEQ ID NO: 397789 - DNA, 252 bp, Homo sapiens
gtttttgaaaataatttggagggaggaagataaaccagattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactatt

SEQ ID NO: 397790 - DNA, 252 bp, Homo sapiens
ctttacttataacattattcaatcgtactcataaactaattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactatt

SEQ ID NO: 397791 - DNA, 250 bp, Homo sapiens
tattaagtaagtctaaaaccaaaataataacaacaaattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactatt

SEQ ID NO: 397792 - DNA, 541 bp, Homo sapiens
caaagaagttcccttctcatcatcttcatctcagctattaaagatatatacagttgtacagtttgctctgatgttggcattttatgaagagacctttgcagatacagctgcactgtcgcaagttactctccttctgagggtttgcttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactattaaaaaaaaagcctggcctcgttggcctca

SEQ ID NO: 397793 - DNA, 512 bp, Homo sapiens
caaagaagttcccttctcatcatcttcatctcagctattaaagatatatacagttgtacagtttgctctgatgttggcattttatgaagagacctttgcagatacagctgcactgtcgcaagttactctccttctgagggtttgcttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactatt

SEQ ID NO: 397794 - DNA, 573 bp, Homo sapiens
gcctgtgcctcacacgagaaggcccttccacagagacaggtgattccgaccaggggagatggtggccaagggtttcgtaatcaactttgtggcactttcatacttcaattgttaaaaactgatcagtaatcatttctgattatgttttcttttatacagttaaatgttaattgtttttctgggtagaaaagaaacatttacacactgtggaaaatctgaagaatacagggaaaataaactcactcaataaacctggagaccagaaatactcaggatgagtgagactctattttcatatatacatacatgatcgccgctacaatccactttgttcatctttttaaaaacacctcatttaaaatcctttaactcgtaggctgatattcttgttttcatcttagtgccaacacttgctttccaaatcaggcagaaaaaggcatctgttatccattactgctgctcctgactaaacgctcccttccctgttggtttccaaggggcccgaggttggttggagatcatcctgacaagcccacagccctcctctccaggtaactgaatgccctgcggccg

SEQ ID NO: 397795 - DNA, 490 bp, Homo sapiens
ttacaggggcagcaaatgctgtctgtacattctcctccttagtgttcaagcagcactgggctgttgcctcctctagtcctgtaggggtaaagatgaccatcatgtctacttcaataaagggttttatgggtggacaacattgttctcccccattcctcagtagcggacctcttctcagcctggttgcactccttgctcttatgcatggcattagagccacacccagtgtgacagccatacccaatatgccaccaacgtcaggatcctctgggcctgcaccatcaactatggtagccatgaactgtatgtgtccatttacattaagtacaattaaataaaattagaaattcagtttctttctcactagccagctactttgggggctgaggtgggaggatcacttgagtccaggaggttgaggctgcagtgagccatgatcacgccactgcactccagcctagacaacagagtgagactctgtttctaagag

SEQ ID NO: 397796 - DNA, 208 bp, Homo sapiens
taggttttcatacttcatggcaagaaatctacaggaaattacctgtaccgtgagtgcatcggcatcagtattttttcacatgcaaattatagaaaactcagggtaaactggcttatgcaaaaaaggaacttgattagctcatgtaacgaaaaataccaagatttgctattaacatgacccagcatgatgtgattgggatgcagggcgc

SEQ ID NO: 397797 - DNA, 533 bp, Homo sapiens
gcagaatatgtgcattgcaggtgctatttatcatggtgaaaagttggaagcaaactcaacactgaaatgagaaacaggctgaatcacagggtggtgcatccactagcagggatcatatactgtggtaattaaatggtctgacatccttgcagcaagttaaactgtcacaggaaacaagagacaaagtatcatggactacaataaaaataggaaaaggtgttgccgcagagaaagactgtaatgcaggcgtcccatgctaagaatagttatactgtggccaggcgcggtctgggaggccgaggcaggtggatcacctaaggtcaggagttcaagaccagcctggccaacatggtgaaaccccatctctactaaaaagccaggcgcagtggtgcatgcctgtagtcccagctactcgggaggctgaggcatgagaatcacttcaacccaggaggcggaggctgtggtgagccaagatcacaccactgtactccagcctcggtgacagagctagactccgtgtcaaaaataaaaaa

SEQ ID NO: 397798 - DNA, 369 bp, Homo sapiens
aacagtatagggagcccagtaaataatccctaacatatatggtcaaataattttcaaaaaagtaccaagattattcgtggggagagtagaatcttttcaacaaattatactgggaaaactggatatccacatgcaaaagaatgaagttggacacttaacaccatatacaaaaattagctcaaaatggatcaaaggcctatatataacccctaaaactgtaaaacccagaaaaaaaaatatgggggaaaatcatgacataagtttgacaatgatttcttaggtatgaccaatggtacaggcaacaaaaaaaaaatggaaaaactggacttcatcaatattaaaaaatttttgggcgtcaaaggacactat

SEQ ID NO: 397799 - DNA, 682 bp, Homo sapiens
catttcaacatgagttttggagggaataaacattcaaaccatagcaataactaagtgattttgaaaaaattggaagagtattacaaataacagagctaaaaatgactacttaacaaaaatttgggtatacataattgttaaagctgatattgagagaagttacaccattgcttttcaacaaaacactgtttaaaaccactgttcacagaatgctggcatgatgaactttgggtctgactcaagacgaaaactcctgaattcacaccagaatcctgggaaagatcccatttctaggtactgtatataagaatcttacagctggggttggaatatcaaagaaaaaagactaggggtttttaatctagtgtgaaaaatgcttcagatgttacaattatatgtcatacaagaaaaacatatatgcatttgaaattttaaataacattaaagaaagacttcagatttttatgtttaactagtagcactttgttttttgagtcattatgcttggatttactcttttggcattgacacctgcattcttcaaagcttccttaatcagcaggatttcagaataaaattaattcttaatatcgggcaaggggagcttacggaatgaacgataacccggaagagctgggcccaatgtccattgtccaaggcccccggtcccacgttccgcgat

SEQ ID NO: 397800 - DNA, 677 bp, Homo sapiens
aactactaacacagaaactattctacttacaatatggttgtaattgaatctgtttgttggaaattccaaagtgactaagcttgctgtcacaaatgcacttccaggaataggagcatgaatcagtttctcaaagcttttaataaaagctggtgttcttgtttatgcatgttcaatgccatgtctgcctaggtgataaaataatgtttggtgcatagaaggcactaaaaatatagcttttgaatgagtgaaggacattttccccaaaattattgtcatttgtcatttgtctctgctggaagtctgtgggggcagataactgttcttggggatctcccaagtgtcctgaggaggtccttaggagccacagcctgcattctcgtcgcctcgcccctcatgtggatgtgaaccagactggaagaggcatccctttgccttgaggcaacagtttcaagagcagagtctctttggccagctcttaaacttctcccaagttagccctccccggaatgaacaggaggctcctctgcccatctagtgtcaaggtgccgactcaagaagtcatcctttgtcttcctcttccattctcttgctgatattgtccacggacacaggcacagcacttttgtacgttgcacgatttgctctttgccctttataatcatttctactattgaata

SEQ ID NO: 397801 - DNA, 632 bp, Homo sapiens
ttgtcctctggcacatagtaggaagcactcaatatctgttttttaaaatgaattgaatgtagtatgtgaggaagaaggagaaaacaagggcgtctgtttctagcataggtgaccccaggtgagtggtcgttttccacctgagagagagagtagagtagaactgcggggtcgtagcatatgttcgttatcaactttgctagataatgttgaattattttccaaaatgtgtgtgccagtttatattcaatacagcagtgtatatttgttctatttgcttgaggacattagtttttttcatatttaggtaaaatttgcataacctaaaattaactattttaaagtatataatcagtgacatttagtacattcacattgttgtacaaccaccacttctttctagttccaaaacattttcatcccctctaaagaaaccccatacctattagtctgttctggcactgctataaataaataactgagactgggtaatttataaagaagagatgtttaattggcacacagttccacaggctgtacaggaagcatggctggggaggcctcaggaaacttagaatcatggcagaaggtgaaggggaagccagcgtgtcttacgtggccggagcaggaggaag

SEQ ID NO: 397802 - DNA, 295 bp, Homo sapiens
tttcacttaaaagcttctggttgacgcgtgatttctcccctttgcaggaagctgacaagaagcacgttgctgagtgatcctgggttcccatcctccgcacccgtgcatccacgcgtgggcccagccagcaaggagaagtctaacaggcaggaggaggggagacacaaggagcccccgcagtaagtcacaagaagctgcctgcactctgactttctttggctttctcagcattttgtacagggttcccttgactgatgtgggggttagaactggaaggaaaggtccctctcctccc

SEQ ID NO: 397803 - DNA, 644 bp, Homo sapiens
gatttcttaactacaggactcttagccttttcacaggaatgtgcatgacttggtgactgcctacatgtcctgcctcatctcacgttttttttccctgacccactttgcttactctgcccagatttaatctagtactaaggatcaaattacaattgtctatgttacatgggcattttctcagtttgccacagcaatattatgatcactttaccatcttgaatatgaactgtccctccatctctgctcaattactgtgtcagagcaagcaaacgtttttactatttcattcatagattcagcaaaatttgttaagcacctactatatttgccagacacagttctaggcactggagatacaacagtgaataaaagaaaaaccctgaccttatatagtttaccttatagtggggagtggaaaaagggaacaataattaaaaatacatgttatgcccagtatggtggctcacacctgtaatccttaaactctgagaggccaaagtgggaggatcacttgaggccaagagttcaagaccaacctttataacacaccaagacctcaacagaaaaaataaaaataaattagctgggcacagtggtgcatactgtagtcccagttattcgggaggatcacttgagcccaggag

SEQ ID NO: 397804 - DNA, 405 bp, Homo sapiens
ctgatctatgaatgctaacatttatgttgttcgctatttctgtgtacttataccacccgtgtgagtgttgcttgatttggcagaagtaatggaattttaaaaagcagttgcatgagcaaatatatctattttccatatgtacatatttgcaatttagcaagtcatttgcttttgtttaaatattcaaaacgttgtcatatgtgtgttgtacacattaagattttatgtattttaaaaattatatatgtgtattgatatatttgtatgcacacagagcaaagcttgaaatagcaaaaggtaattacatgcatattgtatatactactttgtattaaaaatgtagtttattgatctttaaaaccaaatttgtttttgtaataaagagtaataaaaaattagattatg

SEQ ID NO: 397805 - DNA, 652 bp, Homo sapiens
tagaactatgggactgtatttaacaagtacatatgcatcagattagtttaactttatgataacttgcttctcctaaattgttactaaaaataattatacctaaagtcatccagaatgccataatttcatgagatgacacagcaggtaaattggtttctccaactcctaccttctaccagattgttctgtacagaacaatcatgcttccaaagacagccaccactagcaagaccaggaagaaagaaattcttatcacccctaatcaagcagataaattgtgtatgctccaaagcattcttattgaggaggaaaactgaggagttgtagaatatgctacagttactattagaaaaagtaaaagccagtcacctgagactctttaccctttgccccccaattctcagtatgccacctttcactttgatctcctgagtctcatttcacttccctaacattagagtttaggcacattcaattttatcttactttggattgttataaaatcaattaattctagtcttcttttgttttcctttttagtttatataataagagaacacatgcttgttccaaaaacaaaattttaagcccaaacataactttataaggtaaaaagcaaaaacatcctcttttctccatcttgtctcacttc

SEQ ID NO: 397806 - DNA, 320 bp, Homo sapiens
atcaccactgcatcatcacagcatatgcagtcacccggagatcccagagcttatgttatctttcacagaagcagatatacagaggggttatcttttcatctgctgaaaaagtttcaatgtttttatgtgcatgtacaatgcttacatacaaagtcaacattgtgataatgcactttcctgtagtcaaatttgcaaaatatgtgtaaaatgaattagaactctttaaaagcctttatacaatttatatctccagtattggaaaagattaaatacataggatagcaaattgcagaaaatgatgctgacaatttaaaatagtg

SEQ ID NO: 397807 - DNA, 159 bp, Homo sapiens
taactacccacttagtgcattgcccattgcccacccttcaatcccatactgatgccacccatacccagcatgcactgtgtccagcagctctcagctctgcctgggggcagcctaagtatctccagttaccaggggcagaaggagagtctaaacaaattg

SEQ ID NO: 397808 - DNA, 328 bp, Homo sapiens
ttctcatctctttccttatccacttcgcccatgcccaccccggccagagatgattctgaagtcgatctcagatgtgtctttttatctttaactattttagttgaattctatacttttgaggtctagctaatcagaaagaagagtgaagaaagagaccagggcagtcagaggaatcagatgccttttatctgagaaatgagagaaggaatactctctttcagaaacactggtctagaagacccaggaggaagatttcagggtctgtaaataagaaaagcacaataatgtggaaaccagttaagaatttatctctgtgtcattaaggcat

SEQ ID NO: 397809 - DNA, 704 bp, Homo sapiens
  misc_feature (38)..(39): n is a, c, g, or t
  misc_feature (331)..(332): n is a, c, g, or t
ggcagtactctcagggttataaggtacgaggctgggtnngcggcggcgtagctgtggcgggaaacgctgtttgaagcggcaggatggatggcaagcggcggccaggcccaggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacnncaccagcgctggacccccagacagagcccctcatcttccaacagttggagattgaccattatgtgggcccagcacagcctgtgcctggggggcccccaccatcccacggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctccgagagagcatgtatgggtaccacgggcacggtccctccgc

SEQ ID NO: 397810 - DNA, 480 bp, Homo sapiens
agtgatctgcccacctcagcctccaaaagtgctgggattacaggtgtcagccaccatgcccagccgacatttctaaaatagatcatctattgtttcataagattatgcttatagaaaagcattaggtgacaatataccttcttttctagtagttacttaaagtatgtatcgcatacttgaagcatcatgataaaattaatttggctagagtgtaagttggcaagctctagcctgggactactgcctggtttttattactccaccacagagatactgatggtgcttctgtttttaaagggttattgcaaaagaaagaagaatattagaaatgatttgtgactcgcaataacttaaaatatttttttctgacctttttatagtgtctgtggaaacctgggctggaatatttatgttttttaaaaaattttaaaattagtatttatggtagatagaccacaaagttactatgctcttaacttt

SEQ ID NO: 397811 - DNA, 226 bp, Homo sapiens
ccgggtcgacccacgcgtccgcgtatctgtagcccttgctacttgggaggctgaggtgggaggattaattgagcccaggagttccaggttacagtaagttatgattgtgccactgcagtacagccaggatgacagagaaagaccctgtatcaaatacatagatgatagatacatacatatatacatatatatgtgcatacatacatacgaaaagaaagatttgaga

SEQ ID NO: 397812 - DNA, 383 bp, Homo sapiens
gcctagttgctctggctaggacttctagtactctattgaataagtagtgaaaacagacattctcgtcttatttagatcttggaggaaaagctttcaatttttttttcccattttgtataatgttagctgtgggtttgtcatatttggcctttattgttttgaggtatgttctttttatattcaatttgttaatagtttttatcataaagggattttgaattttatcaaatgctttctcagcatctattgaaatgattttatacttctcgattccatttgtgttatttatcatattgattgatttgtatatattgaactatccttgcattcctaggatgaatcccacttcatcgtggtgaatgatatttttaatatgttgttga

SEQ ID NO: 397813 - DNA, 472 bp, Homo sapiens
cttaatattgggcttcccagcctccagaactgtgagaaataaatttctgtgctttataaattacccagtctcaggtattttgttatggcagcacaaacagacgaagacagttactattagaagcactgatcagggaagtgaaatggattaatttatttggagaatttggagtgaaggatggaatagagggatgagagacagatgagggaaactagttaggaggctagcacagtagtcgatatgaaaactcaagaagcatcttacccatagtgtaattaggaagtagcttgttcttgctgagtccatgctgatgtcttctgatcactttcccctcaatacccaacagagttttaatagtctgttggtctccagtggaagagaaagtcagacagatcctaattctctgtcctattgatgcttatatgcttggttcctaaggaatggtatgaaaaataacatagaagtgaaattc

SEQ ID NO: 397814 - DNA, 380 bp, Homo sapiens
gctgtgctcagaggatccccatcaaccctaaatttattatgattacagccactattagatttcaaaagggttcatcagaaatctctgaggtatatgatggggaaagaatattttgactaccactttaacaggtctgctatttaataatattagtttctttttaattgatgtttcatggacatccagaatactagctataaaatcatatatgctgcataatgcaagcaaaacaaaagcacctgtaaatattacagaagactatacatgtatgtatatcattgccataaaatacctatatacatatacgtatatacacacataattgttttcacaaccatgatagtattacttacaaaagcataataaatttagggttgatg

SEQ ID NO: 397815 - DNA, 407 bp, Homo sapiens
ctcatcagaaagactgtaaacctttgagagcagaagtcatgtttatatctcttgctaccttatatttaatgtaatgccacatacatagttggagtgcaatgcatattcagtgctggtgatcatgggatgtgtttgaaaaggatctataaccaagtaacagccaatgtgtattgggcacataataatcattatacacaatgctatacactttatatggattatgtcatttgtcctttctacaacccagtgatctacggacaactatagtcccattttactgatgaggaaactgaggcttagagagagctaagtaatttgcccatggtcatccagctcgtaggtggagaaaccagaattcaatccagatggtttgattccagagccaccactctcaaccaccgtgctat

SEQ ID NO: 397816 - DNA, 358 bp, Homo sapiens
tgtgcctctacattccctcttgggtgacagagtgagatcctgtctcaaaaaaaagctgttcatttcaggaatgttaattatattcgcattgttatgcaaagacttctagaaactttacatcttgtgaaacttaaactcagtacccattaagtaacaactgctaattttactctctctccagccctagactggacaaaccttccactttctctttttatgattttgacttcttaagatacctcatataaatggaatcatacagtatccattattttgttactggattaattcaggtgacataatattctcaaggttcatcttaaaatatgacatgatttttttttaaggtgggataata

SEQ ID NO: 397817 - DNA, 703 bp, Homo sapiens
gtagagacgggctttcaccatgttggctaggctggtcttgaactcctgacctcaaatgatctgcctgggcctcccaaagtgctgtgattacaggcatgagccactgtgcccagccaaaccaaatgttatgtaagccatccatctgaggaaagtgggcctgcatttgtagtcaaagcagtgaacaagcctcccaacagagtagaatggtcttaaataaggaaagacagatcttgcctctgcagaattataaatagcagaaacaactgaaaatagaaatgatcaccattacttttctagactattatgatggtttatatagatgaaaagctaagttactgtatggcaaggatttcttcctagagaagaaatcttcctagaggtaccattagttcagtgtagtagaactcctaagacatttggctggtaacatttcttgaaactgatctatgtgtcagcacctctactgggtgcttctaaaacatcttgcagaatggatgggttcattcaggctgcctcccaaggtggcatggtagtttctattttggcatttttgtttttgtttttttaaatacaaagatatttgtcttacctccttttcagagctctgtttaggctttcctaaagaagtcacaagtgctgggtgcagtagcttatgcctgtaatcccagcattttgtgtttttttgttttgttttgttttgttt

SEQ ID NO: 397818 - DNA, 534 bp, Homo sapiens
gccatttgtttcagtcatgtcagcaactttggttttcataagggttttaatgaatcggagagtggaatttaagaaagcaaacaatccaaggaatactccttatttttctaaaatagcaaagcaaaaatgggaaccctttccagtttagttacagcaagtatctattggagttttagaaattcttagagtacatcatttatcatatagaacaaaacttgattaatgaacactttttaaaagtctttttagggtcctattattattttagttgtttagatataaaaatattttatgacatattcactgttaaatttatagtgaattgacattcagtgacatttgtttttaaagttgtttattgaaatatgtagtctaccagaaataagtacggttaccaactactgaaatcaatttaatagtaatttggtcttgttagtctgttaaaaagaattattggccttcagatatttccacaaagccctttgttactcatgaatcccatcaagatgctatgaataaagactgtgaatatca

SEQ ID NO: 397819 - DNA, 254 bp, Homo sapiens
ctgctctagaggttccgtagggcgggaatatagcatggatcttcgtaccaagagcaccggtggagcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagcttgcaccccttccct

SEQ ID NO: 397820 - DNA, 692 bp, Homo sapiens
atgtggccctttaagcccggcgagaaacctttgattgcttttctagccgcagcctccggcccaaaggttttcggaagcaaacggcgtgggtgacatcaatagtaagggagcgttgaatccctagatgagattgcctggtttcatccgaagtctggctcccagccagaagtttgagaggcaggataagaataatctgtcctttccctgcatccccggttctgcctcttcccgcagtaggtgacgggttgccccagctgagtacgtcgagttgtttttggctatgacttgccgtcctgcatttttctgagcatgtcagaacagagcctgcaactcattactgcctccactagagaaaaagtgtagtgtggagacttagggagaaaccattaatttcctgaatgttgaaaagaggcacaggagagtggtcagatgcaaaaagaacagacttaaggaggtggttttttgttttttggggttttttttgttttttttcagcaacccagaaaacactgcactcatcaacgccctagaaggcagcacagagtggattttcagtcccagcttggacacttagcaagtcactctgagtttaccactgataaggcccacttcccagggttataataagaaaggaatgaagaaaatatatgacaaggtacaataaaatactttgtaagttctcaagtatcatc

SEQ ID NO: 397821 - DNA, 285 bp, Homo sapiens
tcccagctcatgtcatcccagccacctgcagcagtgccctagggccccatccctctgcggatcatgctcttgggccacctcctccaagaagccttccctgacctccctcctcccagctcccaccacaggcagaatctgggcttgcagttgtttcaggaatggaagccccattcccaggtcctggggggaccccaaggcaggaggtgggcagagaggggtcctgcgaagcatagaggagccctgagttgctctggggtgggcgagggcttccgggtgcgtctgcgt

SEQ ID NO: 397822 - DNA, 290 bp, Homo sapiens
ttgctgtttctaacattttagcacctttctggcctttttactatgcttgtttaagatgttgagaccatattatatgtacagatttgtatcctgcttgtttttgattttcaatatgttttatgtcactgaagacttttcataaacatccttttaaaaaactgtgatattccgtcatatgaatatgtcactttttaaagtcatttccaaaattttagcagttactttgtacctgattgttttgctattataagtaatcctgaattaaatatcttttaatatttttttcatgt

SEQ ID NO: 397823 - DNA, 261 bp, Homo sapiens
atgtatgctttatataggtaggtgaaattttcggtttcaacatgtcttaaaacatattaaagcccatgcacatagacctgacatgttataattatctttaggcatatagaaaatgatttgagtgattcagctctgatttgcgttaacaataatgaacaaaactgtggcccagtgtggagagagagggttgagcatggcagagaccagaaatagcagggatcaatttttgcggagcctttaagacatattactggtgtagac

SEQ ID NO: 397824 - DNA, 395 bp, Homo sapiens
taacatgatggatgtcacaaaatctctatttgaacagttctataatgttcaaggaagcaggtaaaacagagcaaatgtgtgaatagttgtcattttaggggtgaagggaatttttttcccccttgaaggtttgaatctgctgaaataaactgaacagaaatcaacaggagaaaaggcatacccatgtattaatgtgcaattgtgcacgggagccatacaaaatatgagactctaagaagggtcagggagttgaggcttaaagaccattttcatgggggaaagagatgtaggcagttttgagggggtggtaaatgattcttaggagaaatgaatgagcccaaagaacagacagtggcctgagtcagagttcctcttagcgctggtggattgtggga

SEQ ID NO: 397825 - DNA, 476 bp, Homo sapiens
gttttttttgaaaaaaaatgcatcacatttttgagagtctgtcacttgaaggcatggtttagtctaatcttggtttatctcaaatgtaagttcagaaattgtggatgttacagcaagacataatttgactctgaatcagcaagtactttcaaatattcagaactatctggaagtgaaaacagcttcctctgtagacagacagcaagtttcttatcccagaaccctgtagatagaccatctgtgaaagttataatcaggagattcacaaatgtgataatgatgacacagtcacattgacaatgaggcttttagtcatacagattaaatatgtactctattgtgcaaacctcctagtaattgagaataaacttaatcttgggctacaagtaggtacaaagtattcccagttagattttacatgtatacattttgaaactattacttttttaaaaataaagcaatgacttttttaaatt

SEQ ID NO: 397826 - DNA, 519 bp, Homo sapiens
tcacacacacacctgatccagtcactttcaaataaagcatgtgacaagcccacggtcacttcctgcctcaggatcgttgacccaatttcataaggttttcaacagctgaataaaggcaaaatatgttttattttagagtctcatttagaatctcttgaatactaccaaacaggtaaatgagttaaaaatttaatttctaagataaccacagctctagattctgtatgggatagaaagctacatccagtgacttctcatcactaccttaataatactagactattccagtgggaagtatcagtgattatatcaactgtttcttatgaagtgtttggctgtgtcgtcataccatgaatttcaaatggctcatcccatctacaaccaagagaacaccctgcagtcagcattacagaatatgatggaataatttgaatgtctaatagaaatctcaaatgctccaccctgaactggccatgatatatttaaattaaattttgaagctcataaacaatttagaaa

SEQ ID NO: 397827 - DNA, 471 bp, Homo sapiens
catggtttaaaaaaacaaacattgatttctctgcttcaggagtttcctttcctatggtagatgaaactaggtacaataatttgttgtttgttttggagagctgtcaaggcatgctccatggcctctgaaactaggtagattgtatcacatacactccagaccaacatacttgctactttctgatttgattggattaacacgatgtcaacaatatagtggaacaatgtgatattcttgtcaggtacagtctctttggactatgtcagacaaatggcatgagagttaacatagtcctcgagctaattcataaatgtatattgttaccattttacataaatgtaatcgttgatgcccttattttctcagaggggtgggggaaaattgctattcccacattaatgtctgtatgttagtgaatctgagtgagtgccaatctacttgagcaaataaacatctggaatagcagctgta

SEQ ID NO: 397828 - DNA, 554 bp, Homo sapiens
cctcccaaaggtgtgagccaccgagactggcagacctgccaacttctgttaagccttctgacacctgcagccctgaccaatgtcttgagagacccaaagctaaactacctacttaagcggcccctgcaaacctgacctacagagactataacaataaatgtctgttgttttaagccactaagttttggggtagtttgctatatggcaatggataatgcagcgtggctctggaccaggtgttctcaccctgcctctggcaatacagcttgtcctcctgtgaaacaacttcctactactgctgtctttggatgtctcaatgtcccctgttgacttcctttatcctgtcctcaaccctttactaaactctcttcaaacttcacaatggaatatgttgcctgcttcctgcctggtgcaggttggaattatgaacaagacagacacccttcccttcagagtttatattctagtggggaaaacagacaataaattagccaacaaataaataagcaaggtaatttcagagaccagtaagtaaaacagagaaacgaatggaa

SEQ ID NO: 397829 - DNA, 520 bp, Homo sapiens
ttcatgggtaccctgtcatttttaacactcacattggcctcaaccaagccaaaagttaattgctatccctatctacctcccaaacaattttagtatgttgtaattccaatcctattcctcccagcttctattttatggctgtatttttgttccacctactatttcaaaaatctcttaaatgaggccgggcatggtggctcacgcctgtaatcccagctactcaggaggctaaggccagagggtcgcttgagtctgggagatcaatgctacagtgagccatgatcacaccactaccctccagcctgggtgacagagcaagaccccatctcaaaaaaaaaaggggtcccattttggaagggggccttaccgggaagatgtgtacacacatacacacatttgtgtccggagacacacagatttgtccatatgtgggcatatggatatataaggcaggagtggcacttgtaggcactttttatgcacgagtagacttgcttgcttggggccagttttccatact

SEQ ID NO: 397830 - DNA, 422 bp, Homo sapiens
ggaaggatatagaatagctcacagattctaagggcctgctgagaaccctcacatggatgggggaccagggattcaggcagtaggcattgatctcatcacatcccttgctgggctaaaccagcttcgtctttgattctattcttgtatctctcccttttaggatttgactcccaagactcactgacccagcttggacctggtgcctctcctgtggctaggaattcagggaaaaacatttgattgacagtcccattatggctaccctcaacaggagagaggaaattttccaaaagcaaatcaaagtgctcttgccataagaaggaggaaacggatgctggctgcctaaagagccctacctggcccactagagcatgcaagccacatgttgggcctcctgtgaggagcctctggctttgcttcct

SEQ ID NO: 397831 - DNA, 1020 bp, Homo sapiens
gtgtgcggggccaccgtcccatacttgtccacctcgggcatgttcatgtcgtcgatgaagtagacgagcttcttagtgcctggcggccgtagttcctccccgatttcttctccagcggcttctccagcacccctagagagggcagagggtcagctgcccgcctgcgcctcctgagccagagcctgttagccctaccctccagcactccaaggcaggactcgcctcacttctggcgcctcctgctgcctcctccatacctcattgccatctggctctgccctcaacacgccctgaagctgttctccctgagtgatggaggtgcgcctagctcccaaatgcaatgggaactcttctgtccttggcttgactctgggtgccatcctactgaggaaatcccttactctgtcaatcaccagccacgtgtccaagcccgaaaatatgcctctggaatcaatatcaagtcttccatttctccagacttcagatatttcttaaacccatcccttcctctctgatccctagaggcccccatcttgctggcatgaccagctgcttttccctcgtcacattggaaagggacacttgcaccttggcccagcatcagcgccttcccgtcaggagcagcctccgcctttatgctctggccaggagaacccgaccactgcccatccggcaatgccccactccccaccatgccctgtgaacgcgggttcttgtctggtgtgcttctctgttttcaccccttagaggcagcctgaccctttggatggcagcccaaacttcaatcacctgggaagacttcccacctccacagaggccaagacctcccttcccacaccagcccttgttccctggcactttgtgcaaacatccgtttgctcagctgccctgcctcgtgtcactgtgaatttacaccatttattcccaggtctctcaccccttcactgctgtgacactggtgcctggtgagggcctgatacacagtttgtgacatgaatgatgaatgaatatgcaactctg

SEQ ID NO: 397832 - DNA, 1272 bp, Homo sapiens
agagcctcagagggaaccagcactgcctactccttgacttctggcctccagcactgggagaggataaatgtctgttgtttgaagctgccccattagtggtcattgtttcagcagctggagaatgctgtataagcaggcaagtgttgctggagaagccggcacagaggcacccaggctcagcagctcctggccctgtccccatagggaacattccacttggtatccctctcaaaccctggccacactgtgctgcctgcctcccagcagagggtctcacttcccacgcagagagcaaagaagtgcaccagcatgaactccggaaacttaattttctctgcctatagacttgcatgcacctgaaaacagccatgcctgcatcccatggccaaacatcattcttgtctcgacaaatactacaaagcttcattcctcttgttccagccctaccctccagcactccaaggcaggactcgcctcacttctggcgcctcctgctgcctcctccatacctcattgccatctggctctgccctcaacacgccctgaagctgttctccctgagtgatggaggtgcgcctagctcccaaatgcaatgggaactcttctgtccttggcttgactctgggtgccatcctactgaggaaatcccttactctgtcaatcaccagccacgtgtccaagcccgaaaatatgcctctggaatcaatatcaagtcttccatttctccagacttcagatatttcttaaacccatcccttcctctctgatccctagaggcccccatcttgctggcatgaccagctgcttttccctcgtcacattggaaagggacacttgcaccttggcccagcatcagcgccttcccgtcaggagcagcctccgcctttatgctctggccaggagaacccgaccactgcccatccggcaatgccccactccccaccatgccctgtgaacgcgggttcttgtctggtgtgcttctctgttttcaccccttagaggcagcctgaccctttggatggcagcccaaacttcaatcacctgggaagacttcccacctccacagaggccaagacctcccttcccacaccagcccttgttccctggcactttgtgcaaacatccgtttgctcagctgccctgcctcgtgtcactgtgaatttacaccatttattcccaggtctctcaccccttcactgctgtgacactggtgcctggtgagggcctgatacacagtttgtgacatgaatgatgaatgaatatgcaactctg

SEQ ID NO: 397833 - DNA, 760 bp, Homo sapiens
gtgtgcggggccaccgtcccatacttgtccacctcgggcatgttcatgtcgtcgatgaagtagacgagcttcttagtgcctggcggccgtagttcctccccgatttcttctccagcggcttctccagcacccctagagagggcagagggtcagctgcccgcctgcgcctcctgagccagagcctgttaggtagggaggggcgctacctgcttccccggaggacagaaggtgggacctggctgggatccaagtttaccaaagccctaccctccagcactccaaggcaggactcgcctcacttctggcgcctcctgctgcctcctccatacctcattgccatctggctctgccctcaacacgccctgaagctgttctccctgagtgatggaggtgcgcctagctcccaaatgcaatgggaactcttctgtccttggcttgactctgggtgccatcctactgaggtgatcagcccgccttggcctcccaaagtgctgggattacaggagtgagccgctgcgcccggccctggatgccttttatgaaccaccaggctgaacccttctctggatcacgtttgctctggagacacacaggtccctggagcgggtgacacacctgagatttgccgctgcccgcattcccgacgatgaacacggagtggcggacctgcagcagctcctccagctgcaccaccttcagcacgaagctgtcctccgcctgcagcttgagctccacgatgctctgcttgatgatctgggga

SEQ ID NO: 397834 - DNA, 574 bp, Homo sapiens
cgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggagg

SEQ ID NO: 397835 - DNA, 2695 bp, Homo sapiens
  misc_feature (768)..(768): n is a, c, g, or t
tctctcatctcttagctcccctccaagcctggggggcagtggtgtggagaagccacaggcctgagatttcatctgctctccttcctggagcccagaggagggcagcagaagggggtggtgtctccaaccccccagcgctgaggaagaacggggctcttctcatttcacccctcccttgctcccctgccccgctaggactgggccacttcgtggtgtggggcagtgggtcccgagataggcttcacgactgagaatgtagagaactacaatagcaaagatttctattatgaaaacatacaaatagagaaatagaactgaaaggaaaccatacacaaatatgataaaagaatgatagcaaaatagatgagagagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggnccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgtagtacaaacaataaaaattctcattccgcatcatcatgcggtccatgatgatgaggccgcaaaaaaaaaaaaaaaaaaaaaaaactcgagactagttctctctctctccctcgtgccgaattcggcacgaggtgtaatcccagctactcgggaggctgagacagaagaatcacttgagcccaggaggcggaggttgcggtgagcagagattgcgccattgcactccagcctgggcgacaaagcgagactccatctcaaaaaaaacaaaaaaattagcatttacggaattctgaaattttgggctattaaatttctacatcatctaagtgccctcttggcaatctttcacatcctctcatggcatctgatccagaaggctcaaacctgatctgagtactagtgtgttcctcctactcacttctgtttctattaactaataagtgtagtaatgaaagccagtattagggacaaattttacatgactttcttctcaaacctggacctttattgaacctctgcctccctttttcattagtatgaaagtatgtatcttaaagggttgctctacgaattaaatggatcagtaaatataaagaaagcgcctagcaaagtgcctagtacaaaataaacgcccaactgttattgttactattgttttaaattctagtttccttaccccttaacatacattttcagttatacaaaagttgaacgtttccctggagattgccaaaattctctgaacggtttcaagagatctgtcctattcttcacctacacacaaaaaagtactaatcatcacacacaggctacctaagccacctgaccttacctcccattagctgtccctgtaccatctaactaaaatgtacagatacatacttgtggccaggcacggtggctcacgcctgtaatcacagcactttgggaggccaaggcaggcggatcacctgaggtcaggagtttcagactagtctggccaacatggagaaaccccgtttctactaaaaatgcaaaaattagctgggcttggtggtgcacacctgtagtgccagctactcgcgagactgaggcaggagaattgcttgaacccgggaggcgggggttgcagtgagccgagatccggccactacactccagcctgggaaacagagcgatactctgtctcaaaaaaacagaaagacaaaaaaacggatacatactggaaccctgaaaactttttcagtagcatttagaccttctctcatatacagcattgtaaaatccattgctttgcttttagctgcactatgtgccccaatatcatcaaatggcatttggccttctctttacagactgaaaaggcacattacagatcttaaatatgctagtagtagatcaatgggcagtgtgttattcagaatacagtattctgtgatggttttctaatctcagtgacagtaggtggttaaattaaatgtttatggccaggtgcggtggctcacacctataatcccagcactttgggaggccaagccaaggtgggcagatcttttaaggtcaggagttcaagatcagcctgaccaatatggtgaaagcctgtctccactgaaaatacaaaaaattagctgggtgtggtggcgcacccctgtaatctcagctacccgggaggtagagtttgcagtgagcagagattgtgccactgcactccagtctggacgacagagtgagactccatctc

SEQ ID NO: 397836 - DNA, 2674 bp, Homo sapiens
  misc_feature (3)..(3): n is a, c, g, or t
  misc_feature (6)..(6): n is a, c, g, or t
  misc_feature (134)..(134): n is a, c, g, or t
  misc_feature (747)..(747): n is a, c, g, or t
ggnacnaggcaggcggcgaggagagcggtgccttgcagggatgctgcgggcgggagcaccaaccggggacttaccccgggcgggagaagtccacaccgggaccaccatcatggcagtggagtttgacgggggcnttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggnccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgtagtacaaacaataaaaattctcattccgcatcatcatgcggtccatgatgatgaggccgcaaaaaaaaaaaaaaaaaaaaaaaactcgagactagttctctctctctccctcgtgccgaattcggcacgaggtgtaatcccagctactcgggaggctgagacagaagaatcacttgagcccaggaggcggaggttgcggtgagcagagattgcgccattgcactccagcctgggcgacaaagcgagactccatctcaaaaaaaacaaaaaaattagcatttacggaattctgaaattttgggctattaaatttctacatcatctaagtgccctcttggcaatctttcacatcctctcatggcatctgatccagaaggctcaaacctgatctgagtactagtgtgttcctcctactcacttctgtttctattaactaataagtgtagtaatgaaagccagtattagggacaaattttacatgactttcttctcaaacctggacctttattgaacctctgcctccctttttcattagtatgaaagtatgtatcttaaagggttgctctacgaattaaatggatcagtaaatataaagaaagcgcctagcaaagtgcctagtacaaaataaacgcccaactgttattgttactattgttttaaattctagtttccttaccccttaacatacattttcagttatacaaaagttgaacgtttccctggagattgccaaaattctctgaacggtttcaagagatctgtcctattcttcacctacacacaaaaaagtactaatcatcacacacaggctacctaagccacctgaccttacctcccattagctgtccctgtaccatctaactaaaatgtacagatacatacttgtggccaggcacggtggctcacgcctgtaatcacagcactttgggaggccaaggcaggcggatcacctgaggtcaggagtttcagactagtctggccaacatggagaaaccccgtttctactaaaaatgcaaaaattagctgggcttggtggtgcacacctgtagtgccagctactcgcgagactgaggcaggagaattgcttgaacccgggaggcgggggttgcagtgagccgagatccggccactacactccagcctgggaaacagagcgatactctgtctcaaaaaaacagaaagacaaaaaaacggatacatactggaaccctgaaaactttttcagtagcatttagaccttctctcatatacagcattgtaaaatccattgctttgcttttagctgcactatgtgccccaatatcatcaaatggcatttggccttctctttacagactgaaaaggcacattacagatcttaaatatgctagtagtagatcaatgggcagtgtgttattcagaatacagtattctgtgatggttttctaatctcagtgacagtaggtggttaaattaaatgtttatggccaggtgcggtggctcacacctataatcccagcactttgggaggccaagccaaggtgggcagatcttttaaggtcaggagttcaagatcagcctgaccaatatggtgaaagcctgtctccactgaaaatacaaaaaattagctgggtgtggtggcgcacccctgtaatctcagctacccgggaggtagagtttgcagtgagcagagattgtgccactgcactccagtctggacgacagagtgagactccatctc

SEQ ID NO: 397837 - DNA, 217 bp, Homo sapiens
aattatatattaatattaatattaataattatattaatgtaaataatttaaatagttcaattaaaaggcagagatagtaggaccggatttttttttaaatccaatcttaaccgggcatggtgacgcctgtaatgtcagcactttaggaggccaaggtgggaggatcacttgagcccaggagttcgagagcagcctgggtcttgttatctatgcttta

SEQ ID NO: 397838 - DNA, 234 bp, Homo sapiens
ctgattgctaacccaataatatttcagcgatatcaagcttgtacgataaggtttttttagtaaatatttaatctctacattatttttcccaaatagtctagtcagatataatgtgagagccctggtaatattggaaagggtcgttttgaagtgattagattttatatacagctttgttgatagagtaaagattacattgtgggaattaatgagatattgcgattaattggaagt

SEQ ID NO: 397839 - DNA, 558 bp, Homo sapiens
tgttacaaatgtttatgaaagaaaagcccaatataaaatgagcccatgaagccaagagaaagacctaacctattttgtggcatcaaggaaggattcctcaaggaaatcacaactaagcaaaacaaaagcatatgcaaaggtcttgagtagagaaaactgaaaacagtagaaataatgaagaaaagtaacaagaggtaaaataatatatgctatttgtaggagactgatttggattacaaaatcaaaactccataggaaggcaggaggggtggaagcagccctaccatttggaaataaaaaataaaagtctcccaaacaagtcctgaaacaaagcttgtcccactgtcctccctcagtaaacaccagtcattctaatcttctgtcaaattcaaagtcaagtcaagcactttgcatatgtaccatttgtgccagcagttctcttcacatgggaaactaccttcaacttcttgattttagaactcagaatcaaagttccaaattttctacacaggacaagctttggagcagcaatccagctggaagatggggaagaggctt

SEQ ID NO: 397840 - DNA, 595 bp, Homo sapiens
tcatagtaggctactccaggagactagtagttcttatattttctagtctatttgaaactaactcaaggatatagacatgctttcactctagtgtcttaggagaaggctctgtaggaggtatgggcctggatcagattaaactaatagcaacagtttctaagaaaactgtcctactgtatgtagtgacctacttgaagttccccttagggcaacatatataaaaggtgaaaagtattatgatttgtgatacatacacaggcttatttagtttgaagtgtttgtactgtttactttgacctattatctgtcataccttttaggtgtgataattcaacttaattttctttaccaagatccacaaaccccaaataattactttttctcttcccatttcctccagggcatacacaaattgcagtgtgttctaaggcattacaaagtaacaaaataatactgttagatttataaaatgagtcctaataagacatttcagggacatgttgaagcatcatcagttgtaagttagcactattaaaggattaaatcttgtaggatgaaggtggagagttaaagtagtaaagaatcttgctagcag

SEQ ID NO: 397841 - DNA, 402 bp, Homo sapiens
aataggtagtagttttccaacagcaggtccatctcttctgtgttagggacaagctaccccaggacctgcccctgcctctcagtgcagctgacccctacgctgaatactctgcagctgcattcctgaacccttatctaggtgctccagcaaggtcaccagacttgcttacagccctccggctggcacgggggaggtcacgagaaacgtggataaacctaagtaacaccctcttgtaaattcctattttcacaagataatatattgtaagccggtcacgagatgctatgtggtaaagttaaccgaaaaacaaccccagggtctctttccccaatataaacccctcattttgtaagctcagggctgcctcctctgactgtagtggagcagcctggcaggttaata

SEQ ID NO: 397842 - DNA, 388 bp, Homo sapiens
ctgccatgcctggccccaactggtattctttaaggctcctctcccacatgccctggaaggtggggagagggatcactcagggggagtgggaagagcccggctcagggcctgacaacagacatgaacaagtaattcataaaataagaaataccaatggttaccaaccatcagataaacggaaacagacacaagatatcattttctactaccacactggcaaagaatagaaagattaacaaagcccagattggtcagaaacaggcattctttgtagtcggtaccctgtgtaggagccaagttggtactatgtagcagaatgataaacatgcaaccctctgcccctgcaaagagatattgtgacaaagatattcactgaagtgtgtttata

SEQ ID NO: 397843 - DNA, 521 bp, Homo sapiens
tgagacaggctgtcacccaggctggagtacagtggcacaatctcggctcattgcaacctgcgcctcccgggttcgagcgattctcctgcatcagcctctcaagtagctgagactacaggtgcccaccagcatgcccggctaatttttgtatttttagtagagatggggtttcaccatgttggccaggctggtttcgaacgcctgacctcgtgatctgccctccttggcctcccaaagtgctgggattacaggcgtgagccactgctcctggcaaaatgctgtttctaagcgtttctttgacaagtcccatccttcaggttcatgcatgattagggagaggcagcagccctgactgagcacctgagtgttcatggaaccaggtgcatagcgtaatgacatgccattcatgacactactttcttccctgaacatgccatgaattcctgatgattacacagttccccaacaagtgctgctcaaaacctggaactaatcagaaggaagcaccagccttgactgtt

SEQ ID NO: 397844 - DNA, 670 bp, Homo sapiens
attcaaactaaatattgtataacaacttttctgcaagcttgaaaaatctttgaagtagaagctaggaccaagttaaagaatacatgcatgcaacaagaatctctgcataattatgtttattattgcaagactgagccacaatttggctaagatttctagcagccaggggggataacggaaagcctagttatgatgactgtcatcaagagaaggaaacatggcacttaagaaaaacaaagttttgcttagaaatgaattataaataatttcccctgggactgtttagtaaactttactttggaaactctgtataatctcaaatgcaattttcatgtacttttttattttgaccacttaacaaaataagaagacataagattactaggaaacagcctgctggttgtctgagtcatagagaatatgcactcaacttaccctattgtcaatcgtgtctatacttggactatgttcacaaaaatttgctttctcactcaaagttgggttactgatgggcacaattcagatatcagccctctggaaacttctgacacatttggtcttatagaagatacgaaaagaagaaacaacatatgtataataaaaagaaaatccaagtaatgaagttagagaaatatgaaaaaaatctataattaaaaacaaactttcctaa

SEQ ID NO: 397845 - DNA, 504 bp, Homo sapiens
taatgctaaggattctctgttttgcataggataaaattcaaacttctaaacttggcctacggaccccctatgatttttagcctcttccttgcagtttctcctgcccctctgtgaaccaggtcatcttggacctgagcctgtacatgcaccctctccccctgggagacttcctcactcatcattacctgactgacttgtcaggaagagacaccctttctatccaccttgcctaccaccaatcactgacctaggttccctttctatgaatgccagtagtgccccatatttacctcatggtaaatttacattatgggtttatcactctattctactttgattttcatgcatttgtctagcccaagtaaactgtaaactccttgaagataggaaacggagtcttatttgctgttatatagttcctgctatagtgcttagcacataacaggctctataaatatttgttaagtgaataaataaatgaatgttttaaggaaaaatgtaaaa

SEQ ID NO: 397846 - DNA, 413 bp, Homo sapiens
ctatcggtaggaatgtggaagttgaagactcagagtgcagaaagaaacaagtagcattttagagaaaagctaaatcccctccaagaatacctcaatcatcgtgaaaagcctgttagtagacgcactaacactcaaggcactgcttcacaaggtaaggaacgtgtaattgaaaacttgagaaaggaagaaacttgttctgtactggcagaaagcttagcagaattgtgtcctgcagtcatatgggacacagagcttgtaaatgatgaatttgaatgcttatccgagaaggtttccaaataaaatgtggaaggcacggcctggtttcttcctgcctcttatagtaaaatgcaagaggagagagagaaaatgagggatccgtgaggttgagtaatccgttaagcggtagcgagctc

SEQ ID NO: 397847 - DNA, 223 bp, Homo sapiens
  misc_feature (208)..(209): n is a, c, g, or t
ctatcggtaggaatgtggaagttgaagactcagagtgcagaaagaaacaagtagcattttagagaaaagctaaatcccctccaagaatacctcaatcatcgtgaaaagcctgttagtagacgcactaacactcaaggcactgcttcacaaggtaaggaacgtgtaattgaaaacttgagaaaggaagaaagcaagaaaaagacaaagnnctaggccggcaaaa

SEQ ID NO: 397848 - DNA, 367 bp, Homo sapiens
cttgccttaccttttactctccctcttgccctgttatattgtattcccaatagcccatatacatgagcacaccctctttagctatgttacacagatctcactctctagtttgaggaccaactatctaaatgaacatatctaaactaacttttgagtgtcttactctaccagcacggcctcttattggccactaagagagcaggccaggccaaggacattaattaccaagcccttagcttacagccttttctagtgcttttgtttattcttcatgtgtctattgaatatctaatgatggcttggggatgttcttgagaaactcattttctttagaggcccattttatcttcctgtgctgtaagtaact

SEQ ID NO: 397849 - DNA, 1015 bp, Homo sapiens
ctgtgttttattttacaaagtctagaaactgcctcaaaacagtaacaacttcatcttcagtaagaccctcccaatccccttccgtcttaaccttaactacatctgcctgtgggtccccagatttccagggccctgtagcttttctcagtataaaggcttcttccatggctggggtgagcagcctgagacatctgcaggggaggctccctagaaagagctgggtctttaataatctcctcccagggtgagagaggactgaaaacttacaggaaattagctctgataacagacccccttttcccacagctgccaccccaggattcccacccactcacaaacatacccataaattgatgtgtccacactcctcccaggactaggcaccaccctcaggtgatctacctgcctcggcctcccaaagtgctgggattacaggtgtgagccactgcgtccagtgtctcagttttttttttttttaggtagacatatcatttagaatgtgctagagcatcctctataaggggatctctcctttggttgtacctcatttgctgtaacacccaagaatgcagagctaggttgatgccacctagaatctgcacataaggtttggcctctgcctgggatttacaatacagggccagacttaggattgagaatgtacagaaaaccaacaggaggcatgttctgcattgtgagatgtcaacatagacatcttaaagttcccttttgagagtatggcttcttgagcttttcagatcttgttcagtgacctgctacagttatgtgagaggcaccaggtatacatagaatctcatgggagaatccctaagtgtaaacaagcatcttaggagtgagagagcaaggccacagagtatccaaagccatgaccacagctgtatctacctgtaaaatgtggtactggagtattcttgtccttcctcttacccagagctagctcatcaggacaggtgatccaaattctggagctccaccagggcagtttcattgtttt

SEQ ID NO: 397850 - DNA, 284 bp, Homo sapiens
aacactttttaaccagcttttctgcggagcagattaacagagctcctcttgctgtcatgatggaagttgatctctgggaagtatattttctatgtgaaatctacacaaaaggagaacaaaaattgggcaaaactagcagtctgccacaataagcaataattgaaagcccattggccaaatgtcagtagaatcttttactgagaacttctccatatatgtatctttgccttcttctcagtttttcatagctcttttatctttcatccctttatgttgtctctttc

SEQ ID NO: 397851 - DNA, 486 bp, Homo sapiens
ccttcccttcaaaacctaatagaaacttgggtggctagcgatctcagctctccggcagggggtgcccacagctccttagctgccaggagcgcccaagtttaagaaaggaaagaagctcaggtttccggagtgcctgctgtgctctaccaggcgctgtgtgaagtggggtgggcagtaggaggtgccaccactgcttcatacatgggcagatgggccttcaggttctttctagacagggaggtaggaggtgggaaggagagaggagcaaggcagtggccaaaaccttcccctactggggttgaacagggggaagaaaggagaaattgtaaatttaaattcagattttactacttcttatttatgtgatcttgggcaaattactagctgtctctgaacatagtttctcatctataaaatggctgtaatcatttgcttctcaaggtgattgggagaacaaaataaattaatatacatgaaagtgactaa

SEQ ID NO: 397852 - DNA, 656 bp, Homo sapiens
taactgtatctcactcactcactcactcacccactcacgctcattcgtttagagacagggtctcactcagtcgcccaggctggagtgtagtggcataatcttggctcactgcaagctctgcctcccaggcttcaaccaccttggttgattcttttttttttgggagatggagtcttgctttgttgcctaggctggagtgcagcgacacaatctcggctcaccgcaacctctgcctaccaggttcaagcaattctcctgcctcagcctcccaaagtgctgggattacaggcatgggccaccccccccggccccaaaatatatttaacttcctgtcttcctggacgaaaaagttattctcttacctttccatgaatatacacttggtttgagatttcctcgtcttacacttcttatttacaggacttagggagcctgaacattctgtactgaggaaacagaacagagggctggatattgcagaagtccatcttgccttcataatggtgctcttatggtataagtgatgaattcatctgggggtggagtgagggagtgggcaggggagattatcatggatttactaccacttatagtgccaatatgtttaaaaaaaggaaagactttggggcctcagccaatttttaactttggatgaa

SEQ ID NO: 397853 - DNA, 521 bp, Homo sapiens
tgaaggtgaaaaaccgtatgattatctcagggaccacaggaaaaagcatttgacaagatccaatgtgataaaaaaaaatctcagcaaactaggactagaggggatcttcctcagccagataaaggcatgtatgaaaaaccctcagccagccaggcatgggccaccccccccggccccaaaatatatttaacttcctgtcttcctggacgaaaaagttattctcttacctttccatgaatatacacttggtttgagatttcctcgtcttacacttcttatttacaggacttagggagcctgaacattctgtactgaggaaacagaacagagggctggatattgcagaagtccatcttgccttcataatggtgctcttatggtataagtgatgaattcatctgggggtggagtgagggagtgggcaggggagattatcatggatttactaccacttatagtgccaatatgtttaaaaaaaggaaagactttggggcctcagccaatttttaactttggatgaa

SEQ ID NO: 397854 - DNA, 643 bp, Homo sapiens
gttgggtttttctttactctcttattttaaaattaactttattgttttaaaaatacaaataatttatctagaatctcataatagaaccgaattatagaacataatgcttactaaagtgcatttagtagactttatttagaacatgatgttttcataattcacaatataaagtaaggaaggaagtcttgctctctaaatattagtgagacttgctctcttaatgagataaagcttcttcccttaaaaatgtttcatgtttcttttggatacattgaacaaatttttcttttgttctgattcatatacttatgtaacaaggaaaaaaatctgaagtatgttgttttatttacagtagcctttttgaaattggatttttaaaaataattgcaggattgcttttcattgatgtagctaatgtgtagttacgttgtttctcgtaagtgtaattaggtaagctaaaagaaaaacaaaaaacctttcctcctcactaagagacttttgtcagtttttttaaaaagttttttaaatttgcaaataaagtatgtataaaacacaaaattacatttcttatattaaaatatgcgctatatctaaattactaatattgttataaaaatgtagcaattaaaatgaattttagact

SEQ ID NO: 397855 - DNA, 742 bp, Homo sapiens
gttcagttttcacatctaaagaatgttgataacaataactactgttttgaacacagaatttattgatgattaaacagtatttcaaatacttcatcaaacatgtgaagtcccaatagttgatagtttttattattctgtgcatgattaacaatgacaataatatgtattgttctgattagctatagctgagtatatagccacctaaaaatataatggctaaaattgaaaacggttgtatcacacttcatgattccaagggtaggcccgagctcaactgagtattctccttcctggcctcatgtgaggtcttttctgtgttccaatcagatggtggctgtgactggagctgcttaactctcccctgtgtgcacccatgtgccccttctccacacagcaagttaccctccatggccttgtcgtgtggccattcttttgggcaaactagcctgggtttcttttatggtggctgttatggaatgaatattttactcccctaaattcatgtggtaaagcctaaattcccagtgggttggtaaggtagacctcccttcttcctgggaaatgtgtctcaaggccctagtgaatacttgaaaccgcagatactaaaaaatcatatatttaatgtgattttttttctatgcacatgtacctatgataaagtttaatttgtaaattaggcatagtaagagtgtaacaacaataattatttataaaataaaagttattatgttgtattgtcata

SEQ ID NO: 397856 - DNA, 343 bp, Homo sapiens
caaagtgacagaaccttcctcatcagcaattaaacataaataaactctccaatcaaaagaagagattgcagaattgatgggaaaaaacaagatccaattatatgctgcctgtaggacactcactttaaagatataaaaaagttgaaagtaaaaggatggacaaagatattccatgcaaatagttgctaaaagacagctagggggtggcaagactagtcttggataaaaaaggacacggtatattgataaaagggtcaattcacccagaagatataacgattataaacatatatggactaaaaacaaaggagccctaaaatatatgaaacaaacattgatagaa

SEQ ID NO: 397857 - DNA, 211 bp, Homo sapiens
actagcgctggtaaacatcttcctctaaataactgtctctcatctcttccatctctagcacggagttcatctaactcatcctctttcagtctctccagctcattctggagggcctgtttggatatttccacttcaatcatctgctgtcggagagtttcgttttcatcctcagctttagcgcgcttttcctccaccgtcttaagttcgtggt

SEQ ID NO: 397858 - DNA, 508 bp, Homo sapiens
ccagagtaattaacttattcaacaaatatatattagacatatgtcatatattaggccttatggtaggtggtgaggtgacagcagtggccagttcctcccagtggtgaaacacaacacttggggaaacccaggtgagcaaagtgaggctcgcaacacagcagcacaggtaggtatgctcacaaaccaccatcccgagggaaatgtgcagaaacagtaaccaacattgagatttcaccgtgcataaagagaaaacgatttgaactaggtacaggtaaagccagttaagattatttttttaaatatattttaaggataaatttaagactcatgaggacattttctagccagcaaagcacagacaggctggtattgtgggtctgatttaacaaaataaatatttgtggctggttcaattatggtaaattattgtttctcaagtgcctgagtacaaactgtgctatcacgtaggtgaaataagcccttcccttggggatctggctctgatatg

SEQ ID NO: 397859 - DNA, 184 bp, Homo sapiens
gagacagagattgtagtgatgcgtctacaaaccaaggaatgccagggctaccaccagcagcgaggagagaggcatggagcacactctccttcagagcctcaagaaggaccaaccctcagaccccttgatttcacacttctagccttcagaactgtgagaaaataaattcctgatgttttaagcc

SEQ ID NO: 397860 - DNA, 315 bp, Homo sapiens
cccatggggacaaaagttggagtccaggactaataaagggtggcagcccttctatatcaccctcggatttggcctaggactttaaaaccctgcattgtaggtataagggagtacaagtaaagtaactctcatgtagactgcagactgaattcaaatcatctaagtggcccagaaaaatctcaaggcctgaacttacattaagttgcccctaattgctagtggcaagagtaaaaccaaatccactttggagaaaaaataacatcatcccaggcctcaattgtttctgtaattttctttctttcccttccttcctat

SEQ ID NO: 397861 - DNA, 413 bp, Homo sapiens
ggttccactcaaccgatttttgctgcatgtcaacacttattaccggtgagtgtgagggtattttttctccttctctaggtctcttaatgatttctgagctagttgtgtattaaagtgcttaaaggaacctttaacataatctatagcatgagcaccaaccttccccgcttgggttcaaaaatggcgagctcgaggttgggcccggaggcgcccaggcctcactggcctcagcgcactgccgccgtgctccttgagcgctcagaggttcgccaggcctggggcaggaaccccgcgcagacgatccgccgtctgggggctttctccccgccacccccttccatccctcacctgttactagcaggcaccttttcttctctcggtatctttggcctatcctcgggttttgttttatt

SEQ ID NO: 397862 - DNA, 123 bp, Homo sapiens
ggctggatccctcatgaatggcctggtgcttttgtcctcctagtaatgcctgctttttagtatcttgtagcaataagtaatgaagctagaagagttgtctactatagcctccctgagagttcc

SEQ ID NO: 397863 - DNA, 594 bp, Homo sapiens
ctgaactaaaaattcagcttttaactaaaactgaatttagttaaactaaatttttaactgccataaaaatttcgttggtgaaagtagaagtagtaattgtgaagattagtgagacatctaaataatattttaatcctatctaggaatattcttaaatggaactaataaaggttttgttggttttagaactgaatattacagataagtaacctcttttttttttttttaaccaggatcatttatttttaccttctgctgcttgatctgataggtgataacagcctttttatgcctataatgctacaagttgttcatgtcttttgacccagtttaatccagacacttactaatccatgaatggaggaactgcagcatctgtagactgtagtttctttttttaaaagttattgtgactgaacatttccatacatcctataaggagacatattaagtctttgtatacttgaggatataatgcaattattgaaatgctaatgcattttaaccatctaaagagaaagtaataggaaaaaaatgattctgttaaaatagcacattatcaagtatatgaaggagtacctagaatgttatgaa

SEQ ID NO: 397864 - DNA, 203 bp, Homo sapiens
aggatcctctgcgtccatcaggctggagtgcagtggtggtctcgactcactgcaacctctgcctcctggcctcaagcgatccacccacctcagcctcccaaaatgctgggattacaggcacgagccactgagcaaggcctcaagtcacatatgtaatgttaaattttccagtagccacaagaaactgatacaactaattatca

SEQ ID NO: 397865 - DNA, 258 bp, Homo sapiens
agaccccccagctcgccctcacacacagtgtgcagactcctcacaaagagcccagtgtacacacacaggccttcctgagacagggacaggagaggacctgccagtcctggagtgagtgacctgtgccccacagcctccccaacaggtgggccccagagactccttcaaatctgactctctctccaccctggggcgctctggttctttttgaagtggaagagaacagagaacgacagtttaggtgttgggggaggcaaa

SEQ ID NO: 397866 - DNA, 528 bp, Homo sapiens
taagaaaaaccaaagtaggtacacttaataggcatctctaaggtaaagtgctcccccctttcaaaggggccagcctcttttgcacccgagtatctggtggaccagctgcagcatcctcttgggaagcagaagcaggaaatcctggcccacagtcctggtggggttcagaattggccatgccagcaccctgagctatttctgagctcccagccccagccaccactcactatctgagccacctctgccagaaacactgccagtgagtggtaggcagccagactctaccaggcctggggccttcagtgggcctgcctggctcctgcctggagctgacttatgtgtcccagacccactccacacactgaccctccctgctccattgccctttccagccaatcagccaggagctttcttactcttataggtgtggatgtgcaattaagagcttaaaacgggaacttttttactggagcaaattgtttgagacacatttaaaactatgtttaacaactgctagcaaagaaaaga

SEQ ID NO: 397867 - DNA, 489 bp, Homo sapiens
ggacaattatgaatgctgctgctgttaacattttgggtgtttctgtcctttgatataaaaatatacacttatatattgggtatatgcctagtagaattgttggttcataggatatgcatgttaggtttagtaaattctggcagtttttgaaagtgattgtaccagttttacattcccagcaatagtgttaaattccattgtcctgcatttttaccaatacttgctattgtcagttttaaaaatttgtcattctggtgggagtgtaataatatgtcattttggattgaatttgcatttgcttcataaccagtgatggtgaatccctgtattgaacatttgaaaatcttctgttgcaaagtgtgctttattcaaggcctttgtgaaatttttattaggttgtccatctattaaattgtagaaatctttacatattttgagtgagttcttttttgggtatctgtattagagtcttccttagactgtggcttg

SEQ ID NO: 397868 - DNA, 179 bp, Homo sapiens
gtggtatcattcaatcctttcactttttatggatgagaagactgaggtttagagacctaccacattggtaggttaatgatacattcatcaaaagtaacaaccttgttaggaggagttgtttacagaggatatactagtactctttcagttttaactaaagcttccatttactgatagct

SEQ ID NO: 397869 - DNA, 306 bp, Homo sapiens
agtgggctaataatactgcttgtattagttttcgtactagctgttgtgagctctatactagtccctcatgctctctgggcctcctgatttctgtctctgtagacagggaattaatccttctctaacttggctcaccaggcactgtgaggttcacaagaatgaacagaagttaaaatgctttgaaaggaaaagacatcatatgaatagaagagattgttactaaaatttccaaagtcacctggaatcctttctgacacggttcttctaatccttgtcccttctgaagttagaatctgttgttagaga

SEQ ID NO: 397870 - DNA, 424 bp, Homo sapiens
cagacctgtggaactgtactgcaggaaggaaggccttgcagctggtaggtttttcattgcgggtcctgctcaagagccagatgtgacattgtagcaggttctagcctatggccacagaggtgggaggttattgaaccaccactatgctgtacacttgattttttattttattttttgagacagagtctcactctgtcacccaggctgaagtgaagtggtgtgatcacggcttactgcaacctcgacctcctggactcaagcaatcctcccacctcatcctcccgagtagctggtagctgggtgtacactttaatcaggcatgcacaacctactatcttttaaacaaattagttttatctgtgtcatatctcaaaatttggttttctcaagtaaaaaatatcagaatgaactgttatctattata

SEQ ID NO: 397871 - DNA, 423 bp, Homo sapiens
ccagaggaaggtgtagagagaatcctgctcaattttgggaaaagataattaatgcagatgagagaaaaattcaaaagttctagcaatacaaaagagtatatagagaaaaatgtccctcctaccctggccccaagtctcctgtctccctaacctcctccccagagatggctgaagttttcagtttatatggccttccatagacactgttgctttataaatatgtgcctgcttatccatactcctcccaccatgggacgtaccactcacaccttactgggtttttttacttaacatatttaggaaatcattctattatcaacatatatagagagttatttgttctttctgttgacatgcttttacttatttagttgtatggctgtactgtaacatctttgggttaaatatttgtttccaggttct

SEQ ID NO: 397872 - DNA, 380 bp, Homo sapiens
tttctcagttcccccttccccacagtgagagaatgttgtgtttagtaactgaaaattcatggcatatagtaaacctcactaaatgcagacacttttattaacatgtgactgaagggcaggccccctgtgggcctggtcttatccttatcctttttagtatatgcacttcttctccacagtgcatatgctaatactaggtattcaagaaagcaaggtttgatttggatttgcagtgtctcccctaaatgctcagctcctgctatatgcatttcattctgcacaaacctcctcgccgcctgccacatctaagctatgatacaaatattcttcacgtgtgaaattccttgctcactgcttttacctcactgtggccatcttct

SEQ ID NO: 397873 - DNA, 370 bp, Homo sapiens
agttggaggtcttgttataaaccaggttcattcagtaccacacacagcaagttaatcactgagatgatgggtttgtgagagtttattcataacgtggccaagcaaggaggcaggagaacaggtctcaaatccacctccttgaaaacagggattgggggtacttaggcagtagaaagcagggtggtctaaagtgtgggaagaggtgattggtgggtaggaaagatgaggtaattggggcttccacgcaagcataatctagctttgtggttcctcataggacacatgcagaaaatggtggcgtcagcaccatctgagggaggagtgttttggccctctgatgtcaaaagatcacctcttgggcgtacgggga

SEQ ID NO: 397874 - DNA, 679 bp, Homo sapiens
gtaagatagctgtgggtacataactgcttaggaatgcagggctgaatgaagtcactagaattgttaggtgttgtcaattccttgtatttgtctttgtattcccagcgcatggcacagaacatggtatggaaagaaaaaaagaaaaaaaaaagaaagagggaaagacggaaagatggaaggaaggaatgaaggaaggaagaaggaaaaagaagaacgaaaaagaaaggaaggaaagaaagagagaaagaaagaaaagaaagaaaaagagagaggaagggggaaaggagaaaaaccgagaaggatggagggaaggagagaaataaagaagaaggttttcaaagtgtagaagaggtggggggacagattatgcagaaaggaaaagcatatcctggagcatattcaatgacttagaagccagagaaagcaggctcacttaattcaagaagagattacacattctgagtggttttagaaaatggggtagggcaatttccaggtggctttgaacacgttaagatttaatttgggaagtatgatgtgttactgtaactattgtaggcttctgagaggaatattaagatgactcaaatgaatcaagtggaaggaaaaacgtgaaactcaaaggagttaatccaatggaaaaaaacgaaccatactgcaagaaattaaatgaaggcag

SEQ ID NO: 397875 - DNA, 500 bp, Homo sapiens
ttctaggacttcagaatgtaccctatagtgtctagatttattcattcaacacaaggttttttagattcagccatgtttgttgcagttaccagtagttttgtccattttatagctgaagagtatttcattattaatacaacacaaattgtttgtccattttcttgttgaaggtcttttaggcagtttacagtttggggatattataagtaaagatgctataaacgttcttgtgtaagtcttataatgggcataagttttcatttcttttcaacctaggattggaattgttgggtcataggtttcatgtatgcttaattatataaaacaatgttaaacaatttttcctaagtggttgtagcattttacattccaacaataatgtatgagaattataattgctccatattctcaacaatacgtggtactgacaatatttttaatcataaccattttagtgggaagaataactcactgtggttttaatttgcatttccttaatg

SEQ ID NO: 397876 - DNA, 443 bp, Homo sapiens
ttcccttggagttgttttagtgctcttgttgaacataaatgtaaaggtttagttatcaattaaacataaatgtaagagtctattgctgggcctttttggattcattaatctatatgtctatccttatgtaagtcccatgtggtcttgattcctgttggtttgtagtaagttttggaatcaggaagagtgagtccttcagctctgctctacttttacatgatattctgggtaccttgtgaattttagaatcagtttgtcaagttctaccaagaagttagctctttttttccttgttatagatccaaatttctgacatcctgatcatcttaagcccaaggaataagctcagaatggcaatggaagaagtgttgagaatgtcagatgctaggttgggtgtggtagctcatgccagtaatcccagcacttggagaggccagtagtgg

SEQ ID NO: 397877 - DNA, 411 bp, Homo sapiens
ccgcctgtatccagaactgaccagttatagacctctactacctctacttgccttggctccattctctttggcagagacagatgtggagctaccagagccctgggtgaaaggcatacttttgcattcgtgcaggcccttcccacccatttataggtgtaaattttacaaagcctagattcctgtgtgttggcactgggacagtgttgtatttaagaagcacaggacaatatccaaaatataatttaaaaggaaatgcattctttattcatcctcatgtaagtcataacagagaataaacatagataggaactctttaacatttactaaattcccaatttctttctttctttctttcgctcgttctttctttctttctttctttctttctttctttctttctttctttctttc

SEQ ID NO: 397878 - DNA, 523 bp, Homo sapiens
tagagccaaacagaaatgctgctttgtgactttgtgccaaatatccatcagcttgctctgccagcagtgctgggccggccctgtacacgtcacctctgcccccaccagctctctgctctctgaaagccgtcttcttgtgcccttaaagtcagcttgccttttgatacaatttggatgtgtgtcccctccaaatctcatgttgaaatgtgactcccaacgttggaggtggagactagtgggaggtgttggatcatgggggcggctcccttgtgaacggcttggtgcccccacttcgtgatgagtgagagctcactctgttagttcactcgggagctggttgtttaaaagagtctggtagccctcctcccctctctcttgctccttctctcaccacatgacacacacgggctctgctttgccttccaccatgagtagaagcttcttgaggcctcaccagaagcaggtgctgccatgcctcctggacagcctgcagaaccatgagccaaataaacctcttttcttt

SEQ ID NO: 397879 - DNA, 421 bp, Homo sapiens
ttttgagacagagttttgctcttgttgcccaggctggaatgcaatggcacagtctcagctcaccgcaacctccacttcctgggtccaagcaattctcctccctcagcctcctgagtagctgggattacaggcatgtgccaccatgcttggctaatttttgtatttttagtagagacagggcttctccatgttggtcaggctggtcttgaactcccaacctcaggtgatccgccgccttggcctcacaaagtgctggaattacaggcacgagccattgcgcctggctcctagtaaattcttcttttctgtgatgtgtctcttacctctaataatacttttcttcttaaagtctacttcattaaaaatagttatgctgggcatggtggctcatggctgtaatcttggcactttgctggaggtc

SEQ ID NO: 397880 - DNA, 1311 bp, Homo sapiens
cgagtgggtcctgcatatatttttgaagtggaaggcaagccccattcagttgaagagtattatcttaatgatttggagcacattcatcatagcaagctctctcctcatctcctggaggaaccggtgataactaaggatatatattaagttgctgtctctctcattcagatgtttgatgacttagatatgaaggagagtgggaacaaggcttggtcgggggcccagtttgtgttggagcgaagcagtgtgttggtgtttttgccaggtctgggtgaaataaattatatgcatgaacttctcacaagcctggttcataaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaaatggggacggttcaattaccattcaatcaagagaattacagaaggtgctgacctcatatgcagcacttggagactagaaatctcacaggtcacatgcatgtgatctcggcgaccgtgtggaccagagttatttataagcgggatcactccaaggtgataggcagggtctataccaatattacttggacacgaaagaaagggcagaaatgtgaacccacaatgggtggaacatcctgttaaaaacgagt

SEQ ID NO: 397881 - DNA, 731 bp, Homo sapiens
tttgaatgtgtgtttttgttaacttcaggtaaaacatggctaaaagcttacggagtaagtggaaaagaaagatgcgtgctgaaaagagaaaaatgaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactgg

SEQ ID NO: 397882 - DNA, 450 bp, Homo sapiens
gcacaacaagggcaattcaaatgcaaaaatatttcccttctatttatataaatgttaactattcatttaaacaaaaactgcagtaccagtactgaaagaatgaggggcaaaccaaagtgtctgaggacagttttggaggagcataatagccagtacagaatgtctaaaatggggccgggcgcggtggctcacgcctgtaatcccagcactttgggaggctgaggcgggcggatcatgaggtcaggagatcgagactatcctggctaacacggtgaaaccccgtctctactaaaaatgctaaaaaattagccgagtgttgtggcgggtgcctgtagtcccagctacaggctggggcaggagaatggggtgaaccccggaggcagagtttgcagtgagccgagatcgcgaccctgcactccagcctggacgatagagcgagactccgtctca

SEQ ID NO: 397883 - DNA, 215 bp, Homo sapiens
attgcaagggcagctggggaatctacaggagttcatgagttacgaactgagcttaacacactctgcgtggagaacaatttgccaaagcgttatgtgtaaatgaacaaacaaggaaaagagtgtggagtgctaagtaaagccaggaagggacatgaaggcgaatcctacgcaccctcccaggaaatgggggtttaatcgctctgcccaccacctct

SEQ ID NO: 397884 - DNA, 386 bp, Homo sapiens
gtggatcacaaggtgaggagtttgagaccagcctgaccaacacggtgaaaccctgtttcttctaaaaaatacaaaaatcagctgggcgtggtggcatgcacctgtagttccagctactcaggaggctgaggcaggagaattgcttgaggccaggaatttgagaccagcctggggcaacacagcaagaccaccccccctaccaaccccatctctaaaaatgtttttttaattagctgggcatggtagcatgtgtctgaagcctcagctacgccggaggctaaggcaggaggattgcttgaatctaggagttcgaggttatagtcagctatgatagactatagctgactatatcacagatagctatgatagcctgggtgatagaacaa

SEQ ID NO: 397885 - DNA, 627 bp, Homo sapiens
taaacatgcagagagcttcacgtaatgaaaatgactgtgcagtatatgtctatagggttaggtaaattatttattaatgggcatcattctgatgacgctgctccacatttatctttctcccttagttttaagcatagagttggaaagggccatagatatgatctggtcagaccgaatgcgatagcaggaattatcctgagaacatgctgaaagataggctgaagcctttgcctcaacatttcttctaattgtccctaatgcagcctgtcccattgtttgtcatttcgaattcacagaaagttctgccttatacagagtgaaccaaagctgatctccctgtagctcccagcagtggtccttactctgcttctggagacaagtccatccctctcccatggggggccattcaggctattgaaggcaactcttatatttccccaccctcacccgcagtttccccattttcagctatttaattatattgcccttagtgcccttcattgaggagttgtcttgctaagaccaggtagcaaaaataaggagcttatcagatgaccaccagagatagaaagcaatgaatgggaatcttcatgtcatttatgaatatcgcattcgtcttacaaccac

SEQ ID NO: 397886 - DNA, 263 bp, Homo sapiens
cttcatgtccctccagtaggatggctttccagaggcttccattcctcactccgtgacttaatcgactatgagcttggacaagtgtggtggagataatgaggatatgagataacttcatagttatttgaagattgggtgagaaaatccacaaaaagcattcagcacatggcaatactcagtgaaggctattttcctcaactacaggagctttttcctttgatctatttcttgatctacctgtcctcctgatgggacactcccta

SEQ ID NO: 397887 - DNA, 372 bp, Homo sapiens
gaatgaaccaggagagagagaacatgtttttaaaatggcgcaaatgcaccccatctcccccgattcctgctggctgggcaagatgggaaaatggcgccaaatgcaccccatctcccccatctccccatcttgcccaggaactccaagacatcaagatttcacgatttttaagacgtcaagatgctagcatgctaacaccatcacggttctagaactttaaaggtgtcaagattctaaagccttctggattctagaatcctgtagatgtcagcattctaaagtaccatcaggttctttatttactggattcattagttccaggattccatgagcctggtgtttagcctaaaaagttatggtaaattaacattg

SEQ ID NO: 397888 - DNA, 613 bp, Homo sapiens
gggtgtatgcatgtgatgatgactggccaagtaagctgcttaaggagaagagggtacttgagaggggtgagagatgtgaaaaagtggtgttatcagtggacagaagttccacatgggggtcaaaggatcactggagatggggtcctagagagactgagctgaaaaggggtcagtggttagagagtagggtgtctgagttcatagaagatttcagttattggtagtaagtaagttcaaagttaccaccaaaattgcagctgaggcaaagtagaagacaaaattttcaaaggagagatccagtgaactccaaggccgtgcagctggaaggatcatctttgtatctgtcaccaagaagtataactgtggtgatggtagagagtgagacaggaactaagatctgaaaggaacaaagggaaattgaggggactgtatactagaagactgcaacaagtacccaggtaactgatgacatgtttttaatggaagaagcagaggagaatggatgagcagcatcccatgaggacaagcatccattgaggacattgaggacaaggaaatctactctgcctccaggcacagtggtatactaggtgtgggagagaaaagagccact

SEQ ID NO: 397889 - DNA, 301 bp, Homo sapiens
cattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaactgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagt

SEQ ID NO: 397890 - DNA, 587 bp, Homo sapiens
tgttacaggctgaacgcagacaccagtgaaagccaccatcacaggggactcgccaccttgcctgcccatcccgagtcactgctggggtgatctcttctctaggtctctgggcagggttccgattcaatgaatcgtggagcttggtttcagccccacctcccttcagacaggaggggtgtggaaaatcccatttccccctctctctctttaaaaaatacacaccacatagccaaagaatttaatttctctgtccaaggggagcaactggtacatgatacagcaagaaccagtttgggtctccccattccgtgtttcccaagacaacctgtggtcttttcttgttgctcataggtgagccaaagagatgcactattgacaggcttgtaggaatgaaagaaaataaacagaaaatgcctgctcgcaaggtaggtttttgagcactcagggagaagccagaagtgtacaggcatcctaagttagacctctcaactgggcaccacaggacactcagagtctcaaggggccagagaggtcctgctttctgatcctttcctttaaagccattctgcaccgccgcccacctcccc

SEQ ID NO: 397891 - DNA, 112 bp, Homo sapiens
tgaggcaccctgcctccacctgctctctgctctcgaagcgtcagttataccagcacttctctcttctcttttgtctctttttacagtcacccctttagagtgacaggcagcg

SEQ ID NO: 397892 - DNA, 534 bp, Homo sapiens
gagctgacaatctgtaagaaggttttgttatcttcatgttacagatggtgaaccgaaacttacagagctcaagtcacttgaccaggctccatccctacaagaggcagcacgcaaactaaaaaccaggcggccttttccaaagcttgtgctctgctccactgctggaaggaacccttcggggaattgaagcagcactgaacaaaggccatttttaagaagcgacaccagaaacctaaggcggggtccccggctcaacaaggatctcatgttttgtgggtcagagattcttgtgtcgtgtctgggtgaggtcaaaaaccatgcagagactttcacttcctgttctgtggcagacaagacatctgaaaagctctcctgcagcaacacttctagatgccaaataaatcacagcaagtgcacttttaaatgtgttactaagatcataaaaatgaaggaaaatgcccaagcatatccccaacccctcaccccacaaccaccaccaccacaataaacaagttgctgacagcggattggcaa

SEQ ID NO: 397893 - DNA, 538 bp, Homo sapiens
taaatgtgtttgatgagtgaatgagcaatgagcatcaaagtattatttagcaatggggaaaaaagtagaaacttggaatctgacaataggaactcattacaatgcaaccaggaagtaagagctccctctgcaggctcactgttgcagcatcaccaagagtgggggagttggggagaccctcaactagcaatgacctccactccctgcctgctcccacctcggcctaaggagagctgatctcaggctgaggagaccaagtgccatcagaagcactggttgcttctgacctcaataccatgcatggattttattctaagggccaccaagagccactgttgagtgactaccacatctgtgtttcagaagctcacttaaccagcagtctggcaaaaacgtaaataatatccagtgtcagtgagggtgtggaaaacagtcactcttgttcacgccaagggggagtactacaggtacactctttttggagagcaattaacccagcattaaccctagtggcaattccacttctaggaacctgccc

SEQ ID NO: 397894 - DNA, 361 bp, Homo sapiens
tggccaacacggtgaaactctgtctctacaaaaaatacaaaaattagccaggtgtggtggtgggcacctatagtcccagcaacttgagagcctgaggcaggagaactgcttgaacccaggaggcggaggttgcactgagttgaggtcgtgtcactgtactccagcctaggcgacagagcgagactccatctcaaaaaaaaaaaaaaaaaaagaattcttttagactttggggtcaggaaacaagaaaatcaagtcattccacactgttacttgaaatagatgctcagatctttctggcagtccaagacttctttgccatgcctcttattcagaaacttccttcctactctctctgtataat

SEQ ID NO: 397895 - DNA, 219 bp, Homo sapiens
cgtggtttgctcatctgtctgatctgggcttgcccatggcctattgttacttggtcatgacgtgtgcttctttttgcctccatgccatcctccctcctgtctcggatgtctctcccataccctctcatgggtgcctcctggcagaccctcgcccttccccccagctctgtgtcacttatgagcttctgcgctctgccttgattggtccctctagctgtc

SEQ ID NO: 397896 - DNA, 155 bp, Homo sapiens
ggtaaaatctgcgtctggcacagccagccaggtctccttatcctttgcttccctttctgcctgtgactgaatgggtatgtcagggtctagtaggggatccaggaggaggaaacctcattaacttctattctgcagcaattgatgtccacccaact

SEQ ID NO: 397897 - DNA, 442 bp, Homo sapiens
acacacacacacacacacacacacacccctacacacctcttagtgaagctcccaggtggagatgtggttattcagaagaacacatccctctgttctaagaatctgagtaatctgattaaatgaggtgttaccatatcatgttttcttagttaaaaaatacataaggggctgggtacagtggctcatctgtaattccagcactttgggatgctgaggtgggagaattacttgagcctatgaatttgacattagcctagccagcatagtgagactccatctctaaaaaaaaaaattaactgggtatgatggcgcatcctgtgatcacagctaaatgggaggctgaggtaggaggatcgcttgagcctaggaggtcggggctacagtgagccatgtttgcgccacttgcactcccgtctgggcaacagagggagaccctgtcgca

SEQ ID NO: 397898 - DNA, 255 bp, Homo sapiens
aagagatgttctccctctgtctggcaggagcacaaaatattaacagccccatgtgtgctccagtgattgtctcacctcatctatttctccagcatttttttcctgccctcagtctccttacacacacatagttgagtatgttgccaaagtctcaaggaagctctttaaagatttcaagctcactctctgtttgtgtacgaaacttctttctggtacttagccctgcagcttctcctcagaactctgaattctgcc

SEQ ID NO: 397899 - DNA, 600 bp, Homo sapiens
tggatatctgtttagtattcacaacatatatgtatctccattaagcccagaattctttgacagatggtctcacccaaagaactcataaatacttgattacttcaacttagtttgcaaaaattaaaaaatcagtaaattatgttacagactatagtattttgagtgttaaaatcacttctaaagaacaccatcacaacagaaccctaaattcagaatcgggttgacatggtctaagaaagtgaataaacgggtaagtgatcttcctagtgcatcatattctacactaaaaattcaccatttatacttcatttctgaaactcaatgtcaaagagaagattaaaaatctgggggctgggcacagtggctcatgcctgtaatcacagcacttagggaggcatgggtgggtagatccctgagctcaggagttggagaccagcctgggcaacatggcaaaaccccgtctctaaaaaaagatactcatgtgttataatatttattttgagatactattaatatctcagagtttatcatttcatcgctatcttttgcaagaccttcttatacctgttgtttcacgagtaagcatacatgtaactgtcg

SEQ ID NO: 397900 - DNA, 255 bp, Homo sapiens
atatggtgttgctcaaggtcacattcaaatatttttctgaatatttctagtttatttggacaaatatacaggcaaatgaatgagaaatgtaaattaataaacttaataaacatttagtttttagaagaattgacaggcatatttaaatcatacttagtagataaaaataggtcaattagttaatgatagattctatttgtgactaaaagtcaatgataagatagaatgaatacgtatgggaaagagggagactaa

SEQ ID NO: 397901 - DNA, 479 bp, Homo sapiens
gataagatgataagcctgaatagacatttggtgacagaagagagaaacagattgagactattagaaggtaaataacagggagaagtcaaggatgactagtttggaatacaggatgaagagtgaagctacccaatttatataaagaatactggagaaagaagaggtttaggaaagggggcagaggatggggaaaatgatgagctcatttttgaacacactaagggcctgagggacagccagcaagatgggtcaagatatccagcaagtatctggaataaaagacagattgtgaaggcaggtctaagatatacctatgagttgaaaccaccaaagtacatgagatcacctgggaatagtatctagagtaaggagagcaatgtgccaagaagaaaacactagaggataaggaaaacaattttgaatggtgaggtagaggcaggaaccagagtgtagcaggtcagaatgaatgggagctaaag

SEQ ID NO: 397902 - DNA, 1203 bp, Homo sapiens
aatccaagagaacatttggaaataaaagacaacctgaatctacatggtgtaattatccagaatggtaatctctaagagcataataagatgattatatatagtatacattcagaaagagaataataagggtttcagagaggaaccacgaaagcaaatggagaaaaaaggaaagcgtatatgaatattctttactattattgcatctttaatgtaaattgaacattttataaaaataaatctatgagcaacatatgaatgagaaaaagcaaagaccaagaaccgtagttgttaatcaaagagcagggacatgcaggggtctatattaattccgctgcctgaatctcactagtgagactccttttaccactcccagagggtacataacacttgaaatgtccatactaaagctgcttgttatgcttttacaatcttcaatctaaactaaattattcttagaaagctagaagttgatcctgacttttgatctcactgcttacaatctgccttcagtgtttcaccatgaagagtattttattaaagacatttttttttagagcagttttaggttcatggcaacattaagaggaagatacagagattttttatttatcacctgccccccaacatgcatagcgtccccatatcaacatcctccactagaggggtacatttattacaactagtgaaccaacattgacatcattattcccaaagttcatcgttgacattggggttcactcttggtgttgcacattctatgtatttggacaaatgtataatgacacgtatctaacattatagtatcgtacagcatcttttcactgccctaaaaattctctgtgctctgcatattcaacccttctcccacctcctcaccatcccctggcaactgctgatctttttctctttccatagttttgcctaaggaaagtactttttttcttggaaaagttgttaccttgtttgctctctccaccgtcctgtttatatctgccctcaaagacacataaatttaatttctataattctcatattttttagtgaattccactgacttctagataccttaattattctttcagcaatctgataataatttattaatttatttaacaagaatgtattgaagaattactacatgccagacacagttctagtcactggtaataagtaatgaacaagataaacaaagttgttagccac

SEQ ID NO: 397903 - DNA, 485 bp, Homo sapiens
gtgtattactacactgtaagaaatggaagtggctcaaccagaagagagagtagtctagttcagctgaaattaagaaacagatggttgttaggagctttccatgaggatcagaaatctgtgcccctcttatatacagctctgttgttgagtggatgattcgaggatgcccagaagacaagactaagcattttatattttagagcagagacaaggcttctgtggcagaacttgtattcagaagtagactctttagaacatcaagtgtgatctgatggcagaagactcatttgacatcagtgttttttgtttgtttttttgtttttttgtttttttttttttagcaaaaggatcaaatggtgctgatcaccaaagtgcaagatcaagtcacagccctcattgtctgggaccatgccttgaatttctataaaggtgaacactgttacactcaagtgtcattgagcaaattcatctctttcaaatggaaa

SEQ ID NO: 397904 - DNA, 320 bp, Homo sapiens
ggttgtatgtttctatgattttatccgttttctctagattatccaatttgttggtatatagttcttcataatagttctttatgattctttttatttctgaggcatttgttgaaatgcccccattttcatttttgaagctatttatttaactcttccctcttttttttagtctagttaaaagtttgtcaattttgtttattttttcaaaaaattaactcaattttgtcaacttttctatagtttttctattctttaattgattttcttctgctttgatttttattattttcttccttttgctaatttcattttgttctttt

SEQ ID NO: 397905 - DNA, 442 bp, Homo sapiens
tggaacactgtaagaccaggctgtaaccactactccctggaagcagagcctgccttacggtattgccaaatgaaaccactcccagcctccctgtcaatccagccaaccctgatgagtgcccggagcatgccgggtagacctgtctgtgcctggaggagcctcaggtccagtgttatgtgatgatacctgctgcttcatctgggtgcccccctcaaccacagatcctcctttgagacattcccatcctattgaaacgccaccttcttctcgaagccttcctaggcttcacgatcagacacattctccatctcccaccccaacatttctgaagggagcagttacattccattctgcactctggaactcttgttactatttcccctccccggggcaaacagggagctggctgtgtccaaatgaatctctggggctacagttgtct

SEQ ID NO: 397906 - DNA, 318 bp, Homo sapiens
gtcactttacttagaactaagtggcctcatcatcagattgataggaccagaggtaaaccactgagggagccatctcttttaggcttacttgtgagaatggaacagcctggtagaagagctcttcccaatagaggcagggtgcactgatggccaattgcccagggaactcgccctccccgtcaaggagttggaaccccccaaagacaccagaggagtatgtccctatggtgaaggaagtcggcttggccctgaggacattattggccactgtggataagaccattcccctcctaccagccagcacccatcgagagattg

SEQ ID NO: 397907 - DNA, 179 bp, Homo sapiens
ggaagacaccacatggatagatccggacaggcagttttaccataagagttagagaaattcagaggactgaattcactgtgattggggtggattgagatggttttgagctctgttgcggtcacaggaggaaagacaacatggagatggcagcaggcagatattctgacctttgtgcaagt

SEQ ID NO: 397908 - DNA, 975 bp, Homo sapiens
ctccccagccaggacaagttctaaaagttttcatttttaaatctttgctttcctatcaggataaataatggaaattctacactgtggattcctaaataggaacagctgtgctttctttctgttatctacatgcttgatggggggaacaaactgagtaagaaggtttaataattttattttaagaatctccaatgatatatgcagccttttaaatatgtaaaccagccccaatttttcccattgttcaattttttgttcctttttaaaacataacaataaattcattgttctttgtcagtgcaaatgttgggtggattatttaaagccagttaggagctgatcactgaagtatgtgagttttaattttctcctagttgtcttgatcttaagaaggaattaaagaaaatctcaagtgtctgccttcatactaagaacacatgaaatttctgaagcaaatagaaagatgaagaaataataatatatgttcatacttttggaatatgaaaaggatctgcaggagaacaattattataacatttgtctcaaaagataccatagaatcagttggaagttaataagtctctgtagacattttttaggaaaaatttttaacaatactcatctcagtaggttttgaaagaaaaagtttaaggtatgagtccgttgtacttatcacatgtttagaattaggtgaagtagtttttatttatgactcttctttctcttcctctgaaccattagcctcaatcttctttggaataaaaagaactctcagataaaacggagagaagtaatagcaaataatatattttttctttatattcttggagctgtattttaatatttaacacagttttaaagtttaatatcacctctacttttctataagcttgatattctaggcttgctactgtcatattgagaaatttgtctacataactagatcattaaataattttatactttgtttagctg

SEQ ID NO: 397909 - DNA, 606 bp, Homo sapiens
tcatcaggacaggacttaagtcgctttggctttactgatgtttccagggctagcatactgccttgtacaaagtacaaagttaataaatatgcactgaatgaatgataatcccagtatagctttcaagggtagcagatcactccttcattattactttctggtcctagaaaaatgcacattatattaagtgtccaaaaggaaagtaactatcatttcagagtctacacctctgagccccaagtgttgatagcaacaaattttaaagaaaataatctagaatgaacggcatgtatgcttcgtgccaaagtctggcttatctcttttaatcaattgattagctattgactggataacacagacttctctagcagaggaaagataagattcattagctgtcattaacctaagctagtgagataacaagtactattggccagtgcagtggctcacacctataatctcaacactttgggaggccgaggcgggtggatcacgaggtcaggagttggagactagcctgaccaacatggtgaaatgctgtctctactaaattagccaggcgtggtggcacatgcctgtaatcccagctactaaggaggctgaggc

SEQ ID NO: 397910 - DNA, 480 bp, Homo sapiens
ccccatcaattaatttaatctaatcgacaattttagaatattccatgtaacaatagcaaaatacacatagtttgaaagattatatgaataatttaccaggatatactatgttctgggccataaaatacatattaaaactgaaaaagaatagaaataatagaaagtatctcacactacagtagagttgaactagaaataaaaaaatagtaacactgcaaatgtttacaagtttaacatcatatatccaagtaacctataagtcaaaaaagtagattcaacaaaaatttagaaatattttgaactgagtaaaatacaaatacaacttaccaaaatgtatgggatatagttaaagcaggggtatgacagaaatttttaatactaaatgcatatataagaaagtaagaaatatctaaatcagtaattttaatccatatttcacatagaaaactatagaaagaaggtcaatttaagcccaaaaca

SEQ ID NO: 397911 - DNA, 349 bp, Homo sapiens
tgccaccacgcctggctaatttttaaatttcttatagagatgggggggcagtgggtggtgggggtggagggtgtctcactctgttgccaggctggtgttgaactcctggcctcatgtggtcctcccacctctgccgcccgcccaagtgctggaattgcagatgtgagccacagtgcccagccccatagttgctgcatttatgcctttctttagccagcatgcctaaatgttgacatcctcaattaagacacagtatcttgtcttttccacatctcaatgatgcagaaaaattcagttatgtttagtaatcatttattgtgtctaatgtctaagattttatattagatgt

SEQ ID NO: 397912 - DNA, 1630 bp, Homo sapiens
  misc_feature (771)..(771): n is a, c, g, or t
  misc_feature (907)..(907): n is a, c, g, or t
  misc_feature (929)..(929): n is a, c, g, or t
  misc_feature (969)..(969): n is a, c, g, or t
  misc_feature (972)..(972): n is a, c, g, or t
  misc_feature (1003)..(1003): n is a, c, g, or t
  misc_feature (1005)..(1005): n is a, c, g, or t
  misc_feature (1027)..(1027): n is a, c, g, or t
  misc_feature (1045)..(1045): n is a, c, g, or t
  misc_feature (1136)..(1136): n is a, c, g, or t
  misc_feature (1626)..(1630): n is a, c, g, or t
gctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggtgagcttcagggttgcccggccacacagcagggtccagggcctctcatggggaggaggggccaggtggacaggaggccctgtccccataccccacccaggttcctgcctgtgattcctccatccagtaaggactcggggtaaagcactgccctgctcctggatggtgggggccactgctcacagaaggctctgggcagacggctcaggaactgggaaggggagggaaggccacgcaggcctgaagccaggagtgcggggtgggggcagagatgaggaggcctccagaaatggcagaattctcggggaaagcatcacttttcgatcttcttcttcttctttttttttttttttgagatggagtctcgctctgtcaccaggctggagtgcagtggtgtgatctcagctcactgcagcctccaactctctggttcaagcgattctcctgcctcagcctcctgagtagctgggattacaggcacccaccaccacgcacaactaatttttgtatttttagtaaagacagggtttcaccatgatagccaggatggtctcgatctcctgacctcatgatccgcctgccttggcctcccaaagtgctggnattacaggcatgagccactgtgcccggccactttccagtcttgaacagagcaaaaagtgctccaggagaggaaggaggtttttccaaaacaatttttcaaattatcctcagccagcaaaccttaggctgtgcggangccgggccttccccctgctcantctggagtcacatgtgtgtcccccaatctgttgccccacnagntgcccccaacgcactctctcccacagagggncnggcctgggcctggtgctggggnccgggttcctgggccagnaggctggctgcccccaacacactctgtcccacaggggggccgggctgggcctggtgctgggggccgggttcctgggccaggcagccggccncctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttctgtggaaannnnn

SEQ ID NO: 397913 - DNA, 150 bp, Homo sapiens
attcctgctgctcccgcgagaattcctgctgctcctcgctggggcccagtatctgccaggctggactgtgctgttcctctctgtcctggggctcctggcctcccgggctgtgtccgcactcagcagcaggaagggatcctctagaataac

SEQ ID NO: 397914 - DNA, 647 bp, Homo sapiens
atgctgctctgagtggtatgatgaaatctgctaccatcaaagggacataaatcatacctttgtccagtgtatccacactgtataagccacccttagtagccatcttggttctcagatcaactgtcgcagtattgcagtgcttgtgttcaagtaacccttatttgacttaacagcctcaaagcacaagagtggtcatgctggcaattcagatatgccaaagagaagctgtaaagtgcttcctttaaatgaagaggtcaaagttcttgatttaataaggaaaaatcataatgtgtgcagggttcagtactagctgtggtttcggcatccactggggttcttggaatgtatccctcgcagataagggggaactaccctgcagagggctatcctgtacactgtaggacgctaagccacatcattagtctctaactactagtagcaagtagcaccagcagtaacaatcaaaaatgtcttctaacattgccaaacatctcctggaggacaaaattcaccccctgctgagaaccactagtttaaagttgatgacagactttaaaaaggaaggatcatgctgtcaccatgtgaatccactgatcactaattgaaactactagacactatgtgtctcctgatgtgatacaatatga

SEQ ID NO: 397915 - DNA, 349 bp, Homo sapiens
cccagtcaggaggcaagggggtcagggacccacttgaggatgcagtctgtcacttagcagagctggtgaactgtactgggagaatccctcttgtcagaatcagctgctctcttcagagccagcaggcaggaaagattaaattccgctgaagctgtgcccacagccaccccttcccccaagtgctctgtcccagggagatgagggttttgtctgtaagcccctgactggggctgttacctttccttcagagatgccctgcctagtaagaaggaatctacacaagcaatctggccacaatctctttgccatgcccagcccagacctcccagcctccttagcactgccaggg

SEQ ID NO: 397916 - DNA, 603 bp, Homo sapiens
gtcccccatccttccccttcataaatgactctacatgggctaaatctaggtacagggaggccttctcttgagccgcccactgagcattctatctcaaggccctgctcccacctcaaattcagctggttctaaaccagactcatcatctcctgaaaaatattcctcacttctctccttccctccttccttccttctctcctcccctctgctttctaagggtcagagctctcccaacctcctcctgctccttccccatttcccctcagaggcttcacccagtaaatctctccgatgtctcaccctgtctgggcatctgcttctcagaggacttgactaacatgagacttaaatcagcccatgagtggggacttctctcaatatttctttggcatttctcacagtgctggacagccagactctctccttgggaattacataattgcacatgtggaatgacttggggagacccaaggaaggtttccccaagtgtgtgacccctgacaccaacctactatgtgaccttagccaacttacttcacctcttagcccattaattttctcaccataaaatgagtggttaaattcaatgtaaattcacacaaa

SEQ ID NO: 397917 - DNA, 441 bp, Homo sapiens
cattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctaacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctt

SEQ ID NO: 397918 - DNA, 345 bp, Homo sapiens
tgaaaaatccaacttggaaagaggatcctggattcacatggtagtgttgagctgagaagcttcaggattctgggtctatctgttttcaaactgtctcctgcaacactggttcatcagaagagcctctggtgccacagagagtggatctaggtaacattccttccatggaccttcaaaggagaatctcaccttctaagttttactaggttaaagcagtcgttcccaaccaaggtgcttttgtcccccaggggacatttggcaatgtctgaagatattcgatagtcacagctagtggagaggtactgatatctactgggtggaggccaggaatgccaccaaacatcc

SEQ ID NO: 397919 - DNA, 592 bp, Homo sapiens
ttaagttacggtatatatacaaatgcaatatcatttggtgacatttaaatgctctaaaagctcaaaggtgatcacacactatggaaagtgtggatcttataagagattactaacatgtggactacattaccttccagtatctagtcatttattaataaaagcttttcaagactattagtagttagcaactaacacaggcagcaaccaagtagacagcaaactcccctgcttcatgatctcctatcacaataactactcatttttcaaaaacaactacgtatcaggccagaagtaagtgcacacaaacattatttcatcttaactctcacaataaacttttgaaattttactattatcctgattatatgggtgagaaaaccgagactcaaagaaagaaaagaaccccactatcacacggtaagtaaatgattatatcaaaattcaaacccaggctaagtctgattccatttgtatatatctctgtcagtaacatttgtctttaatgattttgttatgctaatcaccagatgcttttctccttgccagttcttttctgaaggaaaatgcctgaaaagacagataacctaagaca

SEQ ID NO: 397920 - DNA, 221 bp, Homo sapiens
aggcctgtctcctgggcggagctgctgaggaggctggaggtaaggacaagcccctgagagttcacaggtcatcattcccaagtgtcctcaggtagcgtgtgtgtgtgtgtgtgtgtgtgtgtgtgtgtgtgtgtgtgtgtgtgtaatgttcaagcacgttttcctgggacagtcgggactggggcctccccaaactgcagaatctacccagttatgtttga

SEQ ID NO: 397921 - DNA, 457 bp, Homo sapiens
atgaggttaacatgcaacccagcaattctactcttatgtatttacccaaaagaaatgaaaatacatgtccaaaaaaacacatgaacatacacagcagttttattcaacatttcaaaacattgggaaacaatccaaatgtccatcaaccggtgaatgaataatgaaatttatctcacaattacaatccaacagcactaatgttcttttaaaatcaatgtatcgtggtatattcccataatgaaattctcccagcaagaaaaaagaagacaactgcattcaatgacatagatgaatcttgaaaacattacactttgtgaaagaagtcaggcacctaaatacatactgataatcccatttatacaattctagaatagttaaagctaatctacagtgacaaaaagcagagcagtggttgtctaggccaggagtggtcgtgggcaaattgactgcaaaggag

SEQ ID NO: 397922 - DNA, 415 bp, Homo sapiens
gttgacagcctgatcacttgacaagaggctggctggtgagggcagtgaggtgagaggggaggtgagtgagttccagatctggttcagtcctcttgacttggggtgctttaatatagctcctttaagctgtggacgcttccttggtgacaagggtgtatgggggggtggacctgctgccacttttgagtccaaaggtcaaggcctcccacgataggctgggcacagctctcccaggtctcttaataataatgtcatttctttgtgcctactatgtgctaaatattttacatacattactactattttccacaatcctatgagataggtactattaggattctattttttttacttttttttttgagacggagtttggctctgtcgcccaggctggagtgcagtggcgcgatcttga

SEQ ID NO: 397923 - DNA, 568 bp, Homo sapiens
cggatgagggagtagaggctgggcccctgtgaagccctccttgcatgaggtgactacagaggagtggacctccagagcctggtgacaccctctcccaccacacagactacagctgggtctagggtgtgacgagctggcagagaagccgccccagagcgatagccacttccggaggacaaggatctctccaccggctcaggaaaacaagccagtttaagggaaacccaaatggctttggggggcgggggcataaaatgtgcaggactccctcaggccttgccatgcagaccttttcaggaggactgccaggggaagacggctgctcacttctgccccacggccaggcctgtgacagccgctcctgtcagcgcagtcctctgcggggccgacgctgtgtaaataattaacaaaacatctgccttgcttcataacacaccgtggctgacacagctctcagggccttcagagaccctccaatgccacgccgaggacttatggcctcgctttgtggggacaggtgggaacgagagcagatactgacaggcaaacattttcctgaggcgccaca

SEQ ID NO: 397924 - DNA, 984 bp, Homo sapiens
taggacttcgccgatctcacaggctcctttccagatgagctgactgtaatctctgggaagctggatctggaggaacaatgggatgggatttgcggtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactgggccttccttgcccattgaatgctttctatacatgaagacttggagctctttacagatgacagtagccagtgaggaagataaaagaagagaaaagacccaaaatgcgggtttgccactcttttttgccagcaccgtggggacagtcactctgccttctttccaccacctccaacttcacactcacacgcacactctggtcccacagagcctgtttggtacttgcctgacagcccaccttgaaaccagatggtcatgaacctgtcaccaagtcatctgaagatcttccactgcaacctgtatggcatctgccacagggaccatgggacatgattgaagaaccactccagtgcagttgatgaaggggtgggtctgcactggagttaggtgcaccagggcctgggccaagggtgggctgggtccatcttgtgtgtggtggtcttcttcagagtagcagctgattcagagggattccatagaactgcacaggctaggtctagtcagatatcttggacattttctatttctagattagagaatatagcatacgctgattttaatataactgtgtatgtgactttttcagtgagaa

SEQ ID NO: 397925 - DNA, 438 bp, Homo sapiens
acatggttcaattactgctctttttgtttttgtttttggtttctttgagatggagtctcgcctgtctcaaaaaaaacaaaaacaaaaacaaaaagagcagtaattgaaccatgtcaaccccttctaaaaactcaatgcagtggcctccctttgcatatgaaatgaaatctgaactccttcctgtgcttgccagcatctatgaggtactccatcagctgagccttcctaccttcggcctcatttcactctgcaacccctgcccgcaacttaccccttactcgccgtgcttcaaacacactagccttctttctgcttcttgaataagtcaagcatttatcctctgacatgcaatttcctgggtctggaatgttcttttcccaaatcttttcatgcctgactccttctcaacatttggttcttacctcaaatattgattcc

SEQ ID NO: 397926 - DNA, 428 bp, Homo sapiens
gatatggagtctcactctgtcccgcaggctggagtgcagtggcacgatctcagctcactgcaaagtctgcctcccgggttcaagaaattctcccacctccgcttcccatgtagctgggattacaagtgcacaccaccaagcccagcaaatttttgtatttttagtagagatggcacttcgacatgttggccaggctgatcttggactcctgatcccaggtgatccaccggcctcagcctcccaaagtgctgggattacaggcatgagccactgcacctggcctggatatctcttctgtaaagtgtctgttgaggtcgtttgcccgtcctcctctcggcttgcctgtcttcttgctgacttgaaggagttcttcatattctaatttcccatctcaggtcagatttctcctcccactctgcactctggct

SEQ ID NO: 397927 - DNA, 438 bp, Homo sapiens
gtgacaagaaagttcttgagtaaaggctaggaggaaaactatctgaggttacttatttgcctaatccttctatattagaattaggagatgtaaattagtctccagatcacttgtgttgccttcttagtcccaccgtagccatgacagacaaattctcagccctcgccctgctgactgtgtgcaaagttagagaacagcccccaaatccaccccccacttttggaactgcagagtttgggggggtccgcaagatcaccctcgggttcaatagtttactagaacgactcacagaactcactaaagctattatacttacagtgaagggagacagactaaaatcacccaagagaagagatatatgggcaaagtccaggagggtttcagatgctgagcttccagttttcctttcccagtggagtcatggatagtgtaactcct

SEQ ID NO: 397928 - DNA, 473 bp, Homo sapiens
tcaggtgttttcttttttgctgataaagtgtgggtgaaatgtgttggacttggtgcatgctgcaataattgcaaatgagatgatctgcacatgaattttcttggtgtgattttgtttgatctttctcggtgtggttctgtaatggcaagagacatcttcctctgcatcagagtatgaaacatcttaaaaggcattgcatggctgaagtgcaggtctgtattttttagaactagctatttgacaggaaagggtgtaaatccacattgtgttcattcaattccacaagcattcattgaacaccatctcatgacaagccagtgccaggggccgtgaatggggctggaggcagacacattcccagggtgactttagagtggcctctcctgtgtgctcatttggaaaatcagaaggaagatgacgcaggcttgattctgtccggctcagatgttcaagaacattgtgatcacttcaga

SEQ ID NO: 397929 - DNA, 367 bp, Homo sapiens
ggttggctagaactcggacccggccacacggagtgcaggggaagacttgggaacatggtttacatgtgcgtctgggaggaagaggagagcatggaagcgatgactactcccaccccagcatccttgggatgcagcagcagatcttgaggtctccagggtgccaagagcagagctgcttccctagaaaggaaattcacatgaccgtgatctcatctggttcctgggtttgaggttgggggcatttcggccaagcttgcagtcttctctggtggggaataaagtagggtgagcaaatccgttgtaagagatggacctatatgttcctggttgcaacgatatttatcgtatccctactgtgtgccgggca

SEQ ID NO: 397930 - DNA, 425 bp, Homo sapiens
caaattcctggcctcaagtgatctgctggcctcagcctcccgaagtgctgggattgcagacgtgagccaccgcatctggcctctcctagttgctttttctgagttttatgttaaggctttactcaaatgtcccggtggcctgggctgtccactcattaaggaatgggggactaaaaagctggttgctctttgtgtctggcttgtcaactggtggactcacagcgagatgaactggctggccctttcgttgggagatccccagtgttggcggctataggtgcgttccctgagtttaccaggttccccagagaatacttttccagtcatttgcctgaagggtatgaggctatggggctagctgccagcattctgggaaacctgggggaagattgagtcttacacattgagcaagtaaacatcagtgt

SEQ ID NO: 397931 - DNA, 272 bp, Homo sapiens
tataaagagtaaggtttaaacagtacttgctctcttttttgtttgtttgtttgtttaaagtagattgatatatttacatggttcaaaatcaaatgacataaaagatgtatactgagttggcccacttcctcctttgttcccatccaacctgttttctcatctccaacatgcaatcactttcattagtttgttgtgtagtcttctagtgtttctttatgcaaaaccaaacaaatataagtattcctcccccttttagaaaagaggtcacatgc

SEQ ID NO: 397932 - DNA, 518 bp, Homo sapiens
ttccttgattattctctggcagaattgactaagtataacatctgtactgcaatgaaaacataaaagctagtacgtaaagtaacagtttgaaagaatgaaaccagaaagaaaaagaaagcattttcttttcatttgaataacttctgaaaatcagctgagtatttatgtttctattcattgtttataatcacagttaactttaagtgatcactacttcttaggtggaaacatttactttttctcaaaatatgaactgtcttaattagtcctattcaaataaaaactccataacccatattcttctatgttcatatatatctttgtatctcctctttcattataccttataattccctcaatttggagatcatacgaatctgggatatctgttttagcattggtgtgtctaacctcataagaacatatcgcatagtttttctgatacatagaattagcaatctgcttactagaaaattacaggaggtcttcatgaacattgcgttaattttttctctatg

SEQ ID NO: 397933 - DNA, 547 bp, Homo sapiens
cagtgttttgaaatcatatgttaagggcaaacatacagaccctagcatcaatgttctagaatcatatgtgagggacatacattcagactctcgcagcagttgttctggaatcctatgtgggggacaaacattcagacaatggcagcagtgttctggaatcctatgtgagggacaaacactcagagccttgtagcagtgttctggaatcctatgtgagtgagagtgcctggagcctacccaacctgacgcccccaaagccctcacagggtctgacctcccagcatgcacctgcctctctctgaaccccaactgcccaccctgcctgttcccttggccccctccatcctgtgcagcccatagactgtgaccatctctccagccactctggtctttcctttacctttgtcctgtcagaatctctgagcaggatctcccaagtccatccaaacacgtgctttgtccacttttgactaggcccttgggcatcactgggctatcccagctgtccacagggccttcaataatgcacattgcacctggcttatcc

SEQ ID NO: 397934 - DNA, 307 bp, Homo sapiens
acaggacttcacatctttaacctagatttttaataaatgtgaagaaatatgtgtcaggaaatgggacaagaaagtagtcttttttagaagagtttcacttgaggacagtttctaacccagtctgtgcaaagcctcttggagggctctgagctgggatatgtaaccccgtgtcctattctcttcccctgaaaagcccacgctggacctggccagccagcagcactggcatggaccactggtaggagcagcccttttcttcctctaatcaactgtttccagaatagagcttaacaagatgattttattt

SEQ ID NO: 397935 - DNA, 667 bp, Homo sapiens
tcgtgatgctgtcaggctgcccagagacatgtgtgcagagccaggcttggtgtgtgccacagagcggcactactacagtgtcaatggaaatcataccagtgacagctgaagacgtgacagggagaaacatagacaagggtgtaggcacgtgagaatcacaacagggacaaatgaactccccaaaaggtggggatcagcagtgaagacacaggagagcactagtgaccaaggaagaagggtgtcctataagtcaaatgtggacacattttcctgatggcctccagatttggcaattttgtcacctgaaaagaattttcttcagtagagaggggctgaagcccattttaaggggtttaagagtaagaatgaggtaaagagatggtagaagcctttggcagaacagttgttcaaatatattttaagagatttccacttccagcaataagaagatacagtagtccagaattaacttcctactataagcaactagaaaactagtcaaaaataggaaacaactattttcagcaggaactggggaccaagatggctaagactgtaacccctgagaaaaggaaaaaaagaaggggtgccccaccatcaccttggctttctgggcactgcagtgcagggagcaaaaccaaaccacactgcagccaccctgagttga

SEQ ID NO: 397936 - DNA, 537 bp, Homo sapiens
ctgacttgtcccaacactgtcagtgaccttaatcacttggtcaccttggtgtctgccaggtttcttctctgtaatgtcaccttttttctctttataattgatagtattttcaggggacatatcgtaagattatgccaatatcctatttctcgtcaagtcttcatcctcagttttagcatccattgatgaattctatctgaaccaaacaccactattttgttttatttccatctctgttagttggcattctatgtaagaagagctttccttttcctgtcatttatttatatcagcatagacttgtaaaatcccactttattcagcaggttgtaatcagttactgtcattaaatattttattgctcatactgtcccagtttgtccagtgggagccctttcaaggaggttcctaggtcttcgtaacaagtccccatcattctttgaacactttctggcagaagttgttccaggcttctcttgtattttgcttggctcagctatctacaatcagccattttccctagaagcactggtccta

SEQ ID NO: 397937 - DNA, 570 bp, Homo sapiens
tgtcctagatgttgatgggggtggtaggtttgggtaggtcatagggtgtggctgggtcttagatatgtaaatttctcagggctggcagagtcagtcaggggtagccctttggcaagagtaatatgagtttggattatcgaacttcagagtttaaccctaagaggtaagtatttgctcgtttctaaattttgaagttttaaagccggcgttttgataatctgatatattttactaaccctctgaattcactgagagtaggtagggcactaattcagaggtcctagggaaaccttctggggggagataccaagttatggctacaaaatgacccaactttacatggcacggagctctaaaagtaagcagaattagcaagtgtggatcaacagatacaggatttaagaggcatcataagtttgcaggcggtagctgaaactaacaaatgaggtaaccagaggaaaaaggtgtaactgtgtgtgtgtgtatacatacacacatatacctactattttactatatataataaaatatatagatattatacatatataaagagagtttatgtatatg

SEQ ID NO: 397938 - DNA, 1187 bp, Homo sapiens
ttaattttttaaaacgtagttacttaaaaagattgggagattttctattcctctatcaatggggatttccaggcacgtgccccacccaaggcccacgcccagagcgcccgagcggcaggacaacgcccgctgacatcttcccgtcccgacggcacaggctactccgagctccgccttttagattgcaccgagagaagccagctacagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcatttaaaaaaaatcc

SEQ ID NO: 397939 - DNA, 1129 bp, Homo sapiens
ttaattttttaaaacgtagttacttaaaaagattgggagattttctattcctctatcaatggggatttccaggcacgtgccccacccaaggcccacgcccagagcgcccgagcggcaggacaacgcccgctgacatcttcccgtcccgacggcacaggctactccgagctccgccttttagattgcaccgagagaagccagctacagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagcttgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcatttaaaaaaaatcc

SEQ ID NO: 397940 - DNA, 976 bp, Homo sapiens
ttaattttttaaaacgtagttacttaaaaagattgggagattttctattcctctatcaatggggatttccaggcacgtgccccacccaaggcccacgcccagagcgcccgagcggcaggacaacgcccgctgacatcttcccgtcccgacggcacaggctactccgagctccgccttttagattgcaccgagagaagccagctacagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgaaccaccaaactgttttccacagaggctgcatcaattgacattcccactagcaatggatgagggttccaatttttccagatgctcaccaacacttgttaattttggttttgttttcattatggccattctggtgggtgtaaagtagcatctcattgtggcttgactgaatttctctaatgagtaatgatgttgagcatttttcatgtg

SEQ ID NO: 397941 - DNA, 553 bp, Homo sapiens
tggggttgaaagacgctgccccgcggagtgaatgactactctttcccttcgtttggacacatgggcttacaacgccttgtgttgtaaggagagaagaagaataagatttacacacagtacaatgcacaaattttcaagaatactggctgaaccacagatcttcaagaatcctgtctcacgcctgtatcccagcactttgagaggccaagggtatcagcatggaagccatgagtgagaataaaatggtgccctctgagtttagcacaggacctgtggaaaaaagcttgtgcaagaacattgcccatcttaaggggatacacaaaaacatttgatggcaacacagagaccaacagaggaaggcacaaacaaccatgggcaacgaacgaaccacgaaaacctgtgaaaggaacgccagcgacaacggaaacatcaataccacctcatgaaacacgaggccatctgcccgccagaacaagttgaaccgagcgcagacacacgcaaacaagagaatagaacggagaactagaaccagaagaaacacgacaaaaacgca

SEQ ID NO: 397942 - DNA, 964 bp, Homo sapiens
ttaattttttaaaacgtagttacttaaaaagattgggagattttctattcctctatcaatggggatttccaggcacgtgccccacccaaggcccacgcccagagcgcccgagcggcaggacaacgcccgctgacatcttcccgtcccgacggcacaggctactccgagctccgccttttagattgcaccgagagaagccagctacagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcatttaaaaaaaatcc

SEQ ID NO: 397943 - DNA, 337 bp, Homo sapiens
tactgtggagtggttgtcagaattaaatgagctaacttgcgtaggacagccatccctgtgcttggcacttagggtacccgggaaacatagcagttggaggtcctggcctgtttctcctgtggcttctgcacagcaggtgctactccccgtgtggtgtgccctcccctagggcaggctgcctgctggagctctgggcatactgtcttcccttgcatgccctgtggcatcatcgtatgccctgttgagagcagaggtggggaactcagctgaaagaaactgacttcttcaaactatttttattatgttttaagggtatcagcatggaagccatgagtga

SEQ ID NO: 397944 - DNA, 896 bp, Homo sapiens
ttaattttttaaaacgtagttacttaaaaagattgggagattttctattcctctatcaatggggatttccaggcacgtgccccacccaaggcccacgcccagagcgcccgagcggcaggacaacgcccgctgacatcttcccgtcccgacggcacaggctactccgagctccgccttttagattgcaccgagagaagccagctacagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcaggccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcatttaaaaaaaatcc

SEQ ID NO: 397945 - DNA, 1679 bp, Homo sapiens
ttaattttttaaaacgtagttacttaaaaagattgggagattttctattcctctatcaatggggatttccaggcacgtgccccacccaaggcccacgcccagagcgcccgagcggcaggacaacgcccgctgacatcttcccgtcccgacggcacaggctactccgagctccgccttttagattgcaccgagagaagccagctacagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacgtgcctttcgccttccaccatgattgtgaggcctccccagccacgtggaactgctcattggtggaagggacttgccttgtctcggatgagactttggactgtggacttttgagttaatgctgaaatgagttaagactttgagggactgctgggaaggcatgattgattttaacatgtgaggacatgagatttgggaggggccgggggcggaatgatagtttggctgtgccctcacccaaatctcatcttgaattgtagctcccaaaattcccacatgttgtgggaggaacccggtgggatataattgaatcatgggggcagtttcccccatgctgttctcatggtagtgaataactctcaggaaatctgatggttttataaggggaaacccctttcacttggctttcattctctctcttgcctgctgccacgtaagacgtgcctcttgccttccgccatgattgtgaggcctccccagccgcgtggaaatggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcatttaaaaaaaatcc

SEQ ID NO: 397946 - DNA, 341 bp, Homo sapiens
gtccctttcccctctgggaaatgagtatgtttagaggacctgtgatcatgcagttgtttgtgtttgggttattaatgaatggttctgcctccaaaatgtgggtcttctcatttgcctgctgcgaactgggtctgtgtgtgggccaccattcttgttactgcattgccaggaaggcttccatctttccttcccctctgcttgggctacaatggtaatgttctgtttatagtgttggttcttgttattcattaattctaataccttgatttaaacaatattatcatcatcaccataatctaatcattgcttaattattataattgctgtaatatgtaatcaat

SEQ ID NO: 397947 - DNA, 538 bp, Homo sapiens
aggtgtgggctgggcgcggtggctcacgcctgtaatcccaacacttcgggaggccgaggagggcagatcacgaggtcaggagatcgagaccatcctggctaacacggtgacactccgtctctactaaaaatacaaaaaaaattagccgagcgtggtggtgggcgcctgtaggtagtcccagctactcaggaggctgaggcagaagaatggcgtgaacctgggaggttcacaaggcgggtaacaaagggcccatgaggcctgattaactgatctgacaaaccatctgtcacccacagccctaagccacactgtgaaactgcctagggtggcaccagctttttatcttcctcagggtcctcccctcaggcccccaagtcaccccatcatggtccagattctcccctgagtgactccatccccatggtcatttcccctcctgagcctccccctctgagggccaagggctgtcctcagggccctcctggggcttcctggtggggaacaacctgaggcaggaggataagctcttattcagagc

SEQ ID NO: 397948 - DNA, 767 bp, Homo sapiens
agcagctaccttaatggacagtgcaggcctaagccatcaggagggtccttgggtacttccccacccttgccttttctccttgcactacccattccttatttattgagcgtcttctgtgtcttgaggctgtggagataacaaagctgctcagctttcctccttcctggagcctctgagacaacagaagttatatgtccccaaggactggagcttctgtttgcgccaccagcctagtgctgtagtagaggctttaggcacttagttctgagagtacccttgaaagcaaccatttcctgtgctttacagttggagaaacagagtcttggagaagttaggtaatttgcccagagttccccatatctttgagccaggatgtaaactaaggctcttctggctttttcggaggtactcagttacatcctgcttccaagcttttcggagaagaaacagggtaacagtccttataaccaacttaggttttcttgtaaattcttggagttcttgtgtttctaatgcaggtataactgtacatgacagagctgagaagatagttgaggttactaagcaactctaacaaaagagggtttttgctgagggcattccatttaagtcccaaactttactttcatagtgagaactggttttgaagtgtcaaagggaagcagttagaagcaaaatgcagcagtcaataagcccctccttacttcacgttagttgggccagcaagatagtagagaggactgattcatttggcctattcttgaaac

SEQ ID NO: 397949 - DNA, 363 bp, Homo sapiens
gtgaccctagaggatacccaaaagtgcactcttctatatctacagatctccagcaatctccccttttccttccccatcgcagggtgcttccttcattgtttttttggtcagcatcaccagagatttacgagtttggggcactttcaaagaatcgatagttgacttttttggccctcaatggaaggtgtgttctgaaggtttctcctccctgtgtctctagccctccctctaaggacgtttcaaacacctcttctataccaatcagctcatgtctcctgaggaagaacgctcttgatttctcttgtgtgagtctgtatttatttcacctttattcttgggtagatatagaagagtgcactttag

SEQ ID NO: 397950 - DNA, 327 bp, Homo sapiens
atggacaacttgatagcttgtcacatctgtggacattactattgttcttgatctcaaactttttgtggaagcagaaaggaaagatgccagctcataacttctttgacagccttaggcagtcaccatccccccaccccacccctggtatccagggagtagtcaggattttggcagaaaaccttgggcaggttatgttccaaattgccaaggtactattgacccacagcctggcttggccttgactcatccaagtagggacaatgactcatgctgcctgtgtcccctgcttgtaactagtacccaattaattattaactggtgacactc

SEQ ID NO: 397951 - DNA, 498 bp, Homo sapiens
taacttaaaaataaataaaagcatgttatttaatgggtgtataatattctaccttatgcatctatcttaacacttccattattggatatttgcagtgtttttcatttctgcaattaaaaacaatattctggagaatatcaatatcaattaataataataatactgtcgaataattgctttcagtaccttaagctatgaaataagcaaaataaggattgtagtagctatggcataccaagtaagtactataaaactcagttctttggatgccatctaaatgagtttacacaaagtagagctagaaagtctgggtcactgattgacaccatggcaagaaggatgtcttcttatatttaaatgtaaggttgaataggttgaaaatgccactttcagcaaaggtgggaagatcgcttgtgcccaggagtttgaggttatagtgagctatgatctcgccactgcattctagcctgggttgagagagtaagaccttgtctctta

SEQ ID NO: 397952 - DNA, 500 bp, Homo sapiens
actcacatgtttattgcagcactattaacaatagcaaagacatataattaagctaagtgctcatcaatagtggattggataaagaaactgtatatggaatactacacagccacaaaaaagaacaaaagcatatcatcctcagcaacatggatgcagctggaggccattaatttaagtgaatttaatcagaaacagaaaaccaaatactgcatattctcacttataaatgggagctaatcattgattcacacggacataaagattaggtcagttgacactggagaattgaaaagggaagagagagagataaagtagggcaatggttgaaaaattaactcccgaataccatgttcactgtttgggtgataagatgaacagaagcccaaacttaagcatcatgcaatataccaatgtaacaaaccagcacatgtacttcctgaatcccctgaatctaaaatttaaaatgaaaataaaattaaaaaaataaattctagactaga

SEQ ID NO: 397953 - DNA, 219 bp, Homo sapiens
catgttggttaggctggtctcaaactcctgaccttgtgatccacccacctcagcctctcaaagtgctgggattacagccgtgagccaccacacccggcccctgccattcttccttctataaatacttggatatttactctgtgcctcttgtggctttagatagtgacagatgtctcagaagtctatatcctagacataaacttatgtgtatactcatag

SEQ ID NO: 397954 - DNA, 516 bp, Homo sapiens
taaaaatgaaacatgtccatgcaaaaatttgtaaacgattatagcagcattattcataatagctaaaaggaagaaacaacacaaatgtccatccactgaagaatgaataaacaaaatgtatagccacatagtggagtactactcagccatgaaaaggaatgaaggactgatacacactacaacatggatgaactttgaaaacatcatgctaagtgaaagaagccagtcaccaaagattacttgtgtgatgccattcatatgaaatgtccacaacagagaaatctgtagagacagtgcttgcttagggctggtggggggcagggagagtagggaagtgatggccaaagggtacagagtctcttcttgaggtgatgaaaatattctaaaatcaaccatgttaatacttgcacataaccttgaatatgctttttaaaagccattgaattatacacttttaggcgaattgtgtggtatgggaaatacatctcaataaagatgtttattttaaaagtcact

SEQ ID NO: 397955 - DNA, 540 bp, Homo sapiens
gttttccaattaacctacctctatacaggaaggagtaacgtctgttaaatacttttaagttaacgtaaaaaacataaaacataaaaacaaaatagatttgtaagcattttgctaaaatagtcattacgtgtctctaaaaaccagaacaagaagacagacagtttaagagtgaaagctatttgctgacttagaccaagtgaaagccaacgctaaccaaaaaaacattttccatgtaaaaacattccttttaatatttcttaacctagagctctactcatcaaaaagagaaagagagaaaaaagattactgcttaaaatctcagcaaagggaacccagtacttaactagaccagctcccagagtgaccagatgcaaatctctttcacaaatagccacagggcagcacggcctcctctaggaacaccggccccaactgcccacccgcgggggcttccaggcctccaggtgccaagacatcccaccaggggccaaccacatgggacctctggggtagggcttccctacagtcagcctccaacac

SEQ ID NO: 397956 - DNA, 670 bp, Homo sapiens
ccttcgatttttgaggctgctgacctttggatggggtttttgtggggtctttttttgttgatgttgttgttgttgctttctgtttgtttgtttttaacagtcaggcccctcttctgtagggctgctgccatttgttgggggtcgaatccataccctactcgcctgggtccctctcgcatctggaggtattaccagtggaggctgcagaacagcaaagatggctgcttgctccgtcctctgggaggaagcactgacctgatgccggcaggaacgttcctgtataagatgtctggcaacccctggtgggtctcagtcaggaggcacgggatcagggacctgcttaaggaagcactctgactgccccttggcagagcagctgtgctgcactgaagggaatccccctcctctggactgcccagacccttcagagccagcaggcaggaaagactaagtctgctgaaccacgaagacgatagtcacccctgcccccaggggctccttcccagggagatcagttctgctcataaacccctacctggagttgctgacatttctgcagggaggcctcgcctagtgaggaggaatggatccgagtcccacctaaagaagcggtctggccacaatctgccactaccactgtgctgtgctgtggggaattcctcctggtcca

SEQ ID NO: 397957 - DNA, 295 bp, Homo sapiens
gaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttca

SEQ ID NO: 397958 - DNA, 461 bp, Homo sapiens
gtatttctgtttttgttctgtggtctgggtttttcatttaaatttatacttctggtaattttgaggatttataacctgattttaattctagtggttgattaatgtcatattctaaatagtgcatatgtacttctatttctcgatgtattggtattaaaaaggaagaacggctgggcatggtggcttatgcctgtaatccaagcactttgggaggctgagatgggaggactgcttgaggccatgagtttgagagcagcctgccaagaaagtgagactccatctctacaggaaattttttaagaaactagctggcgcagtggtgtgggcctgtagttccagttactcgggtggctgaggcaggaggattccttgagccccggagttgcaggttgcagcgagctatgatcatacccactgcatccctgactcctgcttgggcaacagagtgatactctgtctca

SEQ ID NO: 397959 - DNA, 685 bp, Homo sapiens
tgacaggagtggtcatccaataaatatgcctaaatggctggatgtaatactaccaaaaccccacaagttacagacatagtctcataaatcatggttttgtatttatctatatttggaattgatattataagagttttaagtcacaatctgaatctctgggttcctcatcctatcaattaggaagtatttgctgaatgcaaaattattgtcaaaagagaaacttgtaaacaaattacagacatacacagagtaactgctttttaatttttattttatttatttttttgagacagaatctcgctctgttgcccaggctggagtacagtggtgcaatctccactcaccgcaacctccacctgcgaggttcaagtgattctcctgcctcaccctcctgagtagctgggattacaggcacgcaccagcacacttggctgatttttttgtattttcagtagagacagggttttgccatgttggccaggctggtctcctgacctcaggtgatccacccacctgggcctcccaaagtgcggggattacaggtgtgagccactgcacctggccagagtaagtggtttttaatagtcaaattaccaactatttgaatagacggaaaggtagttttataatctgagattctcaatccttgtggcacagtaccatcaaggagagctttaaaaaaaaa

SEQ ID NO: 397960 - DNA, 222 bp, Homo sapiens
cagccctcaagcaaggggttccttaggggccagagacccaaggctctcccacccactcagtgtgttccagaaaagagcgaggcagactggtgttagctagacgtccccagaagccaagaggagaagcagacgggagcctggtgaggtaagcgctgcaggtcctggtcctgacgccagacatttgtgagacccaacctcattccccacaacctgcccaggaga

SEQ ID NO: 397961 - DNA, 360 bp, Homo sapiens
gagccaagatcgcgccattgcactccagcctgagcaacaagagcgaaattccatctcaaagaaaaaaaataaataaattagccataaagcaatgaataatactgtaagatatattcaccataaatatatatcaatatacattaaaatcaaaatatatgattgtctagttaggcagtatgttctaggcaatatacaaaggactacatgtacctagattaggagtttaaaataagacagttgtacagagatacatttgtagattcaacattgatgaatataaaaaataatgtgccaggctcatgctctgtcattcaggctggagtgcagtggtgccggacgcgtgggtcgcgagcggccgct

SEQ ID NO: 397962 - DNA, 369 bp, Homo sapiens
gggtgtctgcatatgctatttaagctttaccgcctcagagcacccgctgccaatcttcacacagacaattcgatcagtccttcaggtcttaagtcacttctcaagaatgccgtacttgcctaggctagattagatcctactgttacatgctccctttatttttgtttttttgagacagggtctcacttacccaggctggaatacagtggtgcgatcatagctcgttgcagccttgaccttctgagctcaagtgatcctcccacctcagcctcctgagtagctgggaccacaggtgcacatcaacacacccagctaatttttgattttttttttgttttgtgcggtaaaagcttgggatcctctagatca

SEQ ID NO: 397963 - DNA, 659 bp, Homo sapiens
gggtgtctgcatatgctatttaagctttaccgcctcagagcacccgctgccaatcttcacacagacaattcgatcagtccttcaggtcttaagtcacttctcaagaatgccgtacttgcctaggctagattagatcctactgttacatgctccctttatttttgtttttttgagacagggtctcacttacccaggctggaatacagtggtgcgatcatagctcgttgcagccttgaccttctgagctcaagtgatcctcccacctcagcctcctgagtagctgggaccacaggtgcacatcaacacacccagctaatttttgattttttttttgttttgtagaaacaaggtcttactatgttgcccagggtggtctccaactcctgggctcaagcaatcctcctgccttggcctctcaaagtgctgggattacaggtgtgagacactgcacctggccccttattttgtaactcttatcaccattataacaacaccgatggtatctttttaatgtcgtcagtctgccctactaaactgcaagctgtgtggaggcaagaaccatgtctgttcactgctgtatttctagcaccaagtggagcgtctggagcacaggtgagagtaaccattataaacggtcctcaccattgtcccagccatcc

SEQ ID NO: 397964 - DNA, 326 bp, Homo sapiens
taaaatatgcaaattcggcagcattccctagccatacttaagcctcacatttaaaacactaactgcatacttttgaaactgtagaaattagggtaaattactttttaaatgagttacagtggaactatgccaattaatgcaggtaaaaagtactaggtttcagaagtagctcggaagtatcaaattattggctctgcagtccaaatgatgtaaaattcaaaactgaattcttctacataactgcaagaactgagtacgataatctcccagcataaatcctgcaaatttagaaatagtgactagagtcttgggatttgcctaaatcc

SEQ ID NO: 397965 - DNA, 349 bp, Homo sapiens
actagagacggggtttcaccatgttagccaggatggtctcgatctcctgacctcgtgatccgcctgcctcggcctcccaaagtgctgggattacaggcgtgagccaccgcgccaggccaactgaacttctttaatgagctgctgcaagaattaaataatataatgtctgcaaagacacaatccttaacagtatccatataaagatttccactgcccactatgtctggctaatttctttaggcttcagtcaaatgtcatttttctgcacagaaatcttctttgactttaaggtccaggtcagagccacctggaacatgctttaacagaatcctatatttttctttcatgg

SEQ ID NO: 397966 - DNA, 5493 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397967 - DNA, 5322 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397968 - DNA, 664 bp, Homo sapiens
ctagatatctcaatatcgccactgtagtaattttaaagtgagtgacaggcccacaattcccagggatcttctggtgtttcaagttgattgtggcaccgacctctctgatgtccagaacaagcattctgtctcctggcaaagtcttttctaagggaggtggcctgagtgtggctctgcccctcccctcctcccttctgagctatggatctgcttagtgagcataatcaagacctcctagacgttatctggagtctgagttcccagtgagacataactggagggtaaatgtgtctggctgagaacagaatgggaggaattgagcccttgtttaaaattatcagctctgggttaacctatctttgttttctgtctttagacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggtaggccatgcctcctgggggctgtgcactgccagtcagatttaggtccagggatgttcctcagagcagcagtcccgagctgttttggcaccagggactggtttcatcgaagacagttttaccacagaca

SEQ ID NO: 397969 - DNA, 5102 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcagttggagaccgctgttacgaggagggaatgtacgaggctgccaagctgctctatagcaatgtttctaactttgcccgcctggcttccaccttggttcacctcggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397970 - DNA, 5627 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggtgtccagaaggtgcccttggctccagagctggaccattcaagtggatggcacgcacgtgcccacctgtgcccctgcctagtgtccccataacaagcttggccaagtgccttgacggttccctcaacttgtcaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397971 - DNA, 1238 bp, Homo sapiens
actcactttattgcaatgttcactttattgtggtggtctggacccaaacccatgtgtctctctaaggtgtgaatgtctgtggtgacattggcatccactgaatcgcccagacagtcctctttgtgtgagtgtaggtcttttggttctaggtgtccagaaggtgcccttggctccagagctggaccattcaagtggatggcacgcacgtgcccacctgtgcccctgcctagtgtccccataacaagcttggccaagtgccttgacggttccctcaacttgtcaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397972 - DNA, 5610 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggaacagtgtgggtcaggaggcagcgatcgatgagcagcatgccagcgggggagacttctttccggagccagctcagcacatcgggtccatgcagatgtgggcactgggcgtcctcaggggtctcccaaacggaactcagaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397973 - DNA, 3668 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcagtaagtgagtcccctctccctagggctctgcatctcactgatgcaaaacctggctgaagcaagaagttgaagagattctcacaaatctctacgtatgatgtatccagagatatcagagggcacatctacatgaaagtttcccacaagagtctgagataaacattattctgttattgacacca

SEQ ID NO: 397974 - DNA, 459 bp, Homo sapiens
ctgggctccaggccgcaggagcgggacactgactgggagcttcctgggggctgcttctactggaagtcctctgggaaggcagtgagacagtccccaaggcccacagaggaggaacagagcagggcccactttaggcacatgtggaagacaagtcagcaagggtaggctgggccggtggagggcacggcagggagacagatgagcgggcgtcacaggtcctcaaagcggagacccaaaggcacctggagctctcacctgagggtcagaatcctggtgcctttgtaggaacagtgtgggtcaggaggcagcgatcgatgagcagcatgccagcgggggagacttctttccggagccagctcagcacatcgggtccatgcagatgtgggcactgggcgtcctcaggggtctcccaaacggaactcagaggtgtgtgctgcaggcgatggcaggcatgcagag

SEQ ID NO: 397975 - DNA, 314 bp, Homo sapiens
ttgctgcagtacttcggaatcctgctcgaccagggtcagctcaataaacttgaatccttagaactttgccatctggttcttcagcaggggcgtaagcaactcctagagaagtggctgaaagaagataaggtagaaacacttgtgagctcgtagcccccccgcacagcttgaaaacttggtccaggctccctacctgcctcctaactttgccttgtcccttggcataccacagctggagtgctcagaggagctcggagacttggtcaaaaccactgaccccatgctcgctctgagtgtgtaccttcgggcaaatg

SEQ ID NO: 397976 - DNA, 5372 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctgatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397977 - DNA, 2212 bp, Homo sapiens
ctagatatctcaatatcgccactgtagtaattttaaagtgagtgacaggcccacaattcccagggatcttctggtgtttcaagttgattgtggcaccgacctctctgatgtccagaacaagcattctgtctcctggcaaagtcttttctaagggaggtggcctgagtgtggctctgcccctcccctcctcccttctgagctatggatctgcttagtgagcataatcaagacctcctagacgttatctggagtctgagttcccagtgagacataactggagggtaaatgtgtctggctgagaacagaatgggaggaattgagcccttgtttaaaattatcagctctgggttaacctatctttgttttctgtctttagacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397978 - DNA, 5634 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggaacagtgtgggtcaggaggcagcgatcgatgagcagcatgccagcgggggagacttctttccggagccagctcagcacatcgggtccatgcagatgtgggcactgggcgtcctcaggggtctcccaaacggaactcagaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaactg

SEQ ID NO: 397979 - DNA, 3617 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaaaggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacaagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcgctgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagcctgggtgacagagcgagactccgtctcaag

SEQ ID NO: 397980 - DNA, 137 bp, Homo sapiens
ttttttttttttttttttttttggtcagttggattgtccactgcaattaagctgtgcaagagcaaaataaaatttgtttgtttgtttgtttgtttctctataactatctcatgctctgcaggaacctctacccttct

SEQ ID NO: 397981 - DNA, 476 bp, Homo sapiens
gagagatgctgaatatgcaggagtgagaataaagcaatgttcttgagtagtggtacaatacaaatatgctgaatgaattgaagctatagaaaaacattttggggctcaatgttgtaaagaggtctcaaaagaagggacaagctaactcaaggaggagtccccagttaccaagtaaacttactcagaagttaaaagaccatttgttgggtatgttatccagggacttgaactggggttagtttaaaataatctatttgggataggagacttttaaggtcctcccatactggagcttctaaatctatgatcagtgccacagtcaagagagccatcattctgagagcctatgtcacagagtgaatggtgactcccacagttgtggacaaaggctaaaaacagatcacaaacttataactcatttggttgggtgtggcggttgacacctataatcccagcactttcggtggctgaggtgg

SEQ ID NO: 397982 - DNA, 648 bp, Homo sapiens
ttcgacggtgtcttgtgtatataccatttccctagcattgttatctaggaatgaacagattaatctagcagctcagaataaagatccagagtcttttaatcacaaaaaccaagtccaacgtttccaaagattatcaaagcgaataaaccatattatggtaaatgctgtacctttcctcctcaagccctgggactctactacatctctgttgaatgattgttcaaggtttttttattttttgagacagagttttgctctgtcactaaaaaaaaacaaaaaaaaaaccaagtgttgacaaagatgtggagcacaccattgtgcactgctggtaaaaacgtaaaatggggccaggtgcagcggctcatgcctgtaatcccagcactttgggaggccgagacggacggatcacaaggtcaggagatcgagaccatcctggctaacacggtgaaacctcatctctactaaaaatacaaaaaaaagaaaaattagccaggcgtagtggcaggcgcctgtagtcccagctactcgggaggctgaggcagaatggcgtgaacccggaggcggagcttgcagtgagccgagatcacaacactgcactccagcctggacaactgaacaagactccgtctcaaaaaaaaaaaaaaaaaa

SEQ ID NO: 397983 - DNA, 153 bp, Homo sapiens
ttggaaagattcattggcagggccctttgggaggaagtggaggagggctggaggggcatgggcgagaggaaggcgcctgcctccctgccacgtgggtgttccccctccctcgacgtggagctgaaatatccctgtaccacctagacctgagtc

SEQ ID NO: 397984 - DNA, 474 bp, Homo sapiens
actatctaggagttaggggtcatctgaggacactacttccaccgactgcaccttctgaggatttaagcattcttctttagcggctgctctgtcaggcactgctggtcaggttgggcttgttctgtgtgcctatgtgggtgtctgtctgttttcctagacaatttttcctgccaggctaggagaaatctgccacttctttttctatcatttaatcaggttttgagagcacaatatttgatccttcttttaggtacctgcttctggcaaagtgcaaagactatcctttggctaatgattactgccttcttttagttggatctacttctcaggacgtgaagtgaaactcttcttagctaaccttctcattgttgagtcctgctctcaggcatctgtgcatggctttgtaggaaagaggcaagcatatcatgacaaatggtcccactttattctgttctggtaattggctaagtttca

SEQ ID NO: 397985 - DNA, 512 bp, Homo sapiens
cagatgcttcctcctggccaaatcccaaatcccaccctcagcacccacaccctgagcagtgggcaggagaggcctgaaaacgtctgtacaaatggcttccgagaagccctggagataaaggagccagaggcagccacacatggttcccagaagctgaatgctgcgcagacgacaggaatgacttcacccatcctgcttccacccgccatagcagtgaccaaagcagcactgggaccacagctgagcacctcagaagataagtcctggggtgattcttgtcatctccgtgaaaaggagaagacaaaaaggcagaggctgctgcttgaggatcccttcacctgggctgcatagctcacccatgctgaccaacttccccatttcaagcttcagactcacagccgcgctagttagggtaccacttgttcagacagctgttttcattcacatctccaaaggtcctctaccttagaagaagaaagaaagagggaaagagaaataaaagagattaatta

SEQ ID NO: 397986 - DNA, 395 bp, Homo sapiens
ccagctgtcctgtcaggggaacctgctatttatttcatgccatccggtcatggcatcctctgtctgttttgacagcagcctctcctgcttgaggtcagtgagggcctctttagcctcaagttgcagaacaggaatctcaatgacttcttccccgtggaagaacttcttccccttggcccatcaccagggggcgcagcccgaccaaacgtggaaaataaaggaggctgtgaataaagacaggataactgactgctcatacttccagaacagtttttaaaatgtcagcatattacctttttttctgtgtctatacacaactgtgactttttaagaattttgatcatactgattacatgtgaacttacaaacttttctgaaaaaacacatttttctca

SEQ ID NO: 397987 - DNA, 424 bp, Homo sapiens
aatatcaccttgatttgttaggatgcatttgacctcctgtcactgacaggagaaggggtgaggtcttcttctgcagacagtaaagagcaggcagttttatttctcagatccttttacaagatttgaggagtaaggaagagacagcagatggttttgaagagattcaatcacccatgggtactgctgcagaatgtgggtcctgcaggcacgcaaatattcaaaacaaactaaacctttaaataaatagagaccatgccattaccttctcaatttgggacgatagacattgatatatacattttaacttaatatcaacatgaaatcaaagggctatgttcatcttttagtgaccacagatggtacaaataccaaggtagatgccaaatataccaagcgatggtgggctggggtaccggttactcca

SEQ ID NO: 397988 - DNA, 534 bp, Homo sapiens
tcaaggatagtttgacaggccagggggtctccttgtgagtgaggcctcatagctggttggtgggtccgagtggagccattggtggtcagaagtgcaaaaacctgaaaagacatttcaaaaggccagtcttaggttctagtacacaatagtgttgctatctgcagaaataattgagcacgttgaaatcttgtttcctctaggataatggctgataattgtgtacgtctgttccttaacataattcaggtccctcattctcctaacctgtgttcttgtattagttttgcaaaggccgtgtaggtttgggaaaggctgtcatgcccaggaatgactaaaggcggtttggaggttaaaggcaaagtggggattgtttagatacgttctctttcactgcaataattttctcactgttactatttttgcaaaggtgatttcattatgatggcttcttgggtttaatttcacagatgctaaagtccacttacttttttgtttactgacacaaaataaaaaagtattagaataagcagaatt

SEQ ID NO: 397989 - DNA, 364 bp, Homo sapiens
gcagggtcagcagactttgagatcccacgtggtcacacaatgggattctgggggctgcgacaggggagacagagggcactcgaggggcaggcaggacagcccagcccagaaaccagccaattgacctgttgctaggcaggcaggggcacgccgtgcaggaaactgcatatattttgggttattctgctccgatgaccatcacagcaggatattccaacttctacaagtccagtctcccaacctaagagaagacaaggttggcgatgccagagcaagtatgggaagcagaatcgagaagtggccaaggctcctggcccaagctgggtgggattttgggcccactttgaggaaaaggtggcacctg

SEQ ID NO: 397990 - DNA, 141 bp, Homo sapiens
tatttcaacaatattgcctttgcctaaaatgtttcagggactcacatttcaatcaatcaccttcagaatccatgattcattcccttgaagatgttcaacagctgtacctctttcttcattaaagatggatttaatttctgg

SEQ ID NO: 397991 - DNA, 1622 bp, Homo sapiens
caaatgtagaccctgcactcaatgtgcttaccctgtaggagcagagacagataagtcagatttcagtctggggcaggtggagccatgatgaagccttccccacacttgtgagaccactttgggagatgggaggcatccccaagctgggtcagcttgaacccaccagcaggggtgagcaggtcttctgcatacagggttttcagagacaccgggctggcccgagacacctgagctgcatcagagaacaataggttctggggcctgctgcggctgaggtgccgggtgggcacgcagctgggggcacccaacaatgaccaccagggcactagtgttcatcgggtaccaccccgtgtgccagggaatgtggactcagtgcctgccatgtcccttgctccgtgcaagcagaccacgtctgtgctctcactgaatcctctggagggacacctctctctacctctgtttccctttggtagacgtctgataacacacgtcgtattctcttcactcagaattcatagatgtcggctgggtgcggtggcttatgcctgtaatctcagcactttgggaggccgaaggggacaggatcgcttgagctcgggaattcaagaccagcctgggcaacatggctaagtctcctctctacaaaaaaaatacaaataattagccaggcatggtgatgcataactttaaccccaactaatgggggggctgagatgggtggatcacttttgggcctgggaggcggaggtagcagtgagtggagatcacgtcactgtactctagcctaggagacagagcaagactccatctcaaaaaaagaaaacaaaaaagaattcatagatgtaacattttgcctttgatacttctgatctttgttaatcatgaaaaatactcactgggcacagtggctcacgcctgtaattccagcactttgggaggccgaggcgggtggacctcctcaagtcaggagttcgagaccagcctggccaatgtggtaaaaccccgtctctactaaaaatacaaaaattagctgggcatggtggcacacccctataatcccagctacttgggaggctgaggtgggaggattgcacgaacctgggaggcaaccagctctgctcacgtgagctgagctcacgccactgcactccagcctgggcaacagagcgagactaagtctcaaaaagaaaaaaaaaaaagaaaaataccagaggttgaagtcctcccatccccctttcttacaggaagtaactgtcgagaaattgtgtgtctgacaacccctgttgtcctctcagtcaagcagtgtgtgccgtagtttcagatgtttgaccctttatgcagatgacgacatagtgtgcgttttgttccaagcttttttctcttactcgacgttattttttttaggtctagatggtccaactaaatctcattgagttctgtaagcagctggttacctccatttccacactttccatttaggaagctaaggcttaaaaagatgaagcccctgccaggcatggtggctcatgtctgtaatccctttgagaggctgagctgggaggatcgcttgaatctaagagtgtgagaccagcctggacagcctagcaagaacccatctctgc

SEQ ID NO: 397992 - DNA, 611 bp, Homo sapiens
cgttcatattctctccattgttcaggagcacaaaggatgttagcaagaaaagacacatgacccatggccgcccacacacccacatctctccacgccccgtgccatttctgcccgccgctgcgtgctgggcggtttcctctgcacagagtttcccttgagctgctactctgaggtcgtgtgcctgttgtcatctttatgatagaggtcagtgtcaccctcctgccagacacttctgccagctcctctgcctcttcactcgctccttcttgcccatccgatggctgcagcacagagtccatgaagggggtggtcagtgccagcccccctcggcgggggagatggggcgggcaatcacagggttcagtggccaacggagaggtagggtagccagagattgtcctaccccaatgactttgctgtagtcacagagctttgaggcagcctctcccctgtgctcggggaggccccatgcgtgaagagcccctcagcccctggggagacagagccataaacaaatgattacggaaataatggctaaattagaggcaaccgtggaggactgggagcccagagaaggaggaacttatttggcctggggggccaaagcaggc

SEQ ID NO: 397993 - DNA, 482 bp, Homo sapiens
gcctggaaaagtcatggtgggcttcccggaggaggcgtccttaggctggggcttgaagacgaggtatttaccagacaaatagtggagaagaaggctgtcttaaacagaaaaaacttcttatgtggtcctgggttctgagggcccagctcttctcaccctccttctccgaggagtgggggaacggaagtgcagagccttcgtgttttaccctccttctccgaggagtggggaacggaagtgcagagcctttatgttttgtgacagtggaatccccttcgcgggccacctcctcgatctgaaaggctctatctgcagctactgaattcccttcagctcgtaagtcttaatagcaatgtcatccccttctgaaaactttcctggactgctccttatcttgctgccggtgattgaaagcaatcctttcctctctcttccctcacacctgcctgtttgcattaaagttcttgagttggactccatca

SEQ ID NO: 397994 - DNA, 482 bp, Homo sapiens
ccatggtgtccggcttcacttggacagaaaccctggatctgtaaccgcagcctcaccctcagcactgctgccagccgagaagggtctccggctcggcccctctgtgccccctcagcagacagaacataagggacttcttatctccaccccaggacattccagttatttagttatttaaaaaaataataatacagtagttgttttgccaggaaattcagcttcggaatacaaccttttaaggctgaggcaggcagatcacgaggttaggaaatcgagatcatccttgctaacatggtgaaacccgtctctagtaaaagtacaaaaaactaggtgggcgtggccaggcgcagcggctcatgcctgtaatcccagcactttgggaggctgaggccagcagatcataaggtcaggagatcgagaccatcctggctaacacggtgaaaccctgtctctactaaaaatacaaaaaaaaaaaaaaaaaa

SEQ ID NO: 397995 - DNA, 605 bp, Homo sapiens
ctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttc

SEQ ID NO: 397996 - DNA, 559 bp, Homo sapiens
gtttcgtcggtgccgaggacatgaggggtgtagatcaggcctgtttcaaacacaaggccttttggccagagtgtaatggtgtgaggacttgggaagaccttacctacttaactgtctctctcaaaggacaaaggtatgagggggttaaaaaaaaaaaaaaaaaggcaaagctatgaagaacatgaagttcttaagcccctagacactcttccaaggtctggcctgtatcccagagtccactgctgaaaaggggcagagatgtgtgttatatgcgcacatacgtacgcatagtatagctagcatatggcattctggtggcctcgacggagctcacaggcaatataacagcattgactgctttcacagtttccacttgtctcaggaaaatagagaaaattcaagatgaaatacagtgagtttaggacaactcagtttcctaaatatggaagatcctgtcccttcccaagtattgaaagagatgaaaattttcccttagttttcaagctcaaagtctatcttatctttgactaaatagccctgatttggatactgttaactt

SEQ ID NO: 397997 - DNA, 299 bp, Homo sapiens
ccatcagttgccacttcctctcattcccaatggataatgaattcccaatacccaatgataatgacttacttaaaactctctgacagtaccaggcttctcacctgtacaatatctttgtacatgctattccctcacttaaaacattctccttatcactcctagtcatctgttgagatccggattatgtgtcagtgactataacatgggaaaggctgacttagggcgtcctcttctgcaactctatcacagtgttcactcttaaaattttattttttttttagagacagggtttcgatata

SEQ ID NO: 397998 - DNA, 485 bp, Homo sapiens
ttttgtcctagttttgctttcttatatatatggttttggattcatgaccttaatacctgtgtcatttttaggaaatagtttaatttttgtgtgtgtcatgtgatgacaaaatggaaaagaaaagttaaatttgggggataaaatttaggaacctgcagttataaagagtaaggacagtgatactaatattgagggtaggggagagccatctcagatcccaagacttagagataaatggtgaaactctgagaaatcattaaactagcttgccctgttgagaccctctgtagtactatgtaaggaagaacattttgtattttctcagttaaaaatgatctattttgtctattttctttgcaaaactggctcaggtgagaggacacttaaaaaaattttccccatgcaaaagcacaattattggttttgtataattttgtataatttttgcaggcatgagtcttgatgcatgacagcccgagcttttg

SEQ ID NO: 397999 - DNA, 589 bp, Homo sapiens
attatccagcacagagaagcaaacaccagaagcttctctccaactttcagtttttctctaaacttccagtccttctcatactgtgtcctggttataatagttgctgggaccttattctattctgaatccccagcccctaaagaaggcttggtactgacgtgtacagcgtagttacccagtgactttggggaaggcaggaagagtgtggaaaggacaggaggaaggaagggaggggccgtggctccgagctgcctagaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggaggcggttcggaggtttgatgaaatcctggaggccagtgatgggatcatggtggctcgtggtgatctaggcattgaatcctgcagagaagtcttcattgctcagaagtgatgattgacgtgctga

SEQ ID NO: 398000 - DNA, 1254 bp, Homo sapiens
attatccagcacagagaagcaaacaccagaagcttctctccaactttcagtttttctctaaacttccagtccttctcatactgtgtcctggttataatagttgctgggaccttattctattctgaatccccagcccctaaagaaggcttggtactgacgtgtacagcgtagttacccagtgactttggggaaggcaggaagagtgtggaaaggacaggaggaaggaagggaggggccgtggctccgagctgcctagaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtgtaagttatcatgtgccctgctgt

SEQ ID NO: 398001 - DNA, 515 bp, Homo sapiens
gaatatgataggtaaaaaatgatatctcaacagttttaattagcattttagttttgattggcgtgtgattttaatatctattttgagcatatactgcccttttttcctgcagataatgaaaaaatagaagcttcactgagacgattagaaatcaacatgaaagaaatcaaggaaactttgaggcagtgtaagttatcatgtgccctgctgtttctgatggcccccaaactagaagtcatcagtttactgggaccccagcctcccgctacccctgcatttgtccattttctgtgctggatggctggaagcagcccacaggtttggggatccattcatggctagcccaggcttctgtccatggaataacatgtggagagagcttcttgaccagtaagataccttctagcagctgtcaaagtacttaaaaacctctatgaatagaatcaaagcttcagttcagttgctgaatttccaagaagaaattcaaatcaaatttaaaatgcccactcattcat

SEQ ID NO: 398002 - DNA, 1114 bp, Homo sapiens
attatccagcacagagaagcaaacaccagaagcttctctccaactttcagtttttctctaaacttccagtccttctcatactgtgtcctggttataatagttgctgggaccttattctattctgaatccccagcccctaaagaaggcttggtactgacgtgtacagcgtagttacccagtgactttggggaaggcaggaagagtgtggaaaggacaggaggaaggaagggaggggccgtggctccgagctgcctagaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtgtaagttatcatgtgccctgctgt

SEQ ID NO: 398003 - DNA, 929 bp, Homo sapiens
aagcaggcgtacggtctcgagttctaggatgacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtgtaagttatcatgtgccctgctgt

SEQ ID NO: 398004 - DNA, 420 bp, Homo sapiens
taaaaaacctgcagttttgtttgtactttgtttttaaattatgctttctattttgagatcattgcaaactcaacacaattgtaagtaatgatacagagggatcttgtgtacccttcacccaggctcccccaatggcaacatcttgcaaaactacaatgtaatctataaacaggatattgacattgataacgtgaagatccggacatctcataacacaggatccccggaggcccacttccctccacccccacaccccagccgtgtccctaacccctggcaaccaggaatccactctccatttctataatgttgtcatttcaagaatgttattcaatggaattatatagtatgtaacctgttttgagcttaaaaaaaaagtatacatgactttaatgaggaaaataaaaaaaaaaattgaaa

SEQ ID NO: 398005 - DNA, 362 bp, Homo sapiens
cgagatcggttcactttgtgcttcacatgtccttcacatgtcacctctctactccgtgaacttgcaagtctcacctgggtctctcactttccattccctgtctctcagatctactagcacaaggctacagccacaaagcacttatatagttgggcccctttgctgacacgtgacatgcaattcagggatgcctcctcctccccctagaagtgatgagtgcctgcagctattgtaaatgttaaagtaaaattaatgttggttgtacacccatgttcatagcagcatgactcacaatagccaaatgtagaagcaatctgtattagtccgttctcaagctgctaataaagacatatctgagacta

SEQ ID NO: 398006 - DNA, 386 bp, Homo sapiens
acttaactactgaaatcaagactttgataaatattatccaacagagtttgggctgctctctgtagctagtacatggtatttagaaagttcatattggataaaggacttatatccagaataaaaaggactacaacacagtatcagcaaactccaattttaaatggacaaaaaatctgaataaacatttcactaagatacatgaatggctgaagagcacataaaagatgctttgacattattcgccatcaggaaaatcaaagttaaaaccacaaaggaatatcatttcaaacgctaggatgggcataatttttaaaaaacagacaacaatgactggcaagactgtagagaaatgggaagccccacacattactagtcagaatgtaaaa

SEQ ID NO: 398007 - DNA, 372 bp, Homo sapiens
tctacccccttacttttaattcacccattagccagcctccttgtgtcttcacttccttccctctgtagttttagttcatggcttatcacttcaatcattcctttgtcaaatttttttgtccctttttctctccgtgaattcaactattaactatctgcattctcttttactttacccagactaccaaatgtgcagcctagtgcctctacatacactcatgatcacacacctcaactggacccttagcttttctcgatcctactattccctagaaagttagtcttcctgtttaccattagcattttaaaccttctctacttttcttaaacatctgacccactctcagcagataatcctatctcatatataaag

SEQ ID NO: 398008 - DNA, 946 bp, Homo sapiens
caccagcgacatttgccttccaccctgagtagagcagcacaaggccctccccagatgagatccccaatcttgaactttccagccatccagaattgtgagccaaataaccctctttttctttatagatgacccagcttcaggtattcccttatagcggcacaaaacagactaagacaagatataaaatccacaagtccgtattggcataaggaaatcatttagtaaagaaataaataaatgggagagaagaaacaaaatgtcctgtgcagaattccaggttatttatgcagctactccttacttaaggagatggccatagctccccactccgtgttgagtggtgacttccttccagagagcacaggggtggggagcagctctgcagcagagaaactgacaggcacgaccccagccaggcacttaaggtcatcatcaacagtgatcagtcgtgaagccttggaaggatgggaagagaaggggtatcacctctatggttgtcctcccttaaacacataaccacagtctagtcgtgagaacaacgtcagacaaacccaaattgaggtgcagtctacaacacacctgatcagcactcctcaaaaccatcaaggtcacccaaaacacagaaggtctgagaaactgttgcagccaaaaggagcctcaggggacaggacacttaatgtgatgtggggtcctgagtgggatcttggagcaggagaacagtagatgcaagctgaggccacctgaatcaagttgtgctgaatgaggtgtgagctttagttaataacaggtcagtattggtttattcattgtagcaaatgcactgcactgatgtattaataacagggtaaactgggtgagaggtgtaggagaactcttcacacactcttgtcttcttttctgtaaatgtgaatctattctgaaattaaaaggttattttaaaagttta

SEQ ID NO: 398009 - DNA, 233 bp, Homo sapiens
tgcttcaacccatctgacctccattttctttttcacttaaaaattttaaagtatttgttttttggtaaaaatggaaagactatagaagcacagcagctaaagataacttctgttcatattttgatgtatactcttgagtttttcattttcatttaaaaaacagaggtagtatatattttaacccaattactttcacttacaaagtatgttgtgaatttattttaatcacttca

SEQ ID NO: 398010 - DNA, 544 bp, Homo sapiens
gtccacagcagcatatctcttcacttagcttaagaactgtcctactcctacagcatacatttagatgcaatcacaccaaagagtgatatgtcaagtctccaccacttcagcaagagtgagtggatttaaaaatgttatctgtgatggaaagaccagacgaccaggccagagtcttggggcaggtggtgtgttaataatagaaattctactccttttatgccctttcaccctttattctaaggatgattccagggaaagccaaacatccaggagaagaagccaacatagaggaataagaaaaatcactagtctaggaataagagatctggattccattctagctctgttttaagaactagtatatctttaattaaatcttttctttcctgcaagcttaagtcccacatctgcccatgaaaaactttgacacagttaacttcatagtacatgctgactaaatattgtagagcttccttaaaaagaaagaaagagagagggagggagggagagggagaagagaaaaagagagaagacaaaaagagag

SEQ ID NO: 398011 - DNA, 353 bp, Homo sapiens
gcaaattacgtgtttgctcaggtggttttgttctcctggatattttgagaccatttctccagatagagaagacaagttggtctcttgttaatttgaaatctttgagaatccaggtttttcttttggagagggggatgtgattacaagttcagggtccttccctacctcccaccacccttttgagatgaactgaaatcatttaatagtgaactggcaaaacagctttctatgctttcacatgttgttgacgcttgtcctggaaaacggaatagcagacaagctaattaaaattcaaccctttagctctttggttgcccaagaaagaacactttgatactgagtttgtaaagtac

SEQ ID NO: 398012 - DNA, 501 bp, Homo sapiens
caatatagtgagcctcccttctctacaaaaaataaaaaaattatctaggcatggtggtgtgcacttgttagtcccagctactagggaggcaagagaatcgttgagtctaggagtttgaggctgcagtgatttccacattgcactgtagcctgggtgacagagtgagatgctgtcttaaaaaataaacaggaaggaaactcttgcacaagctacaacatggatgaaccttgaggatattatgctaactaaagtaaccagttacaaaaagacaaatactatatgatttcacttatatgaggtatataaagtagtcaaagtcataaagacagaaagtggttgccaggggctgggagtagcaaatagagttattgtttttctttttaaaatttttttagagatggggtctcactatgttgtccaggctggagtgcaagggccaatcgtgaatgaaatcatagcacaccacagcctcaaactcatgggctcaagcaatcctcccac

SEQ ID NO: 398013 - DNA, 443 bp, Homo sapiens
tggcaccactgcactcctagcctggacaacagattgttgccctgtctgaaaaataaaaaaaaatttctgaactatgccagtgataatctggtaaattataaatgttgtctgacttttttctttggaaaatgaattaattcagtcctaaccttctctcttaatcacaggttgcaataaattaccagaaacgactggttcataccttatacacctccagtgtaaatgttaagagtttgtatattcttaacagactcttaacaaacatcagtaattctttcctagggataagtgaaaatgtactaacattaattctattatatatatgcaaatatctagaggaaatactgtttataagttactaatacatgtatccatggtagtaggtcttgaaaagttacttttgttgcctattggacaccctctattctcccttccttaataaa

SEQ ID NO: 398014 - DNA, 497 bp, Homo sapiens
ttatttttcttaggcagggtagtagattactttttttatgtatctgaagtcattcatttttaaaaagctattagaatttctcagtttcttttgaattcataaaatgacagccttggaatatgcaggtctagagtgtagaattctgcaacttttgttaagttcacagtttaaaaaaaatacaaaaattagctgggcatggcatgtacctttagtcccagctactcagtcccaggctgaggtgggaggattgcttgagcctgggaagtcaaggctgcagtaagtggtgattgtgccactgcactccagcctgggcaacagagaaggaaaaaagaagagttgctgcacccttgcaaaaactatgaaaattcccttagaacaaaatcatggtccactgtgagttttgtaccaggcaacatacatagtattacctagtgccaagagtttgatcatagagagaagggttttaacaaaaccaggaggcataaggtgagcacttt

SEQ ID NO: 398015 - DNA, 445 bp, Homo sapiens
cccagaccctctggacaaaggtccccactccattttctttacctgtaaagcaggacacagctccccatcccaaacttgtctggattgggctaactggcttttatgttctacttggattgctgtgattcgctaactgcccccaggcaggggcattagctgggcaggactgaggaggcctgggtggggtcctctgagctgcagtgcactgatcgtgtgctgtgcgctaaaatcggagcacttctcttccagagagttctgagggggggcccatctgttgtcttattagctctcaaaacattgctgggagctcagggtaggggaaggggtgcaccatgtttttagctccacaattcagattttactttccaaccgagattgattcttgtttggggctgatgtccccaatagatagatgaagcctgtgcctaggacatcaaagtgtcaa

SEQ ID NO: 398016 - DNA, 509 bp, Homo sapiens
ttcatgggtcctttgactcccacgtttataaagatgctactggagttccacgaggggtaccagataaatttaaggcccgaaatcaaacagcttcaggatttgaatctgtgctgttttggtggtcaactgtaaataaaaatgtagatcggataaactacatttattacaaccaacaaaggtttgttaactacacaagacatgccattaagggaacagcctcccaattaggtcccattaactaaatagtctgggaaaacaggatagccctagatacgatgctagcagaaaaaggtggtgtctgtgtcatgattggagtccaatgatgtacttttattcctaataacacagcccctgacggaacagtaacaaaagctttgcaggacctaacctccttatccaatgagttagcaagcaattctggaataaatgatccctttacaagtttaatggagaaatggtctggaaaatggaaaggcttaatgtcctcaatatttacttctcttgcaatc

SEQ ID NO: 398017 - DNA, 440 bp, Homo sapiens
gaggattgggattgattgccaggggaactaaccatatgattagaagattaaaactttcaaccccatccctcaacctctggggaggggagaggtactaaaggttgatttggtcactaatggcctatgatgtaatcagtcacacctatgtaatgaagcctccataaaatctccaaagggcagagttcagagaacttcaggattactgaacacatggaggtgcctagatgtttttgcactgggagatggcatggaagatttaccctcctttccacatgccttgccctgtgcatctctatcatctggctgttcatcagaatcttttgtaatatcctttataatcaatcatttcatgtgtttctctgattactgtgaattgtcttagcaaattaatcaaacctaaggagggagtcatgggaaccctgatttacagccactcagtc

SEQ ID NO: 398018 - DNA, 311 bp, Homo sapiens
cagaatggaatatcagagtacattttcatgaagtttaaaaatcaaggactgttcctgattagatgacgtatttattggtggccttcttatctaagcacatgagtagttggctctgaactttgtgtatttgaaaaaggaaaattcagtggaggcttttgtttgtgtgtgtgtggctttgaaaacaaattatttgagaaagaccataacacagtgagtagcctatatgtgcatttactgaattgttaatttaaggatatatattaatagagtatgtttaaaataaatattgttttcatcactgactttaggaa

SEQ ID NO: 398019 - DNA, 130 bp, Homo sapiens
gcaagaggaattgccaagggccagagaagtgtattgaatatacctcagtgtagtttattgttcccagcctgtctgcctctccctgttggccaacatggaaaatcaatagacatctaccagtaaatctaat

SEQ ID NO: 398020 - DNA, 434 bp, Homo sapiens
ccctgtgggcagagactggatgtgcttgtggacgtgtgcagatttctctggcttgctgtcgtcaacctccccttcggctgccgcagtccaagttcactgagaacttctctttatatcctagatgctgtctcctcgtgactcatcttccttcttcacagatacctcctctgccttcctgcatggacaggtctgtcttgccttgatcaggcagatctcaggaagttccaatcaggaagcagctttagtttccccactgttgccctccgtcacgctgtgacagcgtgtcttcccgggacgactgccttcaacctggcagaactccttgctttctggacacttttggttattggaactgctattaaaggttcattgcagtccagaacaaaatatcactctctccaatttacatgctttcgccctctacccagctcaag

SEQ ID NO: 398021 - DNA, 417 bp, Homo sapiens
tgcaatgacgcgatctgggctcactgtaacctctgcctcccgagtagctggttcaagcgattctcctacctcagcctcccaagtagctgggattacaggcatgcgccaccacgcccggctaattttttgtatttttaataccgacggggtttctccatgttggtcaggctggtctcgaactcccaacctcagatgatctgtctgcctcggcctccccaagtgctgggattacaggcgtaagccaccgtgcccggccagtgctacacactcttaaccagatcttacaagaactcactcactatcacagcaaggggatagtgcaaaaccattcatgagaaatccacacccatgatccaatcacctcccaccagaccccacctccaacgctggggattacaatgcaacatgagatttgga

SEQ ID NO: 398022 - DNA, 519 bp, Homo sapiens
cctgactgtttagaagttgatcaatctatttgaagatggggaaataaggctgagggagatattttatttatttgagatctcatgatgatataaattaaatcagatatttaccagtacctgaaaactgaggtatctaaccactaataaaattagtctgcagcacaggtctgtttagaagaaagactagggattacaaaatactatcaagccatatggtataggaagttataaaaactattttttgagcagagtagaaattaatgcttatttattcttgcctctttagaacatgatttgaattcagcattacaaacagctgttggaggcctgtttctttaagtatgatatggtccttttacttctgtatgagaagcaccaggagtgcataggaaatcagcctggttccattctcaaaaaagcttacatatagagaacagaatgtgcacaagcaaaggagagagattaattcgttccttaaaggactaggagggacttctttaggatctagtatttaaggca

SEQ ID NO: 398023 - DNA, 151 bp, Homo sapiens
tacgataacaccaatgttgtttggccgaagggcagaacttacagtaagtacctgctctgacaccaggaactatagagaaactggaaatcttagaggcctggggtgatatgatttggttgtgtctccactcaaatctcatcttgaattgtag

SEQ ID NO: 398024 - DNA, 168 bp, Homo sapiens
taaaattttgttgtaggtccaaaaataaacaaaaaggtagctatgattcccaatttctgtattgtacaaaagttattaaatcctaccaatgaatactattatttgtctaaatagtttataaaaaaactgctcagctacaaactccctgaacacagcaaatagcttata

SEQ ID NO: 398025 - DNA, 240 bp, Homo sapiens
tatctctaacattaagtaatttactgtccctttggaaggtaatatatattcccctaaacaggaaaagtaagtttgcaagggagcatggtttatgtacagtcacaggagtagggcttgtaaaagattctgtagatattgaggaggaggtatgtgtgagacagagcatgggatttaacatgtatagtaatgacctgcttggagatggaaggatttgagccaagttttgtaatgttagagata

SEQ ID NO: 398026 - DNA, 495 bp, Homo sapiens
tttggtagctggagctggcaagaaatctttcttattttctgtaatgtgttttataaattatgtgtggtctaatgattatatggttgtaagaaaaataccataaaggaagagtgtttgtccttagttttcatctttagttatccataaaatctgaactctaccctgaaaaatttgtcgtcattgtatttttcatctttcctcgatatctacttgttagttcaatactatcttttatcaattttaatgtactgttccaaagaacatatttgttactgttttcatagggaattgagcagtaggacgtttttcttacagaattaaacttacatttttctccatccactagatggctcaagtgcaccactttggcagctcagattgatccttgcttgctttgcttgtagtttctactttgagtactgtttgctttttaaaaactggatgagcccttacctgaacctagctttacatatatgtgatggcagatttcctcgc

SEQ ID NO: 398027 - DNA, 976 bp, Homo sapiens
cgcgcgctgcgcccctgctgagcggcgcggagctaccacgccctgccagactcgcccttgggtccctgtctgacgagctctaggcaatctgccctcgttcgggacacaaccatcggtctcacccctcagtttctgccagagaaaaaggaaaagtcaccgagaggcctgaccctgacgggtgggggagatgcgcgtgcggagtagcgggaagcgactgaggagcggggaatgggcagcatttgaatggatgcgggtgccgctggcacccgggaagacgctgggggccggcgctgtagagccgggcatgggctgggatgtgtttggattccaatccgggcctgacaccagttcagtgacctcgggaagttccccaaccctccgggcctgtttcctccctctgaagtggcgacagtagtagaaccgacctcgtaggctcatcgggaggtcctgatgggagaacccatgcaacttgccaccatagagccaggcccgcggcggttggcgcctggtgggtattaaagacgagtcgggaaagaagagcaggttgatagactggatgctgctatggtaatctgcctcaggaaaatgccggactgttgtttgcaagctggttaagtgagcaaatcttgggaagatttcaagcacaccaaacattggcacattgtttaccgtatgtagcaagacccttgcacatttgtgcaccattgtaccccttaggaactttagacgtgtaaccaataatcaccactttttttcaacaacaagagcacgcgataccgagagagcttgcgagggaactcaatatgtcgcggttggcgcgacacacaacggacggtacttgacccttgcgccagtggtgcacatacggttgtttcctggaacccacggtttctttgcacaccagttggcaagatcggcccgggttcccctatagagggcgacggaattaattccgatacgccgggttaccgggcta

SEQ ID NO: 398028 - DNA, 392 bp, Homo sapiens
cccctcacttaccctccccctcaattctcacagcaaccctgggaggtaggccttatggtttctgttttgcaaatgaagaacctgagattgaagaagagtagagattggaggatcagatcctgagaggtcccatgtgctttccaataacagttcagtatattagaagacagtgtggcatccacggccaagtactactagttgatagactggatgctgctatggtaatctgcctcaggaaaatgccggactgttgtttgcaagctggttaagtgagcaaatcttgggaagatttcaagcacaccaacatggcacatgtatacatatgtaacaaacctgcacattgtgcacatgtaccctaaaacttaaagtgtaacaataataaaattttttta

SEQ ID NO: 398029 - DNA, 1766 bp, Homo sapiens
atggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccagtgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagcccccgcccggggaggccgcccgggaggagctgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccacgcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtaggcaggcaggagtgccctaggaggtgctggtgttgcgtgcgtgtgctggggggaccacacggctcacttgctgtggggaagagttgcaggcaccattctgcgttcacgtttgctgaggaggaagttcagaagaggctctgtggctgcattcagagaccagatctctgctcaggctgaggaggctcaccccagggagtgtctgaactggggctgcctggcccacctctgtggccctgcttcagcgagctgcggggcactggcctgggtgggcacctgccccactgtgaccaaccatcagcagtgctggaagaatggacatctggatgg

SEQ ID NO: 398030 - DNA, 335 bp, Homo sapiens
ctgtttgagcgatttcaccttagaggaattttcccatgagtctgttttatagtgttttacaactttataatgattgcgtctgtgttcacttctctcttaaaatggagaaattctgcccttcagtactttgcctaagatgctgcactttaattcttctgacagccggctcagagtttattataccattcttcttttaaatgtttccccgtagagtggttttattagatgtaaaatactagttagacttggacaatcatttcatccttcctgccaccttttagagtctgacttgggaagcctttattatcatgtcttgggataagtagggatggatg

SEQ ID NO: 398031 - DNA, 426 bp, Homo sapiens
ctccacataaaaccaagaaaaacaatgtgaggcaaccatcaggggatgtcaaaattctaagtaagactaactgttttattttattttattttattttatttgagacggagcgagactcgtactcaaaaaagggaaaaggccaggtgcggtggctcgcgcctgtaatcctagcactttgggaggccgaggcgggcggatcgcgaggtcaggagtttgagaccagcctggccgacatggtgaggccccgtctctactgaaaatacaaaaattagctgggcgtggcggagggtgcctgtggtcccagctgcttgggaggctgaggcaggagagttgcttgaacctgggaggcggagtttgcagtgagccgccgagatcgcgccattgcactgcagcctgggcgacagggcgagactccaactaaaaaaa

SEQ ID NO: 398032 - DNA, 161 bp, Homo sapiens
cgctcatttaatcttgtccccctaggaaaaccattgatatcattttggtacgtcccagttatctatccattgacctttatgtgtacatttatatatgtatttttaacaatgatttgaacctgttacctagtttcaatttggttttgttttggttgttgttt

SEQ ID NO: 398033 - DNA, 587 bp, Homo sapiens
  misc_feature (545)..(545): n is a, c, g, or t
  misc_feature (553)..(553): n is a, c, g, or t
  misc_feature (565)..(566): n is a, c, g, or t
tacgctgcaccgtggtcaaatttggggttagggttgggattagtaccatgtcagatgaagggatggattcagggctgagggtgagggccatttgcagttagcaccgggcacagctcggggttgggtgaggctgggtcagggcgagggcttctggggtaggatcaggtgcgtggggcctgctgagagtgtccgaggatctgctcgttctgccctgtggtgtccctgatgggctttttctccctttttgcagggttgctctcagctatggccttggttggagacccagctggtggccagaccccaccacccttttgggtttggaccagggctccaggaggtggcatcctgcagtggagccccagactctccagggatggagtatcagctgaagcaggggcccccatttcacactggaaagggcctggggtttggggttcccccctgccggggaatccagggtccccacccctgcctgctgcctgccctcctgcctcggcctcactctgggtccttgtctgggaaccttagcaccttctttgagccgncgtgcgcntgggtacgagtnnattcgatctgctagggggcca

SEQ ID NO: 398034 - DNA, 452 bp, Homo sapiens
ggatctgctcgttctgccctgtggtgtccctgatgggctttttctccctttttgcagggttgctctcagctatggccttggttggagacccagctggtggccagaccccaccacccttttgggtttggaccagggctccaggaggtggcatcctgcagtggagccccagactctccagggatggagtatcagctgaagcaggggcccccatttcacactggaaagggcctggggtttggggttcccccctgccggggaatccagggtccccacccctgcctgctgcctgccctcctgcctcggcctcactctgggtccttgtctgggaaccttagcaccttctttgagccgctggtggtgttggcgcacttagcagagcaagccctggcccctttcctcacaaacctcactcccaggtctaggcggggaggctgggctgctcctcattgtct

SEQ ID NO: 398035 - DNA, 422 bp, Homo sapiens
ctcctcctggtgattaggacaccactaaacaacaggatgaaggatctgtccccagggccgaagtgatgatgtatctaatattatatcctagaacattcacagagtagctgcagaatgtcttgagctggaacatccccaagaggccatatatatatcccagggattttacagtggacctcactaggccggagtaactgtaaagtcagatggataatgagaattcaggacgttagccacacgtggactgtggcaaaaagaaagtgacccactgaagaagactgtttttcagctctctcatcaattgctgtttccaggagcccacagctccaattactcaaaagaacgttgacttttttttttttggtaaaatatcctgattttcaggttaggcaagcaattcattaaaaaataaaagactgcac

SEQ ID NO: 398036 - DNA, 526 bp, Homo sapiens
acagatgtataagtaaccaagttgaattatagttaactacatgcccacaaagaaaagatctgagccaaatggcttcattggtgaattttctcaaatgcttaagaaacaaatgatatcaatcttacaggaaatagagacaaaataacacttcccaaatattttacaaggccagtattaacctgataccaaagccaggcaaacacatcataagaaaactataaaatgagaaaggtacaactttttaacaaagtgattgcagattaaatccagcaacatgaccaagtggggtttatctgaggaatgcaaggttgggctaacatctgaaagccaattaatgtcataactcctcaatagaataaaagaaaaaatccatatgaccttctaatagccacagaaaaagcatttgacaaaaccaaccctttcataataaaaactcccaacctaagactacaaagaaactttcacaacctgataaaggtcatctataaaataaacctgcagctatctaagtttcagagaatcatct

SEQ ID NO: 398037 - DNA, 593 bp, Homo sapiens
aaggggtccaggctctggttggggctgtggactgaggtctgatctccaggctggtatgtggactgtgggcagtttgaactgggcctgggtcccgggttgagttctggcaatgggctgtgttctagggctgggccaagctctgcattctgtgggcaggggtggtttctaagcatggccctgggctcggagtgaagttctgggcttggctttacacttggtcttggggtctagggtgggagttgggttctggtttagatccagacaaggttctagacattgggctggggcttaagtgttaaggtttggagtggattattagctgcttctgggctctggaggggatcagggttgaaatcagagcttctggctgggttccgacctggcttcttccctgacatcttggcaatatgttgtgttcaaggtttggggccatgctgtggtttgatctgtgcgctgggatgacatgggggttgctgtgctgtgttctaagccaggctttgtcctgagtctagcttctgacccgagctctggctgagctgtggcctctaggtcgacctttggccctgggctctgtggccgtgggcaggggccag

SEQ ID NO: 398038 - DNA, 392 bp, Homo sapiens
ccccaataatacaatgctgttaagaacttaattttcagtaaatgttactcttggcttttagtcttaatttaaccccacaaaaatatgtacttaataaatttttaatacagaaaaattatcactggcttatcatggctgacgtcataattggaagttttgttcaacactaccaaatgccgtgaagtaaagaaaagtgaatgctgagtaggttagccaggcttgatttagagcataaaaggataactcaggatttcagtaagtctggttattatttatatacatcattacaaatctgtttttggggtttcctggcatactgcaacaaataatgtggaagggtattattggaggcaggaatattgatgccattgtaaaccacaaagagcagttag

SEQ ID NO: 398039 - DNA, 520 bp, Homo sapiens
tcaaaagttaattcctaggaagaatttgattataacagtctgttccattataaacacactgttttttagccaattccaaggagattagaggtaggtttcaccaatcatgcatggcaggatcagaggggatgcaaagtcctggaaactgacctaaaatactgccagtaaaatagtgggtagttgtgggtgccctgctcttatgaacatctgctgaacccttccttggtctgattctaacccagggtacagaagccctgacactctggtaagtgttcaatctgagcagcctaatttgacttcattctgtttgggcgtcagtccaactggcagatgttcttatagaagctgatctccgacactttccctttctaattttctggcaccgttgcctctgttgcatgggctattatctctgaaactttatctcgggttatccaggttttgcttgttttgtaggctttagttttcccttaaatctttctgccccaaagaagttcatttgaaaaatactaaatcactg

SEQ ID NO: 398040 - DNA, 400 bp, Homo sapiens
ttgtttttgtttcaattcctgttgcaaatttgccaaattattttctagggttaatacatactaaacataatagaatctttctttgataaattagaacattatagtgtcctaggatcatctttctgattatcggtgatactgttagggatatgaagattataacattaacagtacctgagacattttttgtgtatatatgtcagatggcttgcatttttatcagttgttgtattctagaaaaaaatgaagtgaaaaattacttctgattgagatgttagtataccctacccttgtttagtttttaagaataatttttcaattatgaatactcattaatttttgaaggatttaatgaggtatgaacaaaactggtggttaccaaaactatccctattctcat

SEQ ID NO: 398041 - DNA, 535 bp, Homo sapiens
agctccagcctattctcaccaggcccattccctccttccctcctcattttcctttctgcctccctagctgctctcttcctcacctacaactttgtcatgtaactgttgcccttctgttaaaagtctgcagtttaatttcaggcccgagttcctgccacttcaagacttcaccacctgagacaatgagcagcagcaaagggagaaagcagctgctcaaattctccagtatgtgtggatggagtgaggagggatgctgggataaaatacttagagaaaaaccccagcccaggggcatgggcccaaatactgaggggcaaaacctgaaccagaagcacctatatgatgagaaagtgaagaaaaaaaaggatgacagtaaaatggtactggaattagggacatcataaaaattgacctcggttttagatgttgaagaaatgacaaaatgaatagaaaaattagtagagttaatatttatgtctaattattatgcagtatatttctatatataatgtgttaataaaacttaaatgtatta

SEQ ID NO: 398042 - DNA, 263 bp, Homo sapiens
tcagaaacgatcatagactggaggactttaaggagacatggtggctaaatgtgctgtgatatcctgagtgcagaacggaaaaaggacattcggaaaaacgggtgagctctgaataaaatgtggattttagttaacagtaaagtaccaatgtttcttccttaattgtgacaaatgtaacataataatgtaagagtcagcaacaggaatcactgagtgaggggcatatggaaactctgtactatctttgaacttgtcttcaaatg

SEQ ID NO: 398043 - DNA, 423 bp, Homo sapiens
caacaacagaaacctctgggaccacaagacaggtgtgatggtgtcacatagtatcctccaagctttgttctaacaacaaagctctcttggttaggaatttctggtttacagtttaaaatgttagcgtaagacactgatgttccaaaaaaaaaaaaaatacaagcctacttcatgaaaccaatgcctgttgtgcaaataaatacagagttagtgtttacccctggcagggcatttttctttgagttggctgcagagcattaaaaaagacattaagtagattatacatttacatgaagtcccttgttatttttaaccataaaaaaaaagcatttttctttttgatgatatatatactaattgtgaatgattacaagaggtgactttgtaagacagtgtaattgtgttttttcccccacagaaatt

SEQ ID NO: 398044 - DNA, 462 bp, Homo sapiens
gggttggtcctgtcctggggctcgcacagtaatgacagcccagggggactggggcattagagtagctttctctcaaagagaagtaactgggtggccccagttcccccagatgctcctgggggttgggggtaggactgtctcaagctgatattgactatgccaccttcactgttatggatttgattcctcacagaacaaggtcagcaaagacccttcttcctatgtcaaactatctgtaggcaagaagacacatacaagtaagacctgtccccacaacaaggaccctgtgtggagccaggtgttctccttctttgtgcacaatgtggccactgagcggctccatctgaaggtttgatggaagaagggctcttgaaacagagttaagaggtttttaagccaggcgggctgggaagcttgaagtgcaccttgagcaggttctcctggcagcgtttaaagtcagcc

SEQ ID NO: 398045 - DNA, 465 bp, Homo sapiens
cagactcttattgagtacttacattgtgccaaacactaagttaagtgctttacatggattatctcattcagtaatttggtaatctctatttttcagcagaggacactgaaacctagagaaattatgtgatttgcttcaagtcctacagagggacactcatagagccagattttaaaccaagatggtctagtccagagccagtacatgcaggatttagaatatactcattttatttttccccttttccagtttttttttttaagtactatgagctttcttagaatagtctctttcctttatatctgcatccttatcttttagtatagggctaggcaccttagtaagtgtttgacaaatgtttgtgaaaaggataaatgaaagacagagcctaaggcataaaattttaagacaatacactgaagctgttacagtttatgattgaataaataaagtactcagctctcc

SEQ ID NO: 398046 - DNA, 520 bp, Homo sapiens
aaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttc

SEQ ID NO: 398047 - DNA, 194 bp, Homo sapiens
atgacacttctggagttagattgccattcaaagtgactacagtgaatctatcagttacagctggaatccctctgagcatagtcaggtggtacaactgtgaccactgagaaaaaaggcattattaggaaaatggatatagccttagtgtaaactgaaagtgagatggcttttaccatggacaaaattgttaataa

SEQ ID NO: 398048 - DNA, 366 bp, Homo sapiens
agacctcatcttccatgactgcttgctccgccctctacccttcaaccactttggcctacttgaactcaccaagtgtggtcttccctcgggggagtcatgatagtctcctggagatggcagggtctgctgaggtgactcttctgctgccccagcttcttgagtctgtggctccactcctgcagtgactgtgccatcctccctctgccaccctgccccatggtcatgagctgggcttgttgttaccagtactgcgccctttctgtaatctcaattccaagcttcccacctgtcaaaatttctagcttgtttcccatcatagccccacgtaaactcttctccagcctcaccacatctatattgcattgt

SEQ ID NO: 398049 - DNA, 645 bp, Homo sapiens
tttcttgttatttctgtgacagtataagatctttacaatgtaaggtgtataataatgaactaatagatctgagtaaaacctgagagagtattcacaacaggggtgtattctataccatcacagtctcttccaatcaaatcactgtgcactctgattgttgggctactagaccataaatgagctctgtgccattctcttctcttatactcactgcagttcagcctccatgctaacaatgttttagccacttttctcttaacagccaaaagctcatcccatcttactgactaacagagctggtaagaccttagaggtaacatattctaattgccatattaaaaataataaaaaagcaaaacctgaaatcctgagaggttcaatgacttgcctaagttcacataacttggacgggttagcaccaggactaaatctgggtgtggctcccactcctgtggcttctccctctattgagatgtaactggaatttcagactgtggggagcactggcccaggctagcaagtaagtccctcagctcagatacttggtggatgagcctcaaaagcatggatcaatttggcctctgaagggatccccagggtctgtctctatgtgccgaaccacttgcgctctccagccagtacact

SEQ ID NO: 398050 - DNA, 293 bp, Homo sapiens
ttatacgtgtatatatatgtgtgtatatatatatgtgtgtgtatgtatatgtatattgcagcccccttccattgatcaagcagtgggcaagtgtatattaagcatcaaatgctgtaatatctaggctcaggggctgaacaaaaggagtatttggcacaggagtttgaccttaagaaggaggtagcttggctgatgggggcaggttaagatgcttgaaacaatttgaaaacccttcagcactaagctgtgtggttctggttatcagtacagtgggggttcagagcagggagcct

SEQ ID NO: 398051 - DNA, 751 bp, Homo sapiens
ggactgcccatatatgggcaatctatgcttctggggaacatgatggaagaagttatggttatcacacaaatgtacaggtcagagacaataaactttggtgagggtatggatctatgaatccatacgctcaaatacagttgtgctgttggagtttgtcactgaattcccgaagccctatatagacagcagatgtttttgtaggttgaggcaaggctccattttccttctgtatatgttcagctctctgggtatttcattcatcagatggcagcttggcttagagaaggtgttggtctgtattaacgcaatggctgccaccaagtcactacaagcactagggttctatcaatgatgatctagctcagtggctttgtcatggggactgccaggggaaagaatctggggctggttccgtcagaagctcctaccagctgaaaggaaatggcagatattcaacagataatctactgtatgctggtctctgcatgggtattttatttcttataaagaagatcctgcttcttactaaataggggttgtcactagaaccctgtaatctcttcaatctttatgcccttatttaaaagaatttagaataaattcattctaacagtgagctaacatcatagaccaagcacacaaactaacagttaattctgcagccctgggaactttttttttttttttttaaatgacagagtcccgctctgtcacccaggctggagtacagtggtgcgatcttggctcaatg

SEQ ID NO: 398052 - DNA, 476 bp, Homo sapiens
ggatgtggtcacactgcaggactggctcttgccggccatggaaactagccaggtattatgctgatacacgtatctccatcagcagctaacaagacaaggaatcaaaatcactgctaatttacccacaaaactgtccatcttttcccctggtatcattcccctgggtctgctatggggcatccaaattccatcagtttcttttatgcaaacctacaccttttcctctttcacttaccatccatgctaccctcagggtaccatttacaccaccttcccacatccccagggtcacccaaactctgagcttctcgggttttcttccctaatcggtctcattttcttcacacttcaccagtgctttaaaaatgcagctttgtctcgtaaatacctgccttttgaaaggacatactactaaatttaaaacaccaggctgcaagatcctggtttttataaaaacaaaggaagaaaaacagcaa

SEQ ID NO: 398053 - DNA, 230 bp, Homo sapiens
acaccttgatggggtattttacatccaccatatggatgtaaaatccatctacttggagcaaaaggaataggagcaatgttcttggctgttaacggtcacccttggcctggcgcggtggctcacgcctgtaatcccagcactttgggaggccaagatgggcggatcacgaggtcaggagatcgagaccatcctggccaaaatggtgaaaccctgtctctactaaaaataca

SEQ ID NO: 398054 - DNA, 239 bp, Homo sapiens
tatagattcgatgtgctgaggaaaccctgaggcaaaaagaaaattatggaaaaacttgggaaaagttaacatttaatacatttcaatatgtctaactgtcaacacgatgaagagggcagaggagatgcaggtgagactgtaagctagccacacaaagttcatgattctaatttttttttttttttttttgagacagagtcccactctgttgcccaggctggagtgcggtggtgtgatct

SEQ ID NO: 398055 - DNA, 172 bp, Homo sapiens
ggcgcccctgcactccagcctgggtgactgaccgggaccctgtcttaaaaaataataaaacaaatgcagaatgaaaactttttttaataaggaaaagaattaaagtaaggaaggagaaaaagaatgcgctatttccctcaaagccctggccttcatgaggtgttgagatgta

SEQ ID NO: 398056 - DNA, 298 bp, Homo sapiens
ctaaaaaatgtaacgtttgtgacaaagagggaaaagagggaagagcttttggggtggaggggacaaaataagcaaaggcccagaggcagaagggcccaggagacttgcaggtctacagaacatacaaccggaagccagctttccaaagggtagggaaggagagaggatggcttcagaaagtagtctcagttaagactggaaggatatggggtctgaacttaaagagccaaaaatgtaagcagagggcttgacattttattctgcagattatagagagaccttgaatgtttttaagcaa

SEQ ID NO: 398057 - DNA, 569 bp, Homo sapiens
tttttccacagcagcagatagaaatgtcagttttcagctttcttgaagggaaactgtaagaaaaggaacagttggggcatttttcagtgttgatcacccaggtgattgtttgagttgctcacagcaaagtgggatgaagcccttgtggtgctgtctacataagcccttaactataagtaggtagattgagattgacagcttagaagttcgtactgctttccacttgatatgatgtctgagattgtaatacatgttacctttatcatctactgtggaggttctcaactttcaatctcccccaacatacttgagcaacatgaagccttcttatcactgtttaatgaaaacattgtggttattcccaaccaggaggggccagtatgtatagatgagtcattaggcagaagacagggggtaacggagtttgaagaagcttccaaatgactgtgacattcatagacactgccacccttactatgaggggctgggatgggggtgataatgttcctcaggaatattcacatataggccttgagaattactgatatatggcatcatttactcttttc

SEQ ID NO: 398058 - DNA, 354 bp, Homo sapiens
aggaggcacctgtgcccttttaggaacacaatgttgtacctttatccctgacaattggcagaacataacagcagccctgcaaggggtctcacaggagattaaggtagtcaagagccttactgatgaccccctgcagagatggtagacatccctgggctctggcctacgctgggccctgatagtcataagtagcatagctggaatcctagtcatgagctgttgctctccgtattgttgctgtggattatggattcagggctccaccctacgggcacatgtccctacctggaggatgcccctggcctaggggtggagtgtaaggaagatggctgcgctttagtcaggagcaggctg

SEQ ID NO: 398059 - DNA, 419 bp, Homo sapiens
caaaaaagagataatatgggcttagaccaagttgataacaatggggaagcagaagcgtaaacagatttttggcaaggagtgaaagagagtgctaagaatcaaagaagactcccaggtttccgacttgagagttgatcattgatctatattgctaacaatggtaacaacggaggtaaaatatatttgtgttgaacgtgtgggatgaaaatgatgagcttattttggatttatacatgtttaaagcttaggagagaggactggaatggaaatatggacctggaagactttgcaatttggatgattaaagccttgggagtgggtgaaattacttaggagctaatggaagttaggagagaggctggaatagagctttgaggaggttcaatatttaatggcttggtggaagtggagtagccagc

SEQ ID NO: 398060 - DNA, 672 bp, Homo sapiens
atgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactggggatcctctagagtgcagcttcatcctcaggtgattgtatgctcatgaactttaagaagcagtgttttagaacaggtcttacacaaggaacaataaactcattaactaagtactgttaaaaaaagaaaacaag

SEQ ID NO: 398061 - DNA, 162 bp, Homo sapiens
cagctcagacctccttcaactccagctacctccctagcctctgggtttccattcttgtcaccccctactcaccccagtgcagcatctccacatggccctagaaacatttctttcctttttttttttttttttcccgagacagagtctcactccgtcacccag

SEQ ID NO: 398062 - DNA, 326 bp, Homo sapiens
cagaagagtgagatgctaaagttgtcatagtgcctctttaccctgcttggctccagacttctgtctttcacgctttgatatcccaggcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacatacc

SEQ ID NO: 398063 - DNA, 608 bp, Homo sapiens
tgtctattgcctgtatagcagctgtgtaatccagaataaaaacataaatgagattatgttactccttttctcaatgcatttcactgagagttgaatgcaaagttcttaacctagcccacaaggctgcacatgcttgaatgtctcacagcctctctgatctcatttcctatcatttttctcctcactcactctgttctaaccatactagcttatctgccattccttgtacttactgagtgcattcctactacaaaggctttgcacttgttctctgcctgagaagtgctcctttgtataatcatggggctcattccatgacttccttcagtgctctgctcagatatcacctctcctaagatgccttccttggtcactccatatacaatagctgccagtcattcttcattgtccctattctgctttatttttgtcatagcacttatcacatctgacataatatttactgattttttgttttattattttccttcactagaatattggcttcatgagggtagggacattgatcactttggtcactgctgaatccccaaggcttggaacatcttgaaacacagctctcagtaaaattttgttgaatcattgta

SEQ ID NO: 398064 - DNA, 671 bp, Homo sapiens
aaatattttaagtttttttattttgcagtaatttcaaaactacacaaatgttacagaaatttagaaagaagtatcttcatctagactcaccaattgttaacattttaccgtatctgcctaattattgtgtctgtatctattttgttttagttttttttttgttgttgttgttggttttttgagatggagtctcactcttgcccaggctggagtgcagtggtgcaatcttggctcactgcagcctccacccccctgccaccctgggttcaagatattcttgtgtcttagcctcccaagtagctgggattacaggcgcccgccaccacgctcagctaatttttgtatttttagtagagacagggttctgccatgttggccaggctggtttcaaactcctgacctcaagtgatctgcctgtctaggcctcccaaagtgctgggattacaggcgtgagccaccatgccctgctgtgtctatatctatttctatatgtatatactaacgtagtgggtttttctgaagcatttgcactcatttcccttatccctgaatatttcagcatgttttcttaaaaacaaggacttttcttaaataactataggatagttattaaaatcatgagatgtaatattgatataatactattattacttaatccaaagaccatattc

SEQ ID NO: 398065 - DNA, 261 bp, Homo sapiens
ttcgtgtccgtctcagttgggcacgagtcttagcagtgcaagaagacatagcatctgggctttggttataaaaagtgctaaagttcaaaatctggcaatgccacttttagtgtgtgattatttaaattttatgagcctcagtgacctcatttttaaagcagaaatacttttttaaggattcaataattccatgtgtgtaaaactctgtgcacagcattggtaactagacgaaatcaataaatggtgggcatgaatgatttg

SEQ ID NO: 398066 - DNA, 459 bp, Homo sapiens
ggctcccaggccctctctgatcctttccttctctgaagactggatgtttcaagggcagtgtcatgcaatttacgatttcagtctaatacttattgttttgttggctgctatgtcttgtgtattcatttatcttctacccccaactgagttgtaaactctttgatatcagatacatttcttcttgatctccaggggatccagggctgagaacctgggtggaacacaataaatacccattaaatgatttatggtgtggcctatttctgggccagccctgggaatagggggtaaggcatggtcatttgctatcaatcagtttctgaaaatatactatcatttttttgcttggatccctgatgataagacacaagtcaaagaaccaaaattttaccaggtgataggaatttttccaagtgataggaagcaaataattatgtaatcaagacaagtcatagttgt

SEQ ID NO: 398067 - DNA, 631 bp, Homo sapiens
acattgtggctgcaggatgagaggtgctgggacaggagaagggccagtgtttcctggaaagtggggccctagcaccacctgaagtaggagtgtgagatgcttcagggggaggtgcatgctcagagtgggacagagaagtgaattctgggggagagttcgtccatgcagggtgtactgggaggttcagcctggctgatggggggtggggagcaggatgtggagtgccagttctctgctccagagacaaggtggcacctgcagaactaggtctcttgggctggtcccaaagcctgcatcactcatgacagacctactatggagccactatatggggtgagtgggtttgtgaggactcagggggacccaggacagtttcctactagtggcaaggcctcaggagcatgagaaagggaaaggctcacacggggtccctcgtgcccctgcccgagaccccggctcatctccagtagtgcaaaatcgagggtacactgatgaaggctgttgcttgcactttcccagggaactatagaggccaagctccaacggatgacaaacgaatcaggtctggaatccttgcttcccagctttcaattttgtgttttcttccctgctgtagtgtttgccaaactgt

SEQ ID NO: 398068 - DNA, 453 bp, Homo sapiens
aggaaaggccgtcttttcaacaaatacttgtggagtaatagacaaaatatgaacttcagcctaaagctctcacattatacacaaattatttgaaaataggttatgagtttaaatgtaaaatgtaaatctatcaaacatttagaagaattcttagaagaaaatctttggaactggaggccaagtgatgagtccttacccatgacaccaaaagcatgatccttcaaaaggaaaaatgataaatttcactctatcaaaatttaaaagttttgctttgagaaaggctgttaagagaataaaaagacaggcttcagatttgtgagaaatatcacacacaacaaagaacctgtatctagaatgaataaatgatgctcaaaattaaaaaatatcccaaaagattgaattagaaaatatgcaaaagatatgaagagacatttgactaaagacggcaagcgg

SEQ ID NO: 398069 - DNA, 434 bp, Homo sapiens
aattttacttcagtgaggtaagtctactttgaattggcaggaataaaggaactttatataactcttaaaagatctcattatcagaatgaaaaatgcatctactttccccctaaaaagcatctttcccctatgaactcataaacccaatgaaaatgttaagttctagtctcttgactcacttatttagattaagtcttaataatgcattaggaaacccaattatagtccatctacccctaagatgcagctgtttcaacatttccatacaggattcttacacatctataaatgaaataaactatactggaggaatgaagcagccaatgcatgcaacaagttatataggcaataatgttgctttcaaaggagtttttgttttgttttgctttgtttttcaaatggagtctcactttgttgcccaggctggagtgcaa

SEQ ID NO: 398070 - DNA, 376 bp, Homo sapiens
tcctaagcggattatttctgcctaagagcagttactaatagtattactaatattaataataatgagatttgctgagcacttgctacatgccagatgtttggtatacattttcatttaatcctcacaaagcacgttataggataggtaccattatgatgtccatttacagataaggaaaaggactcaggaaaactgcccaaagtcacatagctaataaccaccatctcatactgtttagtaaaaagtagtaaatgggctgggcatggtgacacacacctgtaatcccagtgctttgagagaccaaggtgagaggatcatttgagaccagcagtttgaatacagtgagctatgatcctgccattgtactccagcctgg

SEQ ID NO: 398071 - DNA, 352 bp, Homo sapiens
ttgttagggacctccactaatcagatacctgcaaagaagtccttgaagttctttcccaaggacacacagctagtaagttgcagaggccttttagtttcataatttcataatggcataaagcagagaataaagagtgaactatactgccataatgtcaattatccagagagaaccactcaaatttttacttttattcattttttactttttaaaatatttgtaaacatttttatatatttccttctactcagttctctacatacctacccatttttcctgttataaaactggaatcacgtgaaaactttcaattgtaccttctttttgctcaggacagagtcttgaagacacc

SEQ ID NO: 398072 - DNA, 254 bp, Homo sapiens
taactgttcttcaaactagaagtgagagctgtcatctatggctctggtaaactctcctacccactgggacaagaagagtgttctggggccaagatttaaaattagtgaatttggacaaccttcttcctctctgaaatgagcccactgtttctcagcctggatggaaccttctataaggtcgtacaaccaatgtgactgccaggggacaatatgaattcagcttctggattctggtcatggggagagcctgctgg

SEQ ID NO: 398073 - DNA, 523 bp, Homo sapiens
taggtgtggtgcttggtgcacggtaggtgctcagtcgaggtgctttccctgagcttttgccctggggtactggcgacattcaaagctgagcttgagcagctagcagaaactcaaggctgatcccttgattgggcaaactgatgtcatcccatcctctcctgaggtgtcagccagaaggtggcctttttggtaaattcatgaatgatgatggcttcctaatgggcccccaaaggagccaaagctcctttcagatacttttctgccttgggaagctgatgtcaagaaggatctgcaagcccttgaactccagggtgctgaaggcaggtttgtgatggggtctcaaagaacaggaccggctagaggaggagggggaaatccaggaaatctcagggaagcctgagctctcagaaccttttttttcttagtagctttaaaaaagaaattgacgcagggcacgatggctcacacctgtaatcccagcactttgggaggccgaggcgggtggatcacctgaggtcaggag

SEQ ID NO: 398074 - DNA, 102 bp, Homo sapiens
taaacacggaaggttatgtaatgcagtgccatttccaaaaatatccactctgaggcattacactacacggtggaaggctgattccccttctgtcgtcttctc

SEQ ID NO: 398075 - DNA, 1298 bp, Homo sapiens
tagctagctgtggggtaggggtaggatggagactaatagatatatacatacatacatacatacatatatatcattttggaacttcattagtcatgggactatattgctattcaaaacaggcaattaaacttaaagagaaaattacaagtatacattaaaaacagtgacacacaccttgtcatgtcatattcttgatgcctggaggatgaacaacacaagtcaattttttagaatgtcaaaacttgaatagacagagcagtgaaagagaagctggaagttcatttagtcactgattcagcaaacagataatttataaagtgtgcagagtgcctgtgctaggcagtggggaatataaaggaacttgagtctgaccagacacaaacatataatacaatacaatgagttttttgacagagcaaacaaaggggactcgccactcataaagcaggggacccatcttaggctaggaatcaaaaggagatacagcagttagctaggttagttagaagtggagtgttccaagaaagttcagcttgtctggagtatagtgtgcctcaaataagcagcaagaataagactgaagaggcaggttagtttgttcagggtccaccataagccatgttagacttgggcttcataaaaagggcaacagaagtagagaacactttcaaagttttaagcctgtgatcagagggtcaaacctacatgcctgaaaggttactctgaaacagtaattaaccaaattattgttttgggttttttgttgttgttgttgttgttgttgttgttaaccaaattactctcctaggtagagaggcctattaggaatttgttgcaacagcacaggcaagacataatgctagcatgaccaaaagttatagcggtaggtacagaaaaagtgcaggaagagttacttgagtcattaaattaagagaccatggtaataaggctataaggtcaagaaagaataaggagtcaaggaagacaaccaagtttctgactggagcaatagagtgaatgagaaatactgaagtaaacttgaggaaggggtgatgggttcaattttggacatgctgaatttgagtgtttatgagatatccaaatggagatatgcagtaatccatgacatatacgaacagtacatgtctgtagccaatgtgggctaaagagaagcatttagtttacccagaaagagaatactatgtgagaagtactgcaggggtaggatcaagccctgaagaacatcaatacttaaagagaatggggaaagaagcacctgtaaagattaaaaaggaaaa

SEQ ID NO: 398076 - DNA, 137 bp, Homo sapiens
tgagaggactggggaggaaagacttaggtaggaaaggaatggacctacctttgtgtgttacaaagataactgatggttctctggaggatcagattagagatggcaagattgcaatcttgggtgccactgcaataaga

SEQ ID NO: 398077 - DNA, 450 bp, Homo sapiens
gcaagggaaggaaacctgcaaaagtgtggccaggactatttttaaaaggctttctttccccttggtcctggtctgtatcccagaggcaaagaagggctatttgaggagagaaggcaagtgtgacttgagctaagcccaaaccgctgtccctccttgcttcaactcaaggattctttggaataattgagaccgactaaagaaggagggaaagaaaccaagtcatcaattgcccagctgttgctcagcctggttgtggacgggagagaggtgggggctggtgggtaggaggtgggcagggggcagaaagtgctccttccttttccttagcagactctcagaaacactctcaagcctccagcaggcagcccaggaaactgtacccccgccatgggcatcaccggattttaaaaaagaaataaaatttaacaactgtgcaaccttggccaaatc

SEQ ID NO: 398078 - DNA, 343 bp, Homo sapiens
cgtcttacactttgctacttcttacatacctgtcttcttacttgttcctattgtttacaaatctgcccaaagatataatttttatgatattaagagctgaattttgcttaagaaaatctacatatcttttgtgattcttctaaatctagtaaatcaagtaatcaacagtttattctctgcttgtaaaaaagggtagtaatttttccacataaaaatcaaatatataagcaaaactaatatatttgttgacaaagttgctccagcaagccttgaatttttcattataatttagctataaatagacccaaggaatctgacatccaaggatcattaagcaatcata

SEQ ID NO: 398079 - DNA, 410 bp, Homo sapiens
gggtaagcagtgggcagatcacctaaagtcaggagtttgagaccagtctgggcaacatggtgaaaccccgtctctatgaaaatacaaaatattagatggagccactgcgcctggccggtgtgactattttctttcaagttgaaagtcgggttccatgaaactctagtattagatggatttaggtgaaggttaatacctctgattgtttgaggcctgaaatataactaattaagcagtagtgaatctcttactacatttgcttcaaagcagctacttcataattgaacgtgtgtgtcattaattctagaaatctgttacacattgatttggtgttgtatcagaggaggatacagaagaggaatggcactgactagtggttttaaggcacaatattggaatcacctggagag

SEQ ID NO: 398080 - DNA, 523 bp, Homo sapiens
cagctactctggaggctgaggcaggagaatcacttgaacccgctaggtggtggttgcagtgacccaagatcgcgccagtgcactccagcctgggcgactgagcgagactccatctcaaaaagaaaaaaaaaaaagaactggaggagatatttgtaaaattcatatgaacaatttggaaagttgaaggaggggcttgacctactagatatcattataaagctaattcagtaattacataagtaattaaggcagtggggtactagagcagagttaaactcatggaacaaagtagcccccagacagatccaagccattattagtgctttgtatttaatagagctggcataagaaattattgaggggaagatgaactcttcggtatatgatgttgagatgactgggcttctaattggaagaatgactagagccctccttcacactacacacacaaataaactccatggctgggcgtggtggctcatgcctgtaatcccaacaatttgagaggccaaggagggaggat

SEQ ID NO: 398081 - DNA, 393 bp, Homo sapiens
ctgcctggattgctttttcctcagctcctcagtgactggcttattcttatcttttagatctcaactcaaacatcttctgttcagagaaaccttccctgagtaaccctatctgaagtgtccttcatcatctctggtctttctttcatagtatgattatatagtgtaattgttaacttatttgttcacttgtttactgtgtctcccccatcagtgttccaggagaggtggggcattttttctggttaaccaaatcctcaataattaccacaatgcctggcacactgtaagcacactgttatttctccaacaaaaaactcaatgaatgaatctaggatacttccgaaattatgacttaggcagaagtagagcaaatgtaaagaaaagcctacacag

SEQ ID NO: 398082 - DNA, 481 bp, Homo sapiens
gttacctcctgggaaagcaagacgctcccttaagttttagaatggtacagagagtagtcccttctaccagagtttccatttagacatgggagtgtagggggccatgtttcggcagaagcagggcatgtatcagcattagtggactcctcagtattaaaaggaagaacagcaaacatgtcatgtgcccactttgtgcctcaggagaggtagcccgtggacatcgctagggcagaggttttaatatctgggacaaagttatctcccacggcgaggtcgtggctgggaccatgtcatcttcagccgtgagctgctgggctgggcaatgtcttctgggatgtgagacgtggggtctcctttctaagcggacccccactcgtgctgatgtgggtcccagcatttgccgcgtttggttgaaacagtggcttacctggagggtctgggtctctggatcataaaccagcgaaagcccccacatcagtgg

SEQ ID NO: 398083 - DNA, 290 bp, Homo sapiens
atccgactcaagctaaggtaaacagtggctgctgcatctttgaaaaatgctagccatgtccagttttcatcaaaatatttatctagaggatacatggtcaaattatttttgcttaactactctcatgaataagtaagtactcctgcaagttgcagggggaaaatttatgcaagatttttcttcaaatgacagattcatggttggaagtctgtctcagggttatttatttattgtcaggatggcagtctccgctggcagggctttatcgaggggtgtgtcaagaattaatt

SEQ ID NO: 398084 - DNA, 274 bp, Homo sapiens
cccaccttggcctcccaaagtgctaggattacaggtgtgagccaccacgccccgctgggatgtcggttttcaaggctaccacagagctgagctggggaagggaagatggaaacaagagttaaaacatcacaaaatgggctgggcgcagtggctcacgcctgtaatcccagcactttgggaggccgaggcaggcggatcatgaggtcaggagatcgagaccatcctggctaacacggtgaaaccccgtctctactaaaaatataaaaaattagcc

SEQ ID NO: 398085 - DNA, 191 bp, Homo sapiens
cttatcttactaccagctaaagaattggtgaacatcaattaagattattttgatcatatgtagaaaagccaatattgttctatagacataaaattttactttctctttaagtattgttacacttttaagttttgattctttgcatatgataatatcaacctttgtttgatggaagcttcttaggctggtgc

SEQ ID NO: 398086 - DNA, 287 bp, Homo sapiens
gttttaggatactttaactactacgcccacactaagagtttcttctctgcatatgtggtgggaaccttggtgtacagtgtggttttgtatagcaaacaagatgcatgtgtgtgtaagaatatattgcatgtattcagtcagttatatagcaaatggtgagggagagcttgctacgtggctgacactgttctacgcactgaaatggggcagcaaagaagacacacgcaaattctgtccttgcggatttttacatagtaattgggcaaggaaggcctggaggagtttca

SEQ ID NO: 398087 - DNA, 421 bp, Homo sapiens
catgactcaccgtggcacaggggacagaacagaacaaggaagaatccatcaacgaatggaaacttgtctttttaggggacaggaagctttttttgtgtggttggcctggtggcttatgaggagaggtgaacatttgagacaaaaccccaggccactcttccagctgcatctttgacaattttgagagttttaggaagtagttaaaaaaagaaaaagagaaaccaaaagccaaagacctcgtttactcacaatacctgtgtacagccagccatgtgggctgcgatcggccatgtgtctagaggaaactccttcacttgcatccctccctcctagacccctaaaccagagggggcttttgactattcttagaagaagacttaggcggcctcaaatgaccagaccttgtctcaagcatctaaca

SEQ ID NO: 398088 - DNA, 544 bp, Homo sapiens
tatttccccttctagactacaagctacatggccaaaaatccctgtatgactcttctctcgatcctgcatagcgcctagcaaaataccttaaacttagtaggtgtacaatacaaatttactcactgaatgaataagtgattctatcaatcaatcaatcaatcaacaaaattgtttatcttcttggttcatatacagtaatacctgtgtcctaaacaacaaccataaaatctactgaggctgactttttttttttttggtattttaagtagagatggggttcaccgtgttagccaggatggtctcgatctcctgacctcgtgatccgcccgccttggcctcccaaagtgcggggattacaggggtgagccaccgcgtccggctaatctatttccttttttatagagatggggttccactattttacccagggtagtcttgaactccggggcttgagcaatcctctctcttgggcgtctcaaagtgctgggatttcaggcttgagccattgcacctgatccttttaattaaaaaaatttttatagtc

SEQ ID NO: 398089 - DNA, 516 bp, Homo sapiens
agccagagttttggagtgaacctgaaaatgtaaaattctttctctgcctccttgactcctactatctcttatttgaagggataattcctgccaacctgatcggagccccattttagccctactcaagacagaaaagaaaggctggcatagttttatttcccccaccccgaccacctactccctggttttttaggtataactgaccagttttgcatttaatttgtcttgtttggtcttgtcttttcatacaatattttattgaattgtgattcacataccataagaacaatcatttaaagtatataattcagtgatttttagtatattcacagagctgtgtaactgctgtcacaatagattttagagcattttcatcaccccaaaaagacatgttttacccattaatggtcacttcccatttccgcctcctacccctaggcaactactaatgtacattctagctctatagctttgcctatgctggacatttaatatcaataaaatgattcaatatgt

SEQ ID NO: 398090 - DNA, 282 bp, Homo sapiens
tgtcttctgcactcactatgtgaactggtctagttaattacattagtaacattaattgctagatccaaaaggatacttacagtctttgttttcttgacctactctgtggtatttgatattattgataattgctctttgaaactcttccatgacttcatttttttccagttttcttttttttaagcctctttttttttttttgctttttttcaactgtccactccctgaaatattactgttttcttggattctgtctttgaccccttctcgtcttatgtatct

SEQ ID NO: 398091 - DNA, 467 bp, Homo sapiens
aggaggtagctgaggagacagaatatggtgaaaaaggtagaaatgcaggccaaacttctaaaaagcatttttaaaagatctgaagttattttgttagtttatgaacttaaaatgcattatgttaaattcctctgctcataaactttacggtattgggatgtggtgagtagaacggagatcggggaggaactgccattgctcctttcaaagttcatgaacaaatcactaacagaagtcctgtggagaaagaagttttaccaattcggttttcttacttgcctactctgggcttttcatctttagctacaacttaactattctccttggcaacccagtaagtattgtcattttaggtaaaaataaatcttttgtgttagaaatgccactacataagggcctggcacggtgactcacgcctgtaatcccagcactttgggaggctgaggcaggcagatcacaaggtcagg

SEQ ID NO: 398092 - DNA, 379 bp, Homo sapiens
tgttcctggggaatggtgagtacattttctagcaagttccttgggactcctgaccaatgtcagcatgtccgcaatgccccatctagattctgccctgaaagagccaaacaggagagcagtagtgtctgccacatctttgtggaatcctgcccttttgcggtcaacctcaactcagggaaagtaaaaagtgcattagaacctaatgaaaatttcaaaagatcttgaaagatgcccaccagcagcagacagtgacatgatcagtgcccatggccaggcatatcacggaggtgtgcagtggccacgagaaacaagatgtttgtaaagcactctgagctcttaactgtgaagagtcagagaggcagaggcaccacagtcctgg

SEQ ID NO: 398093 - DNA, 166 bp, Homo sapiens
tagtggcaggaagatggagctagtgtgtgcgcttgaatgtgaacagtgcctcccaaggagggcagctctgtgtttaatgcaagccataattagttggtcaattcactgatggggaccaagctacagtgagagagagatgctggcagagatgtcttgctgggaacta

SEQ ID NO: 398094 - DNA, 1205 bp, Homo sapiens
  misc_feature (914)..(914): n is a, c, g, or t
atttgagtttatgtctcctaggggagagataaacgtgttaactactatatatctttttgggaaattccaactataagttttgaggatactttgataacaggagagaagaaagatgagataaaagcagaaaagcagtgttaaagttgctgtaagtgctttgtttcatacaaaatatatataaatgcctgtgacacataatatagcccaacactaacatctttgacaagtgtaggatagactgaaaaaaaaaaaaaaggctgaccgcccccctaccgccaacacatacaaatttacaaggcagagttcagataaggttacgtatcattgtgaaaatgagctctaacatatttaaactaaacttccggtactatttcatcccattaaaaaaagtactatctcttgagaccatggtgaaaccccatctctactaaaaataccaaaaaaaaaaaaaaatcagctgggcgtggtggtgggcgcctgtagtcctggctacttggagaggctgaggtaggagaatggcatgaacctgggaggcggagcgtgcagtgagctgagatcatgccactgcactccagcctgggcaacagagcgagactccatctcaaaaaaaaaaaaagtactatctcatcccattaaaaaaaaaaaagtaaaatctctgatactttaaaaaagttaaaatttaggccaggtgcagtggctcacgcctgtaatcccaacactctgggaggctgaggtgggcgtatcacttgaggtctcaggagttcaagaccagcctggccaacatggcaaaacctcgtctctactaaaaatacaaaaattagcagggtgtggtggcgccccccttgaaccaagtttcttggaggcttaacaagaaaattgttgggcccaaagttaagacccacttgacaattggngaaaaccttgtttgggaaaaaaaaaaaaaaacatgggcttatggcaaatgcctttaggggcgtttaaaatactggccggttaaaccgcgattggaaacacgggtcccaattataggttgagaaaccctttttcgcgggcataaagaaggcgcccccagtctttccaaagtccacccatgtgaagcatctggccggtatatttaaacacgcatattctaaaaccttttttaccagtggcgggcgatcttcttataaaaatcccctgtgggggttttccttccccttctggcg

SEQ ID NO: 398095 - DNA, 591 bp, Homo sapiens
ctccttggaggaggtgaggggtgggccggtgtgggccagaacctgaaggtggagccctcgggacctcctggtggctggatgtgggccatgaggggaaggaagccctagggatcacctccggcatggcctggcctgacctgatggagctgctgtcgaccgagatggtcaagtccaccaggagagcaggggtgggggcagctggagctcaattcgggacacgccaggcgtgagatgatgtcccatctcaagatgtttcctggacctgctgtaactaagtacacaaactgagagctgaaaacaacaggaatgggccaggtgcagtggctcatgcctgtaatcccagcactttaggaggccaagacgagaggatcacttgagcccgggagttcaagaccagcctgggcaacatagtgagaccccatctctacaaaaaataaaaataaattagccaggcatggtggtgcacgcctgtggtcccagctactttggaggctgaggtgagaggatcccttgagcccaggagtttgaggctacagcaagtgatgattgtgctgctgtactccagcctgggtgacagagtgagacactgtc

SEQ ID NO: 398096 - DNA, 100 bp, Homo sapiens
ctgctgccttcaggggtgacaggagctcaggtcaaacacaacttcggatcacaccttcttccaaatcaaccccatgctctgcagacatcactcacaacac

SEQ ID NO: 398097 - DNA, 354 bp, Homo sapiens
agaaatgtcctttcctggttttacattttgtctcctttttagttgccttcagtacctgacagttctttttgaaaaccctagtctactttgtctctactaaaggggaaactagaaaaggaacctgatgagtcaccatagggccaatagcgcagagaggcgggggtgcccctggtggtcagacttggttacacaccctgcaactctagagattgacccttatgagccacaaattaggaagggctccttcagttcttgcttcttctctgagtgggcaatagctttgcatataggtaccacttaaggaaaattcatttaaaaaaatagcctgggcaacatagcgaaaccctgtctcta

SEQ ID NO: 398098 - DNA, 753 bp, Homo sapiens
gggacgtggggttaactctttccaaataaggagctttccaaactgccatttccgtattctaaggcttgacagcttttgaaaggatgaaaagagcgtgtattttccagaaatccttcatgtgactatttgcttcatttcaatgcctcagaacaccaccaacaaaaaacccactcacacccttgctggtggttgctacagtgcaattggctgcaggcttttgtttagaagtttgcagcagtccgggaaggaggttttcttcctcccggagctgagaaggcctgtcttcagcaccaacgtgtcttctggccttgccaataaagaagtaagaagccactgtgaaaaaaccatcattctcaacaataggccaataaacggttggcagaaatgccatgcgcgcccctccgaggacggggcagcgtgtttgaagagtcaccatggtagtgatattttatgagcatgagtcacttgtctgtttttcagggagcgctttgctcggcccatctcttttagtacatttccatttggtgtggtttggctgctgagtgcagtgtggcagcaagttacttaaaaacatttcacaaaaagccagattccccaacgctggcatacctgtggaccacatagatggctgtaattgcaaacagctgcccacccacccacggaacagtgagaggtcattttaaaacatgttaaaaatagcctgccccaggagaagctggttcatttgttgattcaaaaatatttgccaccaag

SEQ ID NO: 398099 - DNA, 134 bp, Homo sapiens
cggacgcatgggttaaaagatgaaggtacacagaatgtgggctggctggtgggcaaaggggtaaaaatgttctctatattgtatctgaaaagatggggtgtctgaataagaaaatgcatctatttgacagacct

SEQ ID NO: 398100 - DNA, 1020 bp, Homo sapiens
gtagaatatcctccattctggatttctctgttgccttctaacttgttcctgtagcctctgaatttcctgcgaactaaaagttggcttgaaagacttaattagtttcaggttcagctttggttttggtgttgaggatggaaggcatgcaggaatactttgcacatggaactgtttcttcatactgcatcacatcaaggagcatataatgtctgcttgtcatactcttatcaatgctaaaattgggcagtggtgccaacccaatctctctattgagagttttctaccaatctttcctcccgtgggaaaagttgctgactgttctccaaatcaattctgtcattagggtttgcaagagaatgaatttttaaatctgccaccccttacacatttattagtggaaattcttctgtaagaagaagtttccttcataaattacacctttttgatttatctgaaacaatgtatactggaaagaagcctggtgtcttaaatatcatctgttaatacctagtgtaacattccaaaggtaacttgagatactgcaaggaccacatagcaccttgagtacctattttacatgtgactctgaggactttcacagaataaagatatttcttattttaatgaacgttgtcagtatcaggataattttatgtagtcaacatatatacagtgttggtcctataggagttggagaccttttgccagttttatttggtcaaatacattatttgtgatgaaataactgtgagtgatgagttgagcctcaaagaacatgatacttcattaaatcaacaagctgaacagtatcatctaaccaaagctgtagaataaatggtgataaacttaaattcaggaatgaaacaatcaccatttttgttacaaatttgtccacccgtcatcactaaccccatttttatttaatactggtaatgaacaaaacctgaagaagaaataaaactaaaatatttcatttgtagatgacatgattaattatctagaaaaatctacagcaatcag

SEQ ID NO: 398101 - DNA, 305 bp, Homo sapiens
ttgcactccagcctgggcaacaagagtgaaactccatctcaaaataaaagtaaataaaagagtcataaataatgatgggttttggaagccatgattaaagccacaaatcaaagaggaatttccatgtctgcatggcatagaaaggatggctgctcatgaattaggctggtctttccagccagcccattgcatagtgctagtaataactatcagtagccctcaaagatttgcaatataaaacattatgcattggatggatctgctcatatgagagctaataaatcagtgtgggtcttgttagagaa

SEQ ID NO: 398102 - DNA, 622 bp, Homo sapiens
gtgaggaacaggagctgagcaagtgcctacagtcaccacgctgcctacagtgtccaggggattctagcctggataggaaaactggcttggctgagtggactgtcccagggtgaggatctgggaatgagcatatggggatggcagactaccacacgccctggaagctggagaggaaggaggcacccaggacagaaggtgaggttgccccaggtcaacaacttccagatgagatccaccttgagtcatgatcctcagatgccaagccacaggaacctcatcacccacctcatcatccaaactggaacttgatggaaatcattccacaactatgtgttggtgggttgtcttcttaatacttggaaggaggtcttaatacttatcccactgaaatcatgctacctacacctagcaaaacatacatcaaagaaaaacttctaactgggtatatcacatgcccactgtactaacacactggagaacccccaacaacaggaggcccggggagagtccctgacccacagggacttcaggtcaagaccacacccaccatcctttcaaggtggagacagtccccgtaggaaccaaactgatgtataataaaactcatcatttatttctcttc

SEQ ID NO: 398103 - DNA, 800 bp, Homo sapiens
aaggcatgtgtggagacaagacaatatgaatcaaagacaacacagattttaaaatatgcttactcagtccaaggagataaaagtcaagatgaagaatttagcagatatctggaaaattacagaaaaatttccaatgttatatagccaaaaataatactagctgaaatcaagaactcaatgttcttgtgacagcttactcacagctgaagatagaattcgtgaactgaaagactggtgagaagaaaatagaataaaacaagaacagaaaatatagaagataagaaatgtttatcaaatttaacaccgcaggaaaacagcagagagatgcaaaagcaatatattgatagataattactgagatctttccatagctgtcaagataagcaactgatttggggaagcttctgaatctcaagcaagaaagaaaaattcatacctaagcatattataatagaactgaaaaccagagagaaaaaatcttaaaagcaaccagagagaaaaaaatcactttcaaaattctactacttcactaaaagctacctaatcaaaacagaaacgaaaatatagtgaaatggtatctttacctagaatttaatgtctaacagaaatcacctttaaaaatgtcaaagttgttttcaagaaaagtagaaaattctcctacaatgaaatactgaattatacttttataaatccgagggtttattaggaataatactgaaaagagattttcaggcaagagaactatccccaggtggaatgttgatacataagaatgaataaaaagcaacagaaatggcaaa

SEQ ID NO: 398104 - DNA, 563 bp, Homo sapiens
ccatgcaacttggccttcccttccaggatgctcctggtaaatctcagaagaaaagagcagacaagttttatctgtaaaggaagtactccagcacaaggatgtgaagatctatgaaaatagagcacatgtacaccaatgtgtgggtcttctttgcaagcatttcagaggcagctgcctagtctgctgatagctaatgctggtctggtttctcctattcgggatcatatctattttagtctcctctataaattattcaaatgagcccagaagcctttctgtatcagatgggtaaagaagtggctggggattaatttctgaaacattaccctccaagaagaatacttttaggacagtgcttggtacaattttttaagtacaagttactctcccaagcaggctgcagcactaacaacaaggtgacaggtggagtgtgggtcatcctggaagtgacgtggcagcctctgggctatgtcagttctccaggcctccccacccctaccccccagccccactccaaagggtgttttagctctattaagcattctttatgccagacagttaaa

SEQ ID NO: 398105 - DNA, 470 bp, Homo sapiens
aggttgagatgagatgagcttaaatccctgcctcttgagggaaatcagcccagtttcaggacgtgcagttcacaaaactgccccatcttccctttattttttctttttattttatttatttatgtatttattttgagatggagtctcgctctgttgcccaggctggagtgcagtggcgcatctcagctcactgcaacctccatcttctgagttcaagcgattcccctgcttcagcctcctgagtagctgggactacaggcatgcaccaccatgcccagctaatttttgtatttttagtagagagggagttttaccatcttggacaggctggtctcgaactcctgacctcaggttattaatcattctttattccagtgttttacaaatttgtggtagctatgaaataattggtggactattatacatataggtggatgacctatatgtaaaataaataaaagtaatagata

SEQ ID NO: 398106 - DNA, 300 bp, Homo sapiens
  misc_feature (38)..(38): n is a, c, g, or t
  misc_feature (51)..(51): n is a, c, g, or t
ctctagagagtccccctctatccttaatccctatcctnatctctctatccntaatctctcatccttaatctcctatgaaagatagatgagctttttcaacttctgcgagcaaaaaccaaagtaaatctgggagtcaaaaaccaagttaaagtctaagaaactgtcaggtatcttgttcatgattttctaagtctgactagactttataccatctgatatccttgttagtatgggttctccaacttcaaatctgtatactgataattattttggaaacaagctttcctagattaggtaaaa

SEQ ID NO: 398107 - DNA, 309 bp, Homo sapiens
gaactgggtgtacctagagtgcggggtgcaaggaaaccagggtggaagtcattgtaaatacctttattcaccacgttccatctgtaaggatcttaggaaatgtaataacagccaacgtactgaacttaaagggcttgcaatgatgcaggcttttatgaactactctgagagtaattttccttaatatttgatctgttctgggccttgaggaaagtgatgtgtacatacaatgtatttttcccctctttcacccactctcacctggccccactgcttcctctgtgcttaagcctgtgggtggaaactcag

SEQ ID NO: 398108 - DNA, 455 bp, Homo sapiens
tctttattgtcacctgctttctttattatttttgacatgcacatgcaataatcattgatctcactttatacatctattgtttgccaggcaatatagtaggaactgaagtaaaactgttatacacaaacagtacataattaatggatatagtttggcaagtttgcacatatatattatcttgttaccacaccaatatccaggtaataatatatccatcacctccaaatgtttcctacgtccctttgttgttgttgttgttgttgtcagaacccctaagatcgaccctcttaacaaattgttaaatacaaagtacctcattgttaactataggtactatgttttggagcctatctctgtaattgactcattttgtatagctttaacccttgaacaataactccccatattgctctttccccactcaataaaacactaaactcttttaaagcacattc

SEQ ID NO: 398109 - DNA, 621 bp, Homo sapiens
actcccaggctcaagcaagcctcttgctttggactcgcaaagtgctgtgattgccagcatgagccactgtgcccagccagattggtgggttttgtttttttttttccaacaattctggaacattttcaaggattttattgttatcaaatattgtacctttcccattctctcagttatctcttcggaactttgacattttttagcccttctcattttaacctccacgtttcttaaccaccctttcctgttttttagcttttattgcctctatgggttgaagcttctatcttttctttatatctatctttgagtttacctaattctttttctgctatgcctaatctactgtttaatctatccactgagctttagattctaatttttatgtctatcacttatagaagttatatgtagttgttttacaaaccacacggttattttatattttaagatgttctttttatttctttaaaaattttaaatatttgttattttatattttgtaccagctactttcaagatctgtagtctctgtgggtttgattctggtgttatttctgctgactttctctcatggtgactgatttccttatgtggtctatgtttttaaactgtgaccat

SEQ ID NO: 398110 - DNA, 455 bp, Homo sapiens
aaaaacaaaaaagcttgcttgctagtagaaaacagagtattaaaatagaatctaaatcaatgtttctgatcaattgctgcagaaatgtgtatgagtagccgcaaatggagtcatatggcacacagatgtgcttttgcaatggtataaagttgttataaacttgcccctgccccatcacacttccgtgcctggggatttgctcgcacggacacagatctgagaaaatttcctggtccaattaataaatgcttattaggaaacgtggcacaaaatgtgcccacagtaaaagcaaattcacgtgatttaagaggccaggactttttctcatcctttctcttttaagcctaaagggagattagtcttatgtcagtctatctatttcaaacagatctctttaagaagatgttaaccagaacaaaaataaaataccttgatgcctttggaaataataaata

SEQ ID NO: 398111 - DNA, 431 bp, Homo sapiens
ccccccccacccacacacacacacagccacctgctatgcatgttcacaattacaggtcttgtatagttaatgagctcatcagtcaaaacaccactttccaccactctatgatgattgagcccctactgtgtgcaagcaccatgtcaccaaagggcgataaggcagggttgctgccctaaggagcttttactccctgatcaaggcagacagccatgactcatgaagctccagaccagcagtccccaccggtcagtccctggctgctacacagggtggatggagcgcctgtgtgcactcacaggtgcatgcactgtgcccctgagggctgggagctccatcttctctattcccaaaaagcacaggagctctctacactagaaagcacaggagtgagggattttattaaagatataaacttgaatccactcatt

SEQ ID NO: 398112 - DNA, 453 bp, Homo sapiens
  misc_feature (150)..(150): n is a, c, g, or t
  misc_feature (154)..(154): n is a, c, g, or t
  misc_feature (160)..(161): n is a, c, g, or t
  misc_feature (165)..(165): n is a, c, g, or t
  misc_feature (172)..(172): n is a, c, g, or t
  misc_feature (174)..(174): n is a, c, g, or t
  misc_feature (179)..(179): n is a, c, g, or t
  misc_feature (185)..(186): n is a, c, g, or t
  misc_feature (195)..(195): n is a, c, g, or t
  misc_feature (198)..(198): n is a, c, g, or t
ctaaatttgaattggaatatgaatatggacttataatatgttttctcttaaaaaacatgttttctggccaggcacctgtaatcccaacactttgggaggctgaggcaggcagatcacttgaactcctgacctcatgatccacccccttancctnccaaanngctnggattangngtganccaccnnacctggccnatnttttctttaatgaaatttataaatatgcttcttgaataatacacattttgggaaagggaaaaatgtctgttcaaaaagtaaaggtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctccttt

SEQ ID NO: 398113 - DNA, 500 bp, Homo sapiens
tgagatggagtctcactctgtcgcccaggttggagtgcagtggcatgatctcggctcactgcaagctctgccttctgggttcaaggaattctctggtctcaccctcccaagtggctagtattacaagtatatgccaccacgcaggctaatttgtatttttagtagagacggggtttcaccatgttagccaggatggtgtcaatatcctgacctcgtgatctgcccgcctcggcctcccaaagtgctgggattataggcatgagccaccgcatccagccttcctactcttacactcaacacagcacagatacttttctctagcagataccaattaggcgtcctataattcagagcaagcctgacattgtctactggagtaagagtcaaatcccatgagctaagggctcagtctcacaaggctgcccctgacttcagttgccaatcacaagtctggacctccagaatttctgaccaacgatctagctactctgttcaattaa

SEQ ID NO: 398114 - DNA, 472 bp, Homo sapiens
ttttccctaatatctacacccaataataacacatcagtcccttctcatcctttggaaaatccctcttcccagacttttaatcaaattaccagagttccttgctccctgttcagcagcaaatgtgtctatggctggtcaccacagtatcctgagccacacactgaaatcagtcaatgagtcccgcccctggacagatgtatgtgtctttatcatattgccttccaataaattcatatggtcactagccatgtctgaaagtacctaccaaggatatgctatgaggttaattattgtttagctgtttgacacggatattttcccctatgatatttacctcatctgatgatgtcctgcatttccttgttatttcttttccatggctggaaaacataaactgtcttttagtcctaaaaacaacttttattgccatctgcaatttactgcattgttgaataaagtatggtttatttca

SEQ ID NO: 398115 - DNA, 325 bp, Homo sapiens
agtgtcaaactttgatctgattacattttaattttgcttcaccaacagtagatagaatgtgaagctaagaaggtcatgctgtgcagtacagaatgtggtacaaaccactaggggataagacacaagaagcagaaagtaatattatgccagctccccaagaaagatcacaggtttctttgaacatgtgaaattctttagtggagatttttggctcttgtagaatgtaagctacctaagggcagagatttgttctgtcttgtttacagtcgtattccctaggagcaagtgcagtgcctgacacagagtaaacaataaataattgata

SEQ ID NO: 398116 - DNA, 662 bp, Homo sapiens
cctctgcagcaacacttcgctgcctccatctctccgccggaatctcgcaggctcgcgcctttcctcggctcagccccgctcccctcctctcctatcccctcctctcctatcccttcattcccccctcacccggatttgcttcccttcccccttctcccgcccccccctcccccggccgctccctcctttcccccggcctccgtcgggcggcagcggcagcagcggcgcggccggccccagtcgccgtcggtctcccgccttcgggggaaccaggtctccgtccctcttctctcctccagcccgcaccgccccgctccccagctcggtttttccgcaggatttccctcgctctcccctccctgcttggcccccgcgctcccctccctctccactcggcaccatgccccctcccccgggcgctcccccgggtttctgacggccctctgcgccgctccgaccccgccgggatgcagagagacccctagctcctcgcgatggacccaggcatcctggaccttggcgttgccgctccgcggacccccgatttcccggcgggatccagttgattttgttggctccggaccgaggcttgggccctggtttacctccgcttcatccctaccccgctcccggagctcggagccggaggggggcttcgcggg

SEQ ID NO: 398117 - DNA, 384 bp, Homo sapiens
ctctgagcttcagtttcctcgcttacatatgggaaggataacagttattttaaggattaaatgatagttcatgtaatgtttatattacagtatacattggtggtagttaacatgtctagccattatcactattattctttgtataaataatttctccctctatttcataaatttttaaaaattgtcatgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtgagccatcatgcttggggt

SEQ ID NO: 398118 - DNA, 325 bp, Homo sapiens
gggtcgactctcaggatctggtcgctcggacattgcataatttaaatagttggaagcttttaataactaagacctttaaagaatataatttgaagaacaaatctcttgcatctagtttgtttcctccatcttcttcccttttcttcctgaggataatcttccaaaaacccagcctagttgggtttaaacttcagaacctcatctggcttcaatcaaggtgtcagctgggcttcattttcatctgtaggcttgaagagacaagaactcacttccacgcttactcaggttgaaggcagaattcattttttttgtgtgtggctgtggg

SEQ ID NO: 398119 - DNA, 183 bp, Homo sapiens
ctactatgtgccaggtgcataggtcacaatctgtgtgctccagccaggaagtcatcaaggtgaagttcagagaggtgggtgcgtaggcgaaggctgcctgtcatgttggtgacccaggagaaagagatctgaatcatgccaggcagacttctcagggcaggatgagggcacacttgcgagatg

SEQ ID NO: 398120 - DNA, 393 bp, Homo sapiens
tcaggtcctcagtaatggagcaaactgatacttgaatggcatgtatggttatgacttctatcacttgactttgaatttcttaaaaataggcatgagtcttattcctcttcttttaccaacccctgtcacagtagctggccagagtagtgagtcagacactttgcattacgttgatctgaaatcaataacaaaatattgatccacattctatgaattttacacctctcagtatgattcacactcactctggagagtgtaagacaagaggcaaggcaagattgcctgtactttgactttggaatttatttgtagggtgaaacgaggtgttagggtcttggcaacagatttctttactaattgtactttgtttcaggaaaaaaatagtttggattt

SEQ ID NO: 398121 - DNA, 563 bp, Homo sapiens
gaaacccagttcaccatatatgtgtgggcctacttctagactctgtttcattgatctatatgtccttatgccagtttcaccctatcttgattagtgtagctaataaagtaattagtgtagctataaagtaagtactgaaatcaattaaatataagtcctccaacctggttttttgttttgcaacgttttttgcctgttctgagtcccttgtgttcccatatacattttagagtcaccttgtcaatttctaccccaaaaaaatgcctgatcagattttgattgggactgcattgaatctttaatttggggagaattgatgtcttagcaatatggagtcttcccaattcatgaacatagcatatctcttatttatttattcctccatttaactttctcagccatttttttagctttagtgtataggtcttgcatgattttgtttaatttatccttaagtgtttttctgatttttggtcccgttgcaagtggtattttaaatttttcaatttccaatacttcaatactagtatatagaaatataaaaggttttttttgtttgtttg

SEQ ID NO: 398122 - DNA, 503 bp, Homo sapiens
gtgaatattttttatgagatcgaaggaaattttcaattgttttgaaattctcaattgttttcatctttctcaatttaatttggacttaagagatgcttaagttatttacaatatttttcatttcaatttatttaaatttcattcagtatctcctgtgttatctttctacaggcctcataagtggatggactgaattttttatgaaataccagttaatggatagtctatatctatcctgtgtctgaaatctcaacctacatagtcatctttaaatacagggaagcaacagctgaaatccttgttattaagatgggaaatggccaggtacagtggctcatgcctgtaatcccagcactttgggaggccaagacaggagaatcacttgaagccaggtgtttgagaccagactggacaacaaagtgagacccccatctctacaaaaaaaattttttaattagccaggcaaaatagcatgtgtccgtagtcccagctacttgggaagc

SEQ ID NO: 398123 - DNA, 238 bp, Homo sapiens
ttgaaattcagtattgtttcttttttgaattattttggtgttagatagggatatctgagttgggggaaagctccataatcttttcaatgttccaaatcctaaaaatctcaatatcatagctggaattttagatttaaagagaggtaagaggcataacaatgcaatacaaaatcacgtcatctgcaaacagggacaatttggcttcctctctttttatttgaatactctttatttcttt

SEQ ID NO: 398124 - DNA, 295 bp, Homo sapiens
caaagaggaatggcctggagacttgcaactcactccatatgtagacttgaagaaataagaacaccaaaggatcggggtggagagcagtggctttaaacagagaaataaaataggctgagttcctatagcctcctacagagaagacacaaaaaaagtcaaagtaggagctgataaataacgggatttaattaacactggaaaggcccatgaggcttccctacatgctccctacaaaacctctgaactcacatctctcctcttcctactgtcctcagagcacaacataatcctgcct

SEQ ID NO: 398125 - DNA, 453 bp, Homo sapiens
agaccttgctaagggtgaggtgattactagaaggagcaccttttctagttaaaatctaactagattctccttggcaacttgtcttacagaaacaggtatagactatcaccttgcccagctgggcgcatcttcggagggaggcctggggccacgtgcacctaatgaaggtgcctgggagggggctggctttccactcagcaaatgctttcttacagaaagactgtggggagagtccgttttcttagagccgtatgaagaaatcctaaaaaccaactgcccaatctcaactcgtaacagggaacctggggagtgacatcagagattcccaatgttttcctcctcgttgatccctgcgatgaaggcacttgcccatgtgtattctgtagtaggagtttgcattctgaaactggtctttattaaagaacaaacacattatttacaaattaagtaaga

SEQ ID NO: 398126 - DNA, 300 bp, Homo sapiens
tacctgatatttgtggttctggctttggtgggcgagaccttggcctgagaactttggttcacaggaagcttcccttgacaatacttgagtgcaaagcttcatccaggtcccacctgggctgttgccaaggatgctcaagcgttctcttcagtcttccctgtgacttccaagaaacgacaagatctctagcccatccatcggtaaaccaagctgccaaatgtcctagaaaagaagtcagtaaacacagatgagactgacttttgttttttgggttttcttttttgtttttgtttttttttt

SEQ ID NO: 398127 - DNA, 268 bp, Homo sapiens
tcattctagttttgaaacactgagcttgagcaatcctcctgcctcagccttccatttaatagctgggactacaggcagcagttgccaccacaaagttaacttaaaaaaatttttttttagaaacagagtctagctgcattgctcaggctggtctctaactcctggcctcaagcaatcctcatgcctcagccttcccagtaactaggattacagacatgcaccaccacacccaggtgcacatggatgtttacagcagctttattcataa

SEQ ID NO: 398128 - DNA, 575 bp, Homo sapiens
attaaggagttttcctaaatagagggattccctcttatctctaagggttcctcccctcttccatgaggagaggtataaaccaactttttttttctaactatatttgagaacctctataagctctgaattaaatattgaactaacatttgaaatgcaaggataaaaatttaaacaatttttgaatttggaattgtatttataaagcatctcttcatcatgattttagcctgaagttttcatataaatagtaatataaaatgtatgaaagaggggttatcatttacatttgattagaatttgcaaaaaactattttcataaaacttattctgtttctatcctctgttttacatgaaattattatggtcatttttttcatcaaaaaatatttgcattctttcatatatctttatgaccatagagataacaaaataagttacgactacttggcctaatggaatgaaaataataataaacatttactgagtgaatgttttgttcttggcaccgtgcttaaaaattaaaccctttacatatactaactcctttaattaccttataattttagtatgtagat

SEQ ID NO: 398129 - DNA, 299 bp, Homo sapiens
aataaataaataaataaataaataaaaatgtggaatgaattaggcaagttgggctgctaatgccttgccactgaattgaacagccacagacaaaccagaatgcacttctcagggcaaaagaacaaatattgatgaagtcaatcccaacatgctcattccttttccctaatctcatctattagatgagttcctccttctcccaaagaggagtaggtgagaggaggtgagaaagaggccatgtcccactctcctgtgcttccagggatcagaatttccctccctattagggaaatgcgttt

SEQ ID NO: 398130 - DNA, 275 bp, Homo sapiens
aaaactatgatccctctcttgagaaaaatattgatacacagaaaattttgcatgtttgagggattcatagcattcctcagattgccataagttaagaactgctattctaaatagggttaaaaaaaaaaaaagatgagcattgatggaattgcccttccttccttcttcaattcaagaaagaaaaaataacgaagcttagagatgagccagccattgtgacccccgaactccaaataatactgtccttaataataatatccaagggtcatgctagt

SEQ ID NO: 398131 - DNA, 115 bp, Homo sapiens
tcctgggattacaggtatcagccactatgtccggcctttattttagttttacataactttgcagcaactgtgaatatgtaccttcctgatggagtcaattgggtcttgctttgca

SEQ ID NO: 398132 - DNA, 470 bp, Homo sapiens
ccagaaagggatgatggcacccgaagacagtggtgttcaggaagccaagggaggaaggtatttagacaggagggggagagcagaattggcaaagctgtggagaaagtgagatgagaactcctattaaaaacacacaactggtccaatgacatgggatggcatggaaatcactgatgaccaagcaggagacaggggtggaccgcaggggaaaaagagcaagctgaagccagctaaggaatgtcctcgggccatctcctagcggaggcggtagagccgtggttgaaggtacaggaagtggactgttagggcccaggttccccttaaccatgagacctgaagcaagttactttatttctctagggctcaattttctcacctgtaaaacaagagtaacagtgctcacctactaggttgctgtgaggttctttttctttttcttttttttttggagacagagtctcactctgtca

SEQ ID NO: 398133 - DNA, 344 bp, Homo sapiens
gaggcgagaggcggtttgagaagtcagcaaggcgggatggagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctg

SEQ ID NO: 398134 - DNA, 257 bp, Homo sapiens
cagaggctggctggtgtgggagtggccgggacagcagccctggaggtgctccgtgagctgcagcagagggggccgctggcttcgcttgggtacccactcttcttctccctgacttttcctgtgcagatggtggtccccgctctgctggctggcgggaacatggggaacggcggcgcaagtttgaatttgatttgcgaggggatcgaggagggtgtggtgaagaggaggggcggggagggggaggcagctctcacctg

SEQ ID NO: 398135 - DNA, 238 bp, Homo sapiens
gtatgcaggtgaatccgtgtgatagctttatttttttaaatttgtaattgtggtaactacgcataacataaaattgaccgtcgtaatcatttcaagggtactgttcagtggtgttaagtatactcacatggttgtgtaatcaatctccagaaatggttcattttctaaaagcgagattctatattcattaaacaataactccccactttcctctcccctccagcccctggcaacctcc

SEQ ID NO: 398136 - DNA, 663 bp, Homo sapiens
ctcctaattgtagcaaacagtgctgcagaatctgaaatgattttgaagtctgtcatctaacttttgctttgaacacctcctacacaaaagaaaattaaacaacagtgattcccctgacagctttgaatctagaataaacaactgggccacagtgaccaggtaacacagaccagggtgcaaatacaaaacaacaaataataggctatcattgtataagcaatactgtgagggcttcttttgtacctgggaaatagcaaggagcctctgaaaataatttgggtgatggaaggagctatctattgtcctcaggcagggaaggaggcttttataactgagtgtgcagtcctgaaggatggccaggagggaatgtggtctaaatggagacagccttccaggcagagggggaggactggactgtgggcagcagtgagaggttctgccctcgggaatcaggaggtgggaggtatgccgaagccagaactcagatatctaaagcttcgttcctctgagctgccaaatttgccagttgtttttggctttagagatagcataaaacctccctccctcccctccctccctccccacttccttccctctctccctccctccctcccttccttccttccttctttttgaaaaataagctctggccagttttattaa

SEQ ID NO: 398137 - DNA, 483 bp, Homo sapiens
tgctagctgcgactttgcatcattggtttgggctgcatattaagtgcaacctatggtgaaagctctgtgtggtggaagtagggccttgtgaaatgcacctccagcttggtgcccttcactaggcttttacagtgttctggtttctttctttccttttgaagaatacacagctgacttagggaagatggatttttttctgaattcagtatactggggtcttccctatgattgcaaaaggcaagcataactttttgatagacttgccttcgtagttttttgattttcaatgctgttctagttaaaatgctattcttaattttcttcatctatgtctgcaatatattgtaatagaactttcatgtcagttttaaagcttaagtttgctgaactaagtaaaaaaccagatgcatacgaaactctggagacttgcattcttattactgggcatgttgtcttcaggctgtgctataagcacaatgtctt

SEQ ID NO: 398138 - DNA, 503 bp, Homo sapiens
tcgggtggagaactggtggaccctgaacaaaagtgtggctctgctagcaagaaataaaggagaaatgaatgtctccaaatcatctggcagaattttccatagcttgtaggctataacaaaaacttgatctttaagacacagctgtttgtgtgaggtatatctctctttgggaaagagtccaattagttggccatgaggtttaattctgttttaaaaacagatgagtctgttctgacttggaggaattatgtttctggacaattctggcaaaataaggaaaaaccctgattctgtgtttcccaaaatttcttttaataggtgccaaccctactacataataacttattaattttttgaaaaagtttataaatttgaggtttaaatatataccataaaatgtatcaatcttaagtgtagagcttattgaatttttccacatgtgaatgctcatgtaaccactacccagatcaagatataaaacatttcttcccttctgaggttat

SEQ ID NO: 398139 - DNA, 461 bp, Homo sapiens
ctttgtgatggtttactgaaataagaagctagtacacagattacaagggtacgcaaaggcttttctacctttgggtagaaaaggggaaataagagtaaattctgggaagagcatgtttgtaaaatagttcccgtatctctcaattttcttccatcaaaatacacaaaacaacttcagtgaaaaaacaaatacacattgatagaacttccatttccagctaagacaaagtaatagaacctggaacaatcctcagctggaaacatgaactaaacatagtaaaacaataattttaaggattttaacaataggcaatggagggcagtgataactaagagaagggaaacaaagaaagtgagtgaaacagttgtcccaacttactgcctagggagtgtctggttgtggagaacaaacctgggtgtctagagaaaccaaggtagctacagtttactaggcagaatgtt

SEQ ID NO: 398140 - DNA, 1392 bp, Homo sapiens
tgaaaaattcagcttcttattgccacgtaacaaatcatttcagaacacagtggcttaaaaagcaaacatatttcatgatcttgtgggttaggaatttaggtcaggcttggctgggcagttctgctctgctggcatccaccagagtcatttattgctattcaggtgacacctgggctggtctagagggtccaagacagtttcattggttcatttttgtttttaaggcctaaataaagttaaatttcagaagaagatcaatattggtagaaataattgttataaagatgtatgttgtaatttgttggtttattttagtttcttttattaattgcaaaaaattccattaacatttaaaagttatgtaggaaaactaaaggaaatactgataacaactaaataaaacacctagagaacagttgacttccaacagttactattttttttcatttattagcagtctatcctgcttaaacaattactatttaaattaatgcccgcatattttttggcttttgacaagtattggactcttaagctttttgaatttgcattaaaaaatcacattaaatattataacagtaatgtatatttgtagaaatttatggaactgtgggtaattataaagagagtaagtcacctgtaaaagtgttaactctcagagaaaattagtgctttttttgtgtatttacttttagttgcttacattgttctgtgaaagcagcaactatattcatattattaatcagtgtcaatattttaagtagtttagtgaataaagatagtgttaataaataatttgctttttctaatatagtgctaatgttttagctttacagtacaattttgatgacattggatacactagattcaatgagatatatccagaaaacataactgtcaggaggcagacttctttcaaaagaagggagggacatggttacacaatttcttagctatgttttcttctgtagttttagtaggaagcaagcatgaaaagtattgccattctctggagttaagggaagtcagttattctatttaatagctgattaggctgggcatggtgatggtggctcatgcctgtaattctagcactttgggaggctgaggtgggaggataactggagcccaggagttcgagaccagcctgggcaacatagttaatccctgtctctaccaaaaaaaaaaaaaaaaaaaaaaaaaaaaaaattttgtggggcggctcggcgccagaaaaatttctaaacaactgggtgggggccgcggaccaaaggaatgcaacactggccacagcggcaaaggaaaccggggcctagacgggggggtttccccaaaaaaaccggggggcccgcgggttgaaaccccaggggttggggttgggtacacaggccg

SEQ ID NO: 398141 - DNA, 279 bp, Homo sapiens
ccagtctctccaaacccctgaggaactaaggttgtaactgggggagggaaggcgctggctcccggtcaggaatgtgggttctggacccaaagcttcaccaagagtggcagcagcgggtcaattgccaaatggggaggagaaaacacctggattttctgtcccttatccaaaggttcaaatgagttgatgggacaactctcttactcaagaaaagtaaaaagtgccagacaaaaccaaggtgtgactcatgttctttttggatgaattttccattttata

SEQ ID NO: 398142 - DNA, 156 bp, Homo sapiens
ggttttaaggggcagagggcagcagccctctccaactgcacttaggaaggctgagcttaccttgtgacaataagatcagctttctaatcttttgctaaatcgatcacaaaagaaagcaagaataagagacagagagagagaaagaaagagaaagag

SEQ ID NO: 398143 - DNA, 130 bp, Homo sapiens
cgctctcctctttccatccctacagagaaggacagagaggcaaagttccttgcatacccggggcgctgtccctgtgagctcccggtgtcctgcaaacgttggcccctgaatcaccgggccagtgtgtgtg

SEQ ID NO: 398144 - DNA, 371 bp, Homo sapiens
ctgctgaggatggcgaggtggggatggtaatgccagccttctgcacaaaggctatgggccaggggacgtgcactgtccgaggaagggctgtgcagactctgaagctggaccaccagacagtggcagggacagaggaggcgaagatgttgcgtcaccaaggagaagagctgtagcagagctgtgggttgtgaagagttgtgtggaatggatggaggtggtcagacacccccccgtgacgctgtctccggctttactgttggagtggccctgtgttcccacgcttcactcctgccaaagctatttcttgaagttgttccctcctcttgcctgtatttcttcattcatttattcgtcaacaatctgaagggtct

SEQ ID NO: 398145 - DNA, 523 bp, Homo sapiens
aaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactggtaatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctg

SEQ ID NO: 398146 - DNA, 417 bp, Homo sapiens
attcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaa

SEQ ID NO: 398147 - DNA, 248 bp, Homo sapiens
agttcattacaaattataataatcataatttgtaaaaagaagggttgtaggtcagaagtacctatctttggctctcagtcatgaagagctgcaatggtggagccatataaacatatctaacagcccatataaatatatataacttctagattactgatgatacaaataaacaaacataacttctgtaactaggcagatcaaaactaacagtaggccatgtgcggtggctcacatctgtaatcccagca

SEQ ID NO: 398148 - DNA, 692 bp, Homo sapiens
agactgagagaggtgaaatgactttcccgggaacacttgcacaactgggtgagaccagagcctattctcaggcccagaacctgctggtgaaatgacttgtgtcttcatctttctttgttacgtccctgaacacacccgaggatctcttccactctgtcgatatgatgggacatgcttctttaatcttctgtttaaattcctgctatgctcaaacaactaaataacaaaacccactaaaatagaaatgctaacatcaaagtttattatgtgtattttaaagttatcagctgaatagcggttgaggaaaccaccattgggttaaatgtgaggctaaaatcaagtcatttttctaaaaagcaacgacagctactatctattgatatgcactgttgtcaggcacttggacatgcactttgtagaaaaggcattatctcatttaaatcatgcgaccaccctatgatgtaggtactcattatcattctcactcgacagtaaagaaactaaaactaggaacgctaagagagttgccaaatatgtcacagccaatcatttgaagagccaggattcgaacccagttctttctgactccacagtctgggttcttcttcctaagctgtgctgacaaaaatacccaggggagaacacaggaatgggatgagagaatgtgtttgttaaattgttgtagacattct

SEQ ID NO: 398149 - DNA, 602 bp, Homo sapiens
tgtctatcccccatcgtttcccaggggtggagttcgtggttcccaggactggcttttattgcaagctgtgtgggctgttctacacgagcgaggagacagcaaagatgagccactgccgcagcgctgtccactacaggaacttacaggtaaaaatccactctccttgcccagcatgccaggggctccccagtctccataaccgagccaggtgtctggcgtccttggccttgcttgcctctgagtctagctcctacctgcaaggcctactccaggccacaggttacttgccattccccaagcacaccaggctgttttctgcttctgtgtctgtctccttccgctacatggaaaacccctaatcttcccatagacttgattccatcaggctgctctcgacatggtggctacctcctgtgttgctcctagcacatgtctctactttaatacctaaaacatcctgtttgggttggctttggcaatatccacctctccctctatactgtgagtaactcaagttaggccagtgttcctctggcctgtgattgggactgaccccttcccacaagactcggatgttctagtttttctctgtttctgttccc

SEQ ID NO: 398150 - DNA, 261 bp, Homo sapiens
atgatggcatcattgcactccaatctgggcaacagagatagaccctgtctcaaaaacaaagccccaaacaaccaccaaacataggacctttatcaaaattaaaaacttttgtgcatcaaaggacactatcaagagagtgaaaaggcaagctacaaaatgggagaaaatatttgcaaaccatgtatctgataacgggttaatagccagaatataaaacaactccccaaactcaacaacaaaaaaaacaagcaacagaattta

SEQ ID NO: 398151 - DNA, 501 bp, Homo sapiens
ctgtggatggctggcagtgggcagaaagacaggcccagagagcagcaacagaaacagatcgtctctgctctgaacagaaggacttggcagcctggatggcaaaaggcaccacagtagcccaacagtagtcctgttggaaaatgcaaagcctgtatttacacgtacatcccatgaaagacaatcttttccacttttcatgggctacaatgccattagcagtgtcatctttaggcaggaaggacaccgagaggcatatctatatcccctgtccatagattaaaaaatatgagctctaattaagctgttaagaattcagaagagtccagaaatagacccatgcttacatggtcaactgatttttgatagaggccaaggtagctctatggggaaaggataatttttgcaacagccatgctgaacaactggatatccataggaaaaaaaaatgaaccttgactctcaccttataccatacacaaaaattaactcaaaatgggtcac

SEQ ID NO: 398152 - DNA, 713 bp, Homo sapiens
tgttcaagtgattctcctgcctcagcctcccgagtagccgggattacaggcgcccgccaccatgcctggctaatttttttgtatttttggtagagacagggttttaccatgttggccgggctggtctcgaattcctgacctcaagtgatccacccacctgggcctccctaaatgctagaattactggcgtgaggcaccgcgcctggtctcctcaagtattttaatgtcggtctaaaggtttcttcttacataatgaactgtaacctaactagatgtgtaaacagactgtaatctactcttgtaaggagtagcccagtctcagccaatcacagcagccgtacttcaaccgctcgcaggtgaccaactccaagcttgtccaacccatggctcgcgggccccatgtggcccaggacggctttcaatgccgtctaacacaaacttggaaacttccttaaaacattatgagattttatttttgtgattttactttatttcattattgtagctcatcagctatcgttggtgtttattgtatttaatgtgtggcccaagaaagttcttcttcttccagtgtgggacagggaagccaaaagatttgacatccctggaactttaaaccatgttcaaatgcagagctgtgaccaatccagctgtttctgtacctcacttctgttttttgcgtatcactttcctttttctgtctttaaattctg

SEQ ID NO: 398153 - DNA, 669 bp, Homo sapiens
cttgaccttgctgattgttccccatagtagtattaagatgttcctatgtctctttcctgtaaactggaattcgatctagaggcttggtcagataatttatgggttggtggtttattttgacaacatggggttctgttagtttttgttgcactgtatcgggagacacgtgtttggttgtctccattgtgagatgaccagcctgatccacctaatggttttagcagcctttgataattttttttccagaggttgcaaaatgataatttgttaattgtgtcattctttattcatttattatctggaacttttctataaagaagaatagctatccctcatcagtggtaaggttacaactgatgacagttcatgtaagagtcagaataatgcaagattctttcctttacttccagaataatattgatgccctagcgacttttaaaggtgactcgtgtttttatcctcatggttatctacaaatgggtagattttggggataattgatatgtttcagttcattgcagtgtaagacatcaattttatatctattttgggttctaaaattacaccttctttggccccttggagcccctttatatgggttctcctgttgacaacaacttggagagagaatgattttaggattaatagtttataccctgaaatgcagag

SEQ ID NO: 398154 - DNA, 213 bp, Homo sapiens
atgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaacgggcaccaggatctgccagaaaggcagaagcagaagcggta

SEQ ID NO: 398155 - DNA, 392 bp, Homo sapiens
taatggataaataaaatgatgaatgagtaaaaaacctgcagactggtaattatgtgacaatttgcatttcatcagtctttcagaaacataattgctcattttaaaggtgaagatgatatcccattgttttaatttgcatttctttgattacttaagttgaaagtctgcatatgattattagatatttatatattctctttagtgaattatcttttaactactgagaacttcacttcatttaatttcaattttgtaaactcattagagaatatagctattaaccttgtttttggcatatatatttttaaatataggtttcctgtttgttgattatcttttaagtgggtttgtaataccttttgaagcatagacttattaaatattttgaatca

SEQ ID NO: 398156 - DNA, 322 bp, Homo sapiens
ttccttcttattatcttttgactctctccctaagtttccttcggataagcttttcttctgataagatcccaaacactagcatatagcttatgtttgtaaagtataaactaaattgtcagtcactgcaagtgttcttattgttttcccaggttttcgctttagacccagtcctgggcacctttctgatcctcaccagtgtcatcttgatggtacttgtggtaattaatcttttcgtttcggccattctcatggcctttggaaaagaaagaaagtcgcttaaggtaggtaactaaaagataaactagcatgctgttatatcact

SEQ ID NO: 398157 - DNA, 1360 bp, Homo sapiens
acttacattgggggagtttaggggcagtcaaatattaacctgccaccagcctgggaagagtttgtccacacattgagtccctcagctttcacagcttccaccgagggtctacatcctaaaactctcagctctgggagaagaagggattggcctatgcagatctctagacctctgcaggaaaaaagcagcagatttatacgggtgcagaagcacatcgctggactttattccccaggagaagtgcagagaaggggcttaaaatgtagccccctgtttttccccagaagggatttatgacatactcttctggtgactacttgccagcctggcttccaactaacttgcattgaggaattaaaggggtagacaaatattaacctgacaccaccctgataggcgtatgtccacacaacgagtgtcccaacttttacagctgtctcccaaaggattatatcctaaacatcttagctctgggagccaaggggactaggcatagatgagtttttctagatcacagaacaatgggggtggctttaaataggtatacaaataccttcagaggttatacctcctctgagcagtgagcagtgcagaaaggaagtaggaacatgtaggtcccatttgttctccagaaggggcttatagcacacacttccagcagctacttggcagcctggcttctaatgaacttacattcgggagctgatgggaaaacaaacagtagccctctagctaatctcagtgataaatccaaggctactcattcttcctggaaggagtttcgtcatgtctcaagtgccacaacttctataacttccacccaagggacaagctttgggagtcagtggagctttgcattcatgagtagccttagaccacagcaaacaaaaaggtggacgtacagtaggaccacttctacgagcttctcctcaggatcagagggtgcaacctgaatttgagtacaggtttttgccacagatcttctccttagcttagagcagacagagagtgggacataaatgctcaggctcagctgtgaagatagaaggaaatggaaaacccattcagcacctcaacatctccagctacatctagagattctggctcctactctacggtattgtgggggtattgatggaatgtggtacatcctaagctcgaggggaccatcaaaaaagagacagcagtctgaataaacacagagattagagagcaccttaaaatttttggctggatggattggtgagatccttctcctacatgaggccagtctgacaagtctgggagaggttatattcttatgtaatgcatagaagctaacacaaaaatcaaagaacagagaatctattcccaaaaaaaa

SEQ ID NO: 398158 - DNA, 483 bp, Homo sapiens
agaaatctccctcgagatctccgtgggcaccggaaatagaaactgctccctttgaagcatctattagaagatccaagtctctaacagatcaccatgagatttcaattcagttcctattaagcaccaactgaacgcatgtgagaatgtcagggaatcagttggtgaagaggcaaccgttttaatttaattttatttatttgaacagagtaagcctctgttcaatcctgactcatcttctttcttctcttactacccatttgcccttgagcagttcacttaaactttctgaccccatttcctcttcagtaataataattcttgtctcattgagatagtgtgagggcttaaagggaattacatttttcaaaagcatcttgcacagatctggcacagtcagtggtaggtcttcttagcataaggatataaaaagatctttctgtaaggttggtgtggggattaaattggatgacatatctttacttt

SEQ ID NO: 398159 - DNA, 531 bp, Homo sapiens
gacaagcttgggacctatttcggatgcaaaattggtaaatggagcgctcaaaagtgggaaaggaggtgtctctggtctctggctaggaaagccatgaaagtgccataagaggcttcctcagatcacctcccaggcagcccctcaggcctcctacgtctgccccacagagccctcggcaagcaaaatggatgaccatttggggacctattctaagaatgaatcccaggtcccatccacccaaatcctgcctcctacagctaccatgaggagccaagctgtaaacaaaagcaagttcccaatacctgttgaggcagcacccacacgtcgctggtgatggtgaaaacactggcgtctctggtatctgtgaatgcagctgtttgaactttcccttgggcacagagcacaaaggtgccctcaatccacttttaatttcttctgttaaccaatcaagaatttacatgacacgtccagtccctccctttagggattttcactttctgaggtttttgtttgtttgttttttcgtgttta

SEQ ID NO: 398160 - DNA, 696 bp, Homo sapiens
ttctatgaggatcccgaaggcgcacgatggcgcgtccacagtgacaagaatggtgagattgaccaccaccggaacagtatgaaaatctaaaatggacactggagagaaaacttgaggagctcgacggtgagcttgctctgcagagacaggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggatctggaggccatgagccgcgcccgggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcaactccgcagggcagagtggagacaggctgacaccgccaaggagaaggcgcgccctcgtgcgattgagcgtgtgc

SEQ ID NO: 398161 - DNA, 825 bp, Homo sapiens
ttctatgaggatcccgaaggcgcacgatggcgcgtccacagtgacaagaatggtgagattgaccaccaccggaacagtatgaaaatctaaaatggacactggagagaaaacttgaggagctcgacggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggatctggaggccatgagccgcgcccggtgcgcgagtccttcatctcccgaggcgtgctctgtggcagcctcgcaggccaggactggagtctgggggattctaccttttctgctcattccaggctggtctttgctttcatctcacttgctcccttccataaatatttgtttcttttcagggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcaactccgcagggcagagtggagacaggctgacaccgccaaggagaaggcgcgccctcgtgcgattgagcgtgtgc

SEQ ID NO: 398162 - DNA, 673 bp, Homo sapiens
ttctatgaggatcccgaaggcgcacgatggcgcgtccacagtgacaagaatggtgagattgaccaccaccggaacagtatgaaaatctaaaatggacactggagagaaaacttgaggagctcgacggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggatctggaggccatgagccgcgcccgggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcaactccgcagggcagagtggagacaggctgacaccgccaaggagaaggcgcgccctcgtgcgattgagcgtgtgc

SEQ ID NO: 398163 - DNA, 848 bp, Homo sapiens
ttctatgaggatcccgaaggcgcacgatggcgcgtccacagtgacaagaatggtgagattgaccaccaccggaacagtatgaaaatctaaaatggacactggagagaaaacttgaggagctcgacggtgagcttgctctgcagagacaggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggatctggaggccatgagccgcgcccggtgcgcgagtccttcatctcccgaggcgtgctctgtggcagcctcgcaggccaggactggagtctgggggattctaccttttctgctcattccaggctggtctttgctttcatctcacttgctcccttccataaatatttgtttcttttcagggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcaactccgcagggcagagtggagacaggctgacaccgccaaggagaaggcgcgccctcgtgcgattgagcgtgtgc

SEQ ID NO: 398164 - DNA, 1038 bp, Homo sapiens
ggagagactgccaaagccttgcagagacagaaaaaaaatgtgtggttttccaggactgaaaactcagtcgcagcagcccctctctcagttgtacctgtaggattttaatttatagaagcgactgactgatgacagagagactagtggctttgaaggaataatttatccacatttcctgagaggagggacacaccacgccatgcagggccacatggagaagaagcaccaggtttggtcaggaggcagaagggagtgaagggaaagcttaaacgagaacctttattagcgtttcagcagggaaggcaaggcagtgcagggaaagtttgggactgggtggtctgaataattctggtgggttttggagattagcggtatctctaggggttctgtagtacctagccttgggttaatttagggcaggggaaatattggctttgtgttagaaaaagggggtagttagaggtatggacttgggactagttggagggtttgtaatataattttttgggcgcccacaaaaacaagatcataggaaagatgtaaacaactttggcttttcgtttggtcctgtatggcctgagccacagatgcgtttggcataatagcagcttcctggcatgaaagagcccaaaaaaaaagacatcaaaaacactgccttttgcagtagacatctgtaatctttgcctggggaaaatcatccacttacagcagcctgacacggctttggagagccacttttctcaattcagccaggaaactcatgccaatgtgggactgacttctcaagcctggaacaccaggggtggccctgccacgtcagcctggccaatcagtatatcctactggcttggcctgatgactccagctgggccaatgagagccctccacaggactttggctagaatctaccgggaatgtggtaataggtgtgccctttctgttggagttcccaaactgttaaggtgtcatcctggatgtgggactaggaggggagcctgcctgaggatgcagccaccgagaggagagtgcaggcaagag

SEQ ID NO: 398165 - DNA, 324 bp, Homo sapiens
aaaattagccgtgtgtggtggtacacacctgtaatcccagctactcaggaggctgaggcacaagaatcacttgaaccgggggcgcggaggttgcaatgagctgagattgtgccactgcactccagcctgggcgacagagtgagactccatctcaaaaaaaaaatagtttaaatgatagctaataaggttaccatatgtaagggaagaaaacacaatttaaagctattttgtatgagaccagttaggatgagttttaattgatgaatatgaaaataaactgcaggcagataaatagaaaagcccttaaggttgtgagataatgga

SEQ ID NO: 398166 - DNA, 436 bp, Homo sapiens
ttgcctttcctactatcttaaatacttgagaaaatcaaattatcactcaaaagaagagcttaacttttggctatttctgtgaaggcaagcattcaaaaccctaatcagtacaagcagacagcattcccacactgccgcagtctctggaggagcacagagccactgtgtgcaaggccaaattaattacctaacagaaaacatctgaagatatgagtggccttccaagcaagtgggaaaataaacaactcagcaaagactctctgaaatccagtagaaacctgctgaatttaactgttgaactcagatcaagctatctagtatttattgattacttgaaaactatgagattataacgccagcaatgatctgttgcactaaaatgtatttatagtatctacagaatataagacattttgtccattctgtcatatcgcca

SEQ ID NO: 398167 - DNA, 905 bp, Homo sapiens
tcccatattagacatccctttccgtatattgctggatttgatttaccatattttgttgaggggttttaagagtctattttcatgaatgatattggtctgtggtggttttttttttcctttttttcttttaatgcttttatatggtttggatgtcagggtaaagctagccttacaaaatgagttaagaagtgttccctcctcttctgttttctggaagagattgtgtacaattggtattacttcgtatatatttggtagaatttgccagtgaaaccatctggacctgcagtttttgttttctttcaagatttttaactagtaataggaatattcagattctgtatttcttgagtgagttttgatatttgtgaatttcaaagtattggtccttttcatctaagttgtcaaatttatgggcatagagttcctttattatcctcttaatgtatataactgtgtctagtgatatcccttctttcatttctgatattaatactttgtatcttgtttttttattcttttgtcagaggtttatcaataaaggttagctagaggtttattgattttctttttctttttttgagatgcagtctcgctctgtgtcccaagctggagtgccgtggggtgatctcggctcactgcaacctctgcctcccaggttcaaggaattctcatgccttgacctgcagaatagctgggattacagacatccaccaccatgcccggctactttttatatttttagtagagacagggtttcaccatgttggccaggctggtctcaaactcctgacctcaggtgatccctggcctcagcctcctaaagagctggaattgcaggcatgagccaccatgcccagcccatttattgattttcttgatcatttcaaagaaccagcctttgg

SEQ ID NO: 398168 - DNA, 671 bp, Homo sapiens
tgtggtggctcacgcttgtaatcccagcactttggaaggccgaggtgggcagatcactggaggtcaggagttcgagaccagcctggccaacatggcgaaatcccatctctactaacaatacaaaaattcgccgggcatggtggcaggcacctgtagtcccagctactctggaggctgaggcaagagaactgcttgaacccgggaggcagaggttgcaatgagccaagattgtgccactgcaccccagcctgggcgacaagacctcaaggcaggtcctttaggaggtattccagaagaaggctttgttaccttaggagagacagcttcctgcatgttactgcctgtgaagacattcagtgggacaagatgtggaggtggaagacagtgatattaatgatcttgaccttgtgtaggcctaggctaacatgtgtgtttgtgtcttagtttttaacaaaaaagtttgaaaagtaaacaaacaaacaaaaaaccacaaaattttaaaaataggaaaaagcttacaaaggccgggtgcggtggctcatgcctgtaatcccagcattttgggaggatgaggtgggcagatcacttgaggtcaggagttccagacctgcctggccaacatggtgaaaccccgtctccactaaaactacaaaaattagcctggagtggtg

SEQ ID NO: 398169 - DNA, 397 bp, Homo sapiens
tggccccaattttttgtccttccctgtatgcacaccctttgccaagtgactttgcagttcctcccacaaaaacagagtgtatttcttctcgccttgactttggacttgaccacatgactaactttggcatgttagcagatgtgatgcaaaggagggcttggagagtatttgtgcagtggtgcttgccctcttgcactctgccactgccataagaatcctccactctgggtagcaactccttccattctgggtcctagaatgaaaacaccccagcacagatctaaactggccagacccatattttgaacagagccattcagttgaacccactctggatcagctgacccctagctaacctgcagaggtgagcaaataaatgttgctgttttaaatcatt

SEQ ID NO: 398170 - DNA, 227 bp, Homo sapiens
caattggaaatgtgttggaaatgtaagtgatcaggacctaccaaatcagaactctggggatgggtcccaagcagtccaggttttaacaagccctgaatgtgattgtgatgtatggtagagtttgagaactactggtctagagaaaggaaacaaagcttaagatctcagaggtgaccagtatcatctaagaaggaggtacaggggcccactgtactgataagtggctg

SEQ ID NO: 398171 - DNA, 134 bp, Homo sapiens
ggcttgattgccatggaagattctcacacagccaaatttattgctatcttagttaaattatgccagaacacaaaatatgaagttattgtcaaagtaatataatctcagctgtaactgagatagtcagaaactgt

SEQ ID NO: 398172 - DNA, 454 bp, Homo sapiens
ttttttttttttttcaataacaaccatgtatttagctcatgattctgtgggttgacagtttgggctgcacattagtggagggttacctgatttgtgtgtgtgtgagacataattcaaacacataaacttcaccattttaaagtgtataattcagtggtttttagtattttcacaaggttgtggtatgtttggtttttaaacaaactgccaagctgtttttcagagtgggcataccattttacattttcatcatgatgcatgagtgatctagtttttctatatccttgccagcattcagtgctgtcctttttttttttttttttttaattttagccatagggattgctgcttagtgatctctctttgtggttttagtctgtgttttcctaatggttaatgatgtgaacatcttttcatgtgtttatttgccaactatagtcactctggtgaaacg

SEQ ID NO: 398173 - DNA, 301 bp, Homo sapiens
tcagtaactgggaggtaatttgacactaataacagtcacaagcacagaagtttgtggatgctttggtgccttacattacagccgattaaaagttatctctataatgaggtaatttccatggctcaccaagtgggtgtgaaaggagcagaattcttgctggcgggaaggatggagtacaaactacaggctgtgtgagccaagcagcagcccaggcaagcctgctatggatgtgccctcccggctattgtaattagagatcctagaagggcttgggaagtgtggtttcgcagttatttccact

SEQ ID NO: 398174 - DNA, 311 bp, Homo sapiens
caacccatggctcactccctgggaaagccaggagcccagtcacctccagtctccctgtgtgagaggaggggctcttccagcaatgcctggctgaagcctctgaagagcacctgcaggaggcggtttccacaaggaagagccggcctcatcttgtgcagatcaatttgggagacggggtggccggtgctggtctgtgccttgcaggaggcacccatttctgtgggaagagcaggcctttggttgcgagttctaatctggactcaccaacaggctctgcaaccctagacaaggggctggccctcaattaccct

SEQ ID NO: 398175 - DNA, 318 bp, Homo sapiens
tctctcttccccctgctctgcttgagtcttatactctgtgaatctaggacacgtcttatagcatatttgatcctcacttcacctagagtccccattagctcaaaaatgactgagaagtaggctagaaaagggaaattagctgggcatggtggcgcacacctgcagtcccagctactgaagaggctgaggtgggatcacttgagcccagcaatttgaggttgcagtgagctgagatctgccactgcactccagcctgggcgacagagtgagaacctgtctcaaaaaaaaaagaaagggaaggcaaggcgggtgcttttg

SEQ ID NO: 398176 - DNA, 192 bp, Homo sapiens
ctgagtacctagtcatccgcaatcaatcgatgctaaatcaataagtataatgcaaatattctaaaattttaaacaatctgaaatccgaaacaagcactttggataaaggatactgaacctatatttactcttataaagaattaaggttttttttttgtttttttttttttgtgagacggagtctcactttgt

SEQ ID NO: 398177 - DNA, 350 bp, Homo sapiens
taaaggcttttccttttaataaaagcaatccccaaaccatttattttctaacagaaaatggcttgaagggccaggctggcaagatttgatatgcaaatcatggccattagaaatggtccacccaatatggcgattcctgcctccttcttgtcaccaggtgtgccaaggagtcatggccacctccaaataacaccgtgtgttcagaacatcatggcgactcatatttgcacattaaaagggtaaggtaggagggccaggtttttcacaggctacataaatgacacacctcatcaaaaccaataccctgggccctgtgcaaaccagacaccgcctcctacagcatcccagta

SEQ ID NO: 398178 - DNA, 270 bp, Homo sapiens
ggtaccaacacaggtggtaaaagtataagaaaaaacagggcaaaattaagccaaaattcaggaacctctttgggtggactggttgtgagactggcaaggggcacaccacccctaaattacctgcaatgttttattttttcagctgggaagtgggtgcattgttttcacttaggttcttaagtttaagtggtagatcattgggtcttacatattccataacaaaatttttttaaattacaaagagaaataaacaagaaggactcagctgca

SEQ ID NO: 398179 - DNA, 390 bp, Homo sapiens
caaccttaagagctctccttgaacaaagatgggacaatatgagcatcaatgaagacaataactgcagtgaattgaaaaacatcaagtatgtttaaacctatgaatacctaatgatacttgaaagcaaaacacaaaaaatgaattattaccagtggactatgctaatgaaccaattcattcttttgaaaaattggtaactaaatagaatcctttcctatgaattgcactactaaggaatcagaaaacgtgaggaaatttctctatacagaagtatccaagctaataaatgaaaaagaaatattagagtagcacaccattttgcaacccctgatgaattagagtctaggcactaagctgctaacattacacaagacagccaacctccaggca

SEQ ID NO: 398180 - DNA, 264 bp, Homo sapiens
gagaaaaacctttcttgtcttggggtcaagtgacaagcatttagtcccagccctgccacttaaccatctgtgtgatttgaggcaagttggctggagttccgtaacctccattttctcatatgtaaaacagggctaatgattcccatgttgcagagcatgtgaaagcatcctgtccctttcctggtatgcagtggacattgataaatagtggtgaactctagatcactttagtatttcccggggttaatccagtaagtcccaatt

SEQ ID NO: 398181 - DNA, 542 bp, Homo sapiens
acctgtgaaatggagtataatactgacttcatggatttgttaagatggttaaattagataaaatataactcatttagcccatgcctggtttattattaacataatttagaatgaaaattctcctgttgcaaaaaggcatattcagaagtaaattcaaatactatattctaaaatttcacagcgtcttttggaagaaatagctacttttctttaagcacctgtcatatgtgctttcacattgccaacagaatatatgtaggcggtactaaattgttgttttggggttcattttcagtccttcttactggatcctgggtgcaactttagaccccaagtagctagagaaaagtttctctaggtgcctgtcgtctctggttacatgttacactataatctgctttggagcctcacagccacatatgttattgttccacgtgaactgagccagcttacatacacagctctgtggggagaaagaccataaacgaacactccccgtttctagcccatattctgcataatacatgtaagtctctcaacag

SEQ ID NO: 398182 - DNA, 315 bp, Homo sapiens
atattcgctgtattccttttccttcccattcttttctttttatttaaaagtttatatataaatttatgaaaatataaatatatatacaatttacatagaaataataaacactaatgttttcatccctgaatttaagaaacaatattacagtactgttgaaaacccttgtgtactcttcctttaatacacattttttcctcccctcaaaagtaaccattactggctgggcatggtgggtggctcacacctgtaatcccagcactttgggaggctgcagcaggaggatcatgtgagctcaggaatttgggaccaggc

SEQ ID NO: 398183 - DNA, 292 bp, Homo sapiens
agaatcctccatagagtagaaacagtaccttcactatggacaggggccaactgtgcttctcttacacacagatacccaatgaaaaagaggtactctggacctcacactagaccaggtccaatctagtgctctattgctttctttcctctcagtcttacatctagaacatcccctcagcctctagctgatcacacttttggtactggcccataggctgcaccccacaaccaaactaagaggattaacaggagcctttcaattgctgtaatccccttcgtcacttggaggtggc

SEQ ID NO: 398184 - DNA, 266 bp, Homo sapiens
agaccaagctcctggcccaaagcagggctccgcatttggctttgggggatggcaactggctgctccaggcctctgtggagcttgcaaagcagtggccctgggaggaccccacctcacagatgtgtccctttggcccaagcagtcagtgggttactgttaatggtgttgttactattaatttattggcaacaatttaagttggaaggaattgcgcattaagtttgaatcacatgggattactatttctgtgggttaagaaatgatca

SEQ ID NO: 398185 - DNA, 138 bp, Homo sapiens
gctggtgtgaaaggtctgtcagaaaatcatgagattagattgaggtacctcaaaaaatgagagctggtatgatgagtgggtaagaatcataaaagcgtagagtgttgatgatttttatagtttataaatggttcttgt

SEQ ID NO: 398186 - DNA, 441 bp, Homo sapiens
ctaaaggaagtttttgaatgctctctctagagaaaaatctggcttggagaaaggcagttggaccaaatgacatagtaagctggaagttttctggctctttcacaaatctgtgcatcttatgctcttcccataacatgtttcccattaaaagtcactgactgtccgggtgcggtggctcacgtctgtaatcccagcactttgggaggccaaggcgggtggatcacctgagctcaggagtttgagaccagcatgaccaacatggtgaaaccccgtctctactaaaaatacaaaattagccaggcgtggtggcaggtgcctatacttccagttactcgggaggctaaggcaggagagttgcttgaacctgagaggtggaggttgcagtgaggcaggatcgctccactgcactccagcctgggcaacagagcgagactctgtctc

SEQ ID NO: 398187 - DNA, 326 bp, Homo sapiens
agcatttaaggcatgagcaatggaagttcaaaaaggaatccaaaaaaagagtatccagagaggtaggaagaaaacaaggagagtgttattacagaaactaagtacactgaacacatctcgtgtgtcagttcaaagtcatctctacgccacttcttactgcagccacagaatcgatcacagtatacctcttgcttcccacactggggcttttctgacactgctacttgcaacatggagagttctgcctccagttttcctaatagaattaaagtggatggaatcagtaagaattcatggattttaataaataaatatagatatatgta

SEQ ID NO: 398188 - DNA, 423 bp, Homo sapiens
ttaatttttgtatttttagtagttacagggtttcaccatgttggccaggctggtctcgaactcctgaccttaagttatccaccccccttggcctcccagagtggtgggattacaggcataagccactgcgcccagccttaaggataaattcttagaaatagaattactgggtccaaagaacattttcaatatttctgcccttcagaaagatgagtcagttagagggcttcttggcccttagcctcgtaaaacctgggtgttttgttttggtttttaattgccaatttggtaaggaaaagctgagtgttcttaaatgtttgcattcttttggatattttatgaaattgaatctttcttcatgtttgacaatttgtgttttttcttttgtgaattattttttctgcttcctcctgtatccttttt

SEQ ID NO: 398189 - DNA, 230 bp, Homo sapiens
ccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatc

SEQ ID NO: 398190 - DNA, 356 bp, Homo sapiens
tgaggtcattgctttgttgaattttattgaatatcagctatgaaccagcggatacaggcacatgtcttttctcctttaactggtgagactggtgcattatctgggtaccttttgtaatgttttactaaacctgagttcctgggacaaaatccattacttgattaattttgctaatattttctttgctgttttgaaaagtatttttctaataattaagattggccagtaattatcctttcttgtaatgtcctcatttttttgatgttgagattacattatctcataaaatgtgttggtcacttcttttcaaaaagagaggccgggagtgatgggtcacgcttgtaatcccagcactt

SEQ ID NO: 398191 - DNA, 518 bp, Homo sapiens
actattaagagcagctttgctgctgcagaggctgacttgatttggagtgcagagcaaaaaactcccatatccaaataggaaaagaataatgaaagccataatactacaatacaagcctgaagttgttatccttggtggggtgagcaacagaaccgagagcaccgtagaagagctagctgaggtcttcacaacacatcactggcagactggaaggccatgcatatgtacagagaagacctgtaaggacactgcaggaagtaaaagtctgatatgtggatgtgctcccattgcacaaacagatccatcaatggggtataagccctactggctcaaggtgctggagcacaacatctggctagtcttgggctgaccactaagctatacatactctgttgatccccaatttagtctgatggagaaaaagcaagagaagacactaattattgtagcaaattcaagaataaaagcacatcactaccacccctcaaaaattaaaataattgtaagaaaataaaaaa

SEQ ID NO: 398192 - DNA, 552 bp, Homo sapiens
acttacaggaacaacacttcattttcagtaccattagctgaagaagtattaaggcaaggttgccttcttaatgattatttcatgtgttctatcctcagtacatcatttacaatattcagacttggaacaaagtactttgaactctccagcggccagtcagaaaatgaggaacaggttgtgaatagaagatacaaaggagtattagatctgcattgattaaatggtgactacaaatagacttaaaatacatcttcccaattatgaatctctacaggtggttttgtcctgttcacccaactggaatggttgcatcgaagcaagaaaattttctccaaaaattaatacccagatctacgccaaaaacaaagtgaagaatacagcttctgctctcaccaagtcatctctaatagagagaagatttccttaaacataaatatcttcaaaatgcttgttcatttgagagaaagatacagaatattttacatgtgcccttcactggaatatttttatttatttaattcaataaaaattgactcccagttctttatggta

SEQ ID NO: 398193 - DNA, 432 bp, Homo sapiens
tcagtccctggttgctcctggctaaagagtcttattttggagaagtcctggctggagagccaggctgcaggaactcagaaaccagcctgctgacacttccactgcagctgctggaattcagctgacttgatttgactctacttttcatgcaaaggtggttttgtcctgttcacccaactggaatggttgcatcgaagcaagaaaattttctccaaaaattaatacccagatctacgccaaaaacaaagtgaagaatacagcttctgctctcaccaagtcatctctaatagagagaagatttccttaaacataaatatcttcaaaatgcttgttcatttgagagaaagatacagaatattttacatgtgcccttcactggaatatttttatttatttaattcaataaaaattgactcccagttctttatggta

SEQ ID NO: 398194 - DNA, 471 bp, Homo sapiens
cctactaacatatgctttctggaaaaaatatatacacatacagacaacaaatgtaattggtggaatccttgcttaaaggtctctggagtcttagcagaaagttgtaagtaaaccaagaaacttgcatacaaaattattcatttattctactcttcgagtcaagtgtaagacagtactattcatcttggaaagcaatctggctattctttcctttaaaagcaatttcaactggtgaacaaatatgaaatgtactaagtttttcttaaaagacaccaaaggtgtatcttcatatgttttgaaagtaatagtgtaacaggcccaaaagtctttatctgaaaaatcatcatgcaagaaagttgcttgatcaaaagtgattcttacaagatgaatataggtagcgtcttactataagtacagccaggatgtgattataaaagtataaatgcattcctataaatagtaacacttcaa

SEQ ID NO: 398195 - DNA, 310 bp, Homo sapiens
gtctgtcagtatattgacatgtatatagagctgtcagactcacttcacactgaaggataataatggataataatttggtctcttagggagactaggcatttaaataatcagttcatgggccaaccatgtatagaaaacactttgccctatccctttgccctgcccctaggagacccactaagctgctgcttgtgaggggtggggaagagagatctcaggatgatgtctaagttctcagtgaaacctggtcttcctctctctaaatgtttcccacctccagctccagtgcagtgtcgcagacatccaccaa

SEQ ID NO: 398196 - DNA, 591 bp, Homo sapiens
ttgagttcagtctgcgaaaccttttcactgtatattggtcaagtatcattatctcattgaaaagtatagtaggcctggaataccttatacaatgcagatgagatagaaatgagaactctctaaattgtgaaggcctacttagccataagcttattattattattaagagacagggttttgctgtgttgcccaggttggtcttgaactcctgagctcaagccatcctcccaccttggcctcccagagtgctgagattacaggcgtgagtcatcatgcttggcccatgaactgattatttaaatcctagtctcctaagagaccaaattattatccttattatccttcagtgtgaagtgagtctgacagctccatatacatgtcaatatactgacaaacgtttatacccatgtatagaaaacactttgccctatccctttgccctgcccctaggagacccactaagctgctgcttgtgaggggtggggaagagagatctcaggatgatgtctaagttctcagtgaaacctggtcttcctctctctaaatgtttcccacctccagctccagtgcagtgtcgcagacatccaccaa

SEQ ID NO: 398197 - DNA, 606 bp, Homo sapiens
  misc_feature (13)..(13): n is a, c, g, or t
  misc_feature (17)..(17): n is a, c, g, or t
  misc_feature (21)..(22): n is a, c, g, or t
cgactctagagancccngcannaatgtctgcgacacttttcactgtatattggtcaagtatcattatctcattgaaaagtatagtaggcctggaataccttatacaatgcagatgagatagaaatgagaactctctaaattgtgaaggcctacttagccataagcttattattattattaagagacagggttttgctgtgttgcccaggttggtcttgaactcctgagctcaagccatcctcccaccttggcctcccagagtgctgagattacaggcgtgagtcatcatgcttggcccatgaactgattatttaaatcctagtctcctaagagaccaaattattatccttattatccttcagtgtgaagtgagtctgacagctccatatacatgtcaatatactgacaaacgtttatacccatgtatagaaaacactttgccctatccctttgccctgcccctaggagacccactaagctgctgcttgtgaggggtggggaagagagatctcaggatgatgtctaagttctcagtgaaacctggtcttcctctctctaaatgtttcccacctccagctccagtgcagtgtcgcagacatccaccaa

SEQ ID NO: 398198 - DNA, 583 bp, Homo sapiens
ttgagttcagtctgcgaaaccttttcactgtatattggtcaagtatcattatctcattgaaaagtatagtaggcctggaataccttatacaatgcagatgagatagaaatgagaactctctaaattgtgaaggcctacttagccataagcttattattattattaagagacagggttttgctgtgttgcccaggttggtcttgaactcctgagctcaagccatcctcccaccttggcctcccagagtgctgagattacaggcgtgagtcatcatgcttggcccatgaactgattatttaaatcctagtctcctaagagaccaaattattatccttattatccttcagtgtgaagtgagtctgacagctccatatacatgtcaatatactgacaaacgtttatacccatgtatagaaaacactttgccctatccctttgccctgcccctaggagacccactaagctgctgcttgtgaggggtggggaagagagatctcaggatgatgtctaagttctcagtgaacgtcgtcgcctctcctatgacctttgccacagctatgtccatgagtctacgattgcgaca

SEQ ID NO: 398199 - DNA, 574 bp, Homo sapiens
agtcagaaatagatgaaaaataaatcttgtagcagtaaaaataattctcattccagcctgccttttgctaataggaggaggatagtgttgcaattgaaagttagggagcctaagaggaataggccttagttgagatggaataatttccaaccgagacatattgaattgcagatgaaggctgggtatacagtttaatgtgcagtaggaaatgtaggtctaaaacttgggaggccttggcaatgaggtgataggtgaagctgtgaaaatagttgggactaacaaaacagagaatagagcagaaaagaggaacactgagatttaccttggggaaggcccacacttaaggaacagaagaaacagaggaactaaggagggagatgaagaaggggagtagtcaccttcgcagagagacccaatatattatcagagcaacgaggcatttcgagatggaggaaactaccattggtgtcaaaaactagcagtggcacactttgggaggccgaggcgggcagatcacgaggtcaggagattgagaccatcctggctaacacagtgaaacccagtctctaccaaa

SEQ ID NO: 398200 - DNA, 263 bp, Homo sapiens
ccacgacataaataacagcactagaggaattgcaaagccacagccattggtatatgagaagtagaacagatactcggtgacggcactaggcagtggaaattggctttcatggttccagtcttttcttctagttgccaggacgcttgggcatatggaagcatcacaagtcaaaggtgctaagattgactcatcggtctcattttcaatttcattttgttaggctgacctttgggtgttaattaggttcaaagtgaacttaatta

SEQ ID NO: 398201 - DNA, 487 bp, Homo sapiens
gttacttaatgcctcaagcctcagtttcttcatctttaaaatgggagtgctaataccagccttaacaagctacagtgaggatggaatgagtcaatagatgtaaggcatatagaacggcaccctgaacactgtaaaccttttgtacttgtctgctgatatttgctgtcatctgcgaggtcactcacctgtctaggtttgtaactgagctgggtggggctccaggttgcagtaggatgggaagttgtccttcatgcctttgaggaagtgacaggatagcctccaggtggcatgtggcaacaggtgtagcaaaaagcctttttgaactacatccagggactcttaagcgctcaaattaaaccgtcttttggattctctcatttttaaaaactcaaagcctcgttcccaggcttcggttcctaaccatctttctttactcccttgcaagagattcgggctgatggttaccgtcatgtctaagtaaacgatg

SEQ ID NO: 398202 - DNA, 465 bp, Homo sapiens
tgctgtcttatctcaccctcctcaccactgcaagtatgcctgtcttgtggcactactttctgccaggctgccaggaaccatagttagttccttgtgtatgcctgttggtctccatattagattgtaagctccttaaaggcagggactgtctgatgattatagtcgagtagttgaaaaagcataatcaggccaggcatggtgactcacgcttataatcccagcactttgggaggctgaggtgggcaaattgcttgagctcaggtgtttgagaccagcctgggcaacatggcaaaaccccgtctctccaaaaaataaaaaaattagccgagtatggtggcacaagcctgtagtgtgccaccactgagtgtggtagcatgagctactcaggaggatcatctgagcctgggaagttgaggctgcggtaagctgtgatcatgccaccgcactccagcctgggcaacagag

SEQ ID NO: 398203 - DNA, 136 bp, Homo sapiens
ggtggctggctgtcagcccattggctgggccctgtgcctctcatcttccagcaggctagctgggttttgcttacccagcagaggtggagcccaagagataacagcagaaatgtgtacggcatctcctggcccaggg

SEQ ID NO: 398204 - DNA, 397 bp, Homo sapiens
tggcaacttgtgggaaaaatcattactaacaattaacagcacaataaacaaaagggaagaactgtcaaccacccaaaaggttttcatgtcactacaaagaattattaggtttctggcaagaagctgttgaaataactatattaaaactataataatggctctgtaatcttttactctatagatgctatcgtcatcagggaatgaagatatgaaaaaatgggaaaacctatttttttttttggctaagtctgataaaaaggcggatagtcatggagaactctgattggatacaaaatatgatctattggtagtaaactgaagggagcttagcaaggcctgttactcaccaagattattctccttgtccctgtgtcttcacagataagaattccctctt

SEQ ID NO: 398205 - DNA, 259 bp, Homo sapiens
cttgctctgttgaccaggctggtctcgaactcctagatcatcctggatcctcctacttccacctcccaaagtgctggtattacaagtgtgagacatcatgcctggccggcttcatttcagaaatctttccccagcactccatatattacgaataattcctttcttcttctttagatagcattgtagtcatatctctattacctcacttgtcacatgataatcagttgctcacccatccatctcccttgattgctcatga

SEQ ID NO: 398206 - DNA, 411 bp, Homo sapiens
ctttcgccatgtttcccagtagtggcttaatgcagcctacagggttgcccaacccattagttttggtcagttcatctctgttatgactgccctctcttacctctcttttggagaaccaatgatttaaattctaggcatttaagatcacagtaatagtttcagctagcttgtttacagttcattcccagtgctcaccacatgtgccaccatcctaagtgctttaggatcacctgtgctttatgtatactaagtcatttaatgctcataacaacaatctttcttcttctatggaagagcacagaggaatccatagtcttagtttttcaagagttgattctgacagttcatggaaagaattaacagattcaactttgtgggttagactgatatttcaaaatgtgtggaacaact

SEQ ID NO: 398207 - DNA, 261 bp, Homo sapiens
cacgtgcccaccaccacgccgggctaattttttgtatttttagtagagatgggatttcactgtgctggccaggctggtctcgaactcctgacatcgtgacccacctgcctcggcctcccaaagtactgggattacaggtgtgagccaccacgcctggccttgtaagtgtatttctgtgtcaatagatgtattttctgcagcattattttcttttcctgggataaatcacatgtagtcataatgtgctgtcttttttattta

SEQ ID NO: 398208 - DNA, 271 bp, Homo sapiens
ttcaggaactttagtgattatcagcagacccatggttccatctgtgaaaactgtatctgttattcaggtaagtagctgggtgagagatcacaatgagaaaaaactttcaaggtctgcacttggcttatctggaacactaacaggactctttttccttgaaggctgaagctcatgaccacaaataaagctcatgctattagaaagggactccagtgaagataaacatttattgatgtcaaggataacatttaaaaattcctcttgaagctgg

SEQ ID NO: 398209 - DNA, 161 bp, Homo sapiens
tcaattaaagtacttatttcagtaaagttagctgcttaatactgatgaggtaatacatgcaaaacacttagaaggatgcctggcacacaataaatcctcaataaatactgattattaatattattactattagtcttatccaggtattttaatgattttct

SEQ ID NO: 398210 - DNA, 532 bp, Homo sapiens
taaatatacagtatatatctatgttatatgtagtatatataataatcacaattgctatatataataattgctatgtattatgtagtatactctctctatatatatgtgtgtacataaccaattaataattactaagtattttggacctgaattatcattattcattagtagagataatatagccaaaaggaatgagaaggggacttgtagtcaagctgacttaagttcagtcctcaaatttcttgggcctaatttcttcatatgtaaaacagaagtaacgatagtttttatatagctattgtgtgtaagctgcaaaatatgctaaatacctggaatagtgtctggctcatggaaataataagtggcagcaagtatgatttcgtattatgcaagttgaataataattattggcatcctaggcccatccttatgggggtcacggtaatttttattttttgccatagaacctgtgatgagagaaatgtaacacttaccccaggtcacccaataagtcactctatgtcattaggac

SEQ ID NO: 398211 - DNA, 521 bp, Homo sapiens
aagtatgtatattataggcaacactaactaggtgtattttctgctttaaaactactatgccagaaaaggattaaataatgggctgattgatgacttagaaaatgtttgattgcattactgcatcatgatgagacttaaggaatccgtgtgctccttggcaagcaatgactttgtcaaaggagtgttggtcctgctttcaaatgagtaagaatgtgatgtgaccactagagatgttttttcaatgtgagcaaaatcattctgaagggaaggatgaaaatcattagtgaaagttgggtgaggtaactaaacccagtcttaaggagtttggagagaacctcggccctgatctttcagtaggtatctctgaaactgattgctagtgcatattgatagaaactagaagcaaagctgtcaccttcctctcacttccatagccagctcagcacatccaaggaatcccccatctgtagattttatgttaaatgtttgattttacttaataaatatttgtaaatgtgtgt

SEQ ID NO: 398212 - DNA, 465 bp, Homo sapiens
ccgagctggaggtgagccccacagcctgcagagcagccctggactcgtgagccccatcgcaccagtccggtgggacttcagagatgtggaatccagcctcctctagtattgcagagctgggggatgggagctgcggattctgacaccacagctgccttatatatgccagatgggctggggcaagacacacccctttctatgaaatgagcagtcagtccaaatagatgagctaaagaaaggctgtgggagggacccagctctagcctgaggctacagactggcttccagggtactcaagcagctgcctctgggggaggggtcccaggtatgagaggcagggctcagaatctaggccaagcctccacaggacccccctctggagagctcggagcagtcttggggggagggtcagcaggcagcaagtgcactaggagcatctttcacaaggcacccaatattgcatct

SEQ ID NO: 398213 - DNA, 563 bp, Homo sapiens
cattaatatccccagatctggggccttccaagggagtcagcagaaaaaaaatatataataatttcacagatgaggagacaggttcagaaagggacagctacttgcttaaggccacacagcagggagtagcatcactgggccttggaccagctcccaaagcctgagctcactgtttctctgtttcttactgaccatgtgttcatttagaaaggttatttaaaagcggaagcaaacatttcataaaactataaaatgttaactatatataacaatttataacaagatggggcgtggtggttcatgcctgtaatcccagcactttgggaagtggaggcaggtggattgcttgaggtcaggagttcaggaccagcctcgccaacatggcgaaaacccatgtctctactaaaaatacaaaaattagctgggcgtggggtgcacacctgtagccccagctaatcgggaggctgaggcaggagaattgcttgagcctgggaggcagaggttgcagtgagctgagatctcaccactgcactccagcctgggggacagagagattccgtctc

SEQ ID NO: 398214 - DNA, 314 bp, Homo sapiens
gtctcttttagcattgtacattggctaaagtggaggggaatctgtccccaaaaatggcagagtgggaatattctgacccttctgagcacggctgacagtgtgagccatggagaatgatgacatttttcagcaacagaactgtcaatggatgtgttacagctattttagtgccttctcccctcctggagaaaagccattttcaaacccgttgcttgcaatgcattaagtgatgaaatacagataacaaattgcgcatttgtttggcttcatgcttattacacccccggttctggaaagcattgcacttagcccct

SEQ ID NO: 398215 - DNA, 279 bp, Homo sapiens
  misc_feature (10)..(10): n is a, c, g, or t
  misc_feature (19)..(19): n is a, c, g, or t
  misc_feature (23)..(23): n is a, c, g, or t
ctctagaggntcccccaanagancaccctgaaagggtaggaaaggctttagggtgggcttgaaaatgagcgggattttgagggttgagttaggggagtggtagatgggaacatcatgttctcgtacagggaacagtgagcatgataaggaggtagagggcaggtgaccctggagtttggggaactttgggacatctgattggccacagcatagcattggagcagggcagtaggggtggtgggcttgtcactgagggcccagaactctctgtccttaatt

SEQ ID NO: 398216 - DNA, 693 bp, Homo sapiens
gtgacatcatcctcctggacaggcagaggtgtgtactggcagctttccctgctttctgaagcagccggagtgccatgtgcaagtaatctttcatttccaagatgaagagcctgtgtgcacactcatctctctgagagaagcatggctttcacagaggcactcacggtcatgaaactcagctcattaaccctccggaaattcatgaggaggctctgctgagaagagtcactgatgacagaattttaaactttattttctgtccccaataatgttggtgattatgcccatgaaaacgcatgggctttctgtggctgtcaaggactttctagagaaattggtcttgagcttgccatttcgtcagtgctggctctgtgctttgttaactccagggagcttgaagcctgtttttttgttgttgtttgttttgttttgttttgttttgttttaacagatttggacaaaacagaatccagtggtagtgacagtgatgatggcagccaatgtgattaactgaagcatcatttttatttattttatttatttgcttttgcttatttggtcttaaataccaagttgagatatcattcaatgagatttcagacagcgttaaaagtgaaatggcaaattccgtgggattccatatgactgatgagacatgattatttgtcaaataaagcaaaatagaactgttct

SEQ ID NO: 398217 - DNA, 317 bp, Homo sapiens
ccccggccctcctgttcacacacaaacttcaccttaggagacttggtcatttttcaaatcacacttaacttgagcacatactgaattcaacgcaagaaatatcatataaatatttatatttatagaaatctaataatgaattggacttctgaaacttttggtaaaattcaatacttctatgaaatctcgcttttcagggggactctcacagtcctgcccatctctgtgtcccccctttaaatgtttaagtgtcctgtattcatccaggagggacaagaagatgcagagttccactctcaaaggccaaagaccgccaa

SEQ ID NO: 398218 - DNA, 410 bp, Homo sapiens
cgttattagattctagtctcgtcagttgtttttgaggttttttttttccctgcaattcagactaaccccgcttattcttgtgaaccaacaagtgatctctggctgctgctcagaagaaacaagacagatgggtaatgtaaaaatctggattagtattctaattctgggcaggtattggaatcatctagtgactccatattagcttggtttcaacaattgcccagttcatggaaagccttcttatttagtttacttgggatagtattacttatttagctttactcttgtggaatatattgttattgtactctatatgtaggaatgcaggataagcttaatcaatgttctcttaaattgaacacattaattttcctgatattactttctgccagagctcaagagttatgagt

SEQ ID NO: 398219 - DNA, 636 bp, Homo sapiens
tgttttttaacagtgagaaaaactacatattcactatcatcatacttagttttgaaaccatctgttcagaaatgatcctattaatttaaaaaagaaagtatttgaagtccagctgattataataaaagtgatactgattctagcaatgcttttgacctctcatacacctttagttcttttgtttgggtcccagacaggagaaagcctttaaatgtctatagattctttaagacataggagtcaataacgattcactgactaatggaggaaatatttttatcacataagattcaaagtttggtaagggaaatctcattataaactggtgtagttaatctgtaactatatttggattgaataaacatgttagtaatttctcaaatgcatacttgcctccctgcctgctgccctacaaacctacagtcttcctgaatggtagcacagctgcacagaccacagaggttttcaggaagaaaactctgcctgcctatccagaatgggtcggtgaatgcagatgtcaccttttcttttttgtctacaacttttgtgacagttataagccgattaagatagctttaaagcgttcagactttgccactgactgtctttcttccttaaaacacatgagaaagttat

SEQ ID NO: 398220 - DNA, 840 bp, Homo sapiens
tctcagagagagagagagagagagagagagagcacaatgaaaaaaataaacctgatcttgcacagagcatgtaataaaacctgtgcgttcttggctatctctctctggtctcctccagggtgctgaataagctcttctctctccattcacccaggagaactctcttctgctgattttctgtggagctagatcaggctgtgactcagaatctccctccacctccaccctttcctattttcccaacaccagtgtcaatctcagatgtcaacaaccccacgagtgagttcctcctgttgccaatacatccaggtcctgttctccgctgctgtctctacccaatcccttcccttccttcctcctgccaatcctgctttccctgtttcttgctcctctgacctcctccgcattgcttgactgtctcagatacactctggcctcagggtcttggcactttctgttctccctgcctggaagggtcttccttagtcagatactgaggtcacccattgtgttcaagttcctttaatttatctgaaatgagtctgggcgtggtggctcacgcctgtaatcccagcactttgggaagccaagccgggtggatcacttgaggccaggagttcgagaccagcctggccaacatggtgaaaccccatctctactaaaaatacagaaattagctgggcgtggtggcacaaacctgtggtcccagctactcaggaggtcgaggcaggagaattgcttgaacctgggaggcggaggttgcagtgagccaagatcgtgccactgtactctagcctgggtgacagagtgagactctgtctcaaaaaaaaaaaaaaaaaa

SEQ ID NO: 398221 - DNA, 405 bp, Homo sapiens
tttttaacgagcagatatttataactgctaccaaaaccaggaatagtttactaaatatgggggtttgaagatattgtctttagctgggaaaagcttccaggctacaagagaggataaagacagtgagtaacatttgagatgtactttatttcattacctaacaaacacctatccagcactcacaatggacaggctgtcttccaagcaggaaaagattatggagcatatgctgtacatatgacctcatttaatcactatagagtatatgttcaatgtctggatgttttcaatgtctggattaattcagccgtccaggaaagaagtttgtgctttgctctccatggacaacatctagtaaaggagacttagtctcatcgttcttctctgaggaggcaggattcacga

SEQ ID NO: 398222 - DNA, 485 bp, Homo sapiens
atctccttccactgtctgtcagcacaggcacccttgggttctccaggagccctgctggctggaggcatctattttcataggcctggagcaaaccacaatgccccaggtgtggtagatcctctctagagccaggacccactcctaacgccagaagacactgcagctgcttggagcccacatggtggccaggcccatcctgtccccgcagcccactgctgtgtgtggctggttttcctggcgttgacatctcctccaattctagcacatcgggaccactttgggcactgccaattccattcagtgctggagggccccaggtctggcctgccagggatccacaggcacatgactgcaacagcctcccacccaactagggcagtgccttcagcacctgctgaggctgacctgggcaacggtaggctccaggggctgtggtttatagaaaccacctgcctgctggtgggttcagaggatggctcacggat

SEQ ID NO: 398223 - DNA, 829 bp, Homo sapiens
cggccgagattctcttttatgtataacaaaaatgactgagcttcatgcatattaacttttagctcattccatggagatgggacactcctggctgcttgtctagcaacagggctgcctgtctagcatgcctggctttggaacaaggattcccatttcagaatgatgagagtaaaagcccttttactgtgtatagcacatgtgaaatgattttcacatctgtgaacttacgttagcttcacaactttgttggttttatgattcctgttttataaacgagaaatgtgggctggagaacatgaagtgcccaaatgaagaacatataagtgacagagcaaggaaaatagactgcactcctgcattcgtcttgaggctgattgggttctaattctttccaaagatgcaggtgtgagttgattgatgaactcagctcagtctttagtcatatttgatcaactcctagaaatagtttgatgtaggagggcaaggtgggaattgtcaagagaagagactggagaagagactaagggcctttgcatcatgttaaagagcttagattctatcccatacgtgatggggaggcactgaagggttgagaaagtgcaatcaatttccattgtataaagaccactattggccctcaacctttcatctaaaattgttgggactagatgtgaatgagaaatgagaatttttcagattttagaagaataaaacaatgcatatgttgtttattttactaacgttaagttggtaaagccattttccaaggagtagtactcaaattaattcaggtaagctgctttgtgattctctaaattgatatgggcac

SEQ ID NO: 398224 - DNA, 305 bp, Homo sapiens
caacttaaaatggattgaagatttaaaagtaaaatctgaaactatacaattctagcagaaaacataggggaaaagcttcgtaacattggtcttggcaatgatctcttgggtaagacaccaaaagcaggcaacaaatgcagagatagacaagtgggactacatcaaactaataagatgcacagaaaggacagtgaaaaggcaacttagggatggaagaaaatatttgtaagccatatacactcggccctttctatcttgacggttcaaccaagaattcaaccatccttggtttgaaatatttgaaa

SEQ ID NO: 398225 - DNA, 419 bp, Homo sapiens
tctctgcattctcatgccggagtttattctccagtgcactgtggttcgttctctctgtgtgtgtgtgtgtgtgtgtgtgtttgtgtgtgtgtgtgtgtgtaaatatgagcaaatgaagtgaggatgaatggaatgaatgaatgaatgaaactcaaagagcctcagtgcaggaagacatgtttttcaatctttctgaccttcttgtcaatatggactagcatcagacacctcctcttagcacatatagggcctttcatgtgagtacaaagctcttttccctttacagcccatttctatcactacgtctctctttccagagtctcaatttagtaaatgtttaccaagcacctactagctgttgagccatgtacccgacacttcatgcaggagtatctcatatcaccctcaccagccccacg

SEQ ID NO: 398226 - DNA, 236 bp, Homo sapiens
gcggtgaagcccagcaggtaggcaggtgtgacatcacacttagtgttgggggtgagcactctggaggccacgaggagatgactgtgctaagtgcgtggaaagatgaggggccacagtgacttaaacagccattctaccaaaaaatgtcacaggagaccccaaataataggaacaacccacaggcctcttgactaaagagatggacaaatagtggtctagacctttgcacaatctgg

SEQ ID NO: 398227 - DNA, 321 bp, Homo sapiens
atgagaggcggcccatataggctattgattaccaaaacacagaagtgtaggtttctgcaggcccaaactctttcttcttggatactggatcaattatatcactatttgatcaatgtcaaatctccttcttatatcaacattgatagaaatctatgtcaatgtcctaatctaataggcattgtctagcagactttctattatgtagtagattcttttttcctgagatggaactttctcccctctgcattgactcaatcaatggggaaatacatgaaaaaaataaaaatactttttgcttccacctataatatattgctgaag

SEQ ID NO: 398228 - DNA, 436 bp, Homo sapiens
tacaaatttttaatccagattgtttccttgtcatctagcctgcttctgagccttcatcctactccttaaaatcattgtgtatagagccatagcaaatagattttaataatatcctaagcagcaaagtctgtcttttaaatttgttaatcaaaaggtgtatttttattttactaaagtataaaattaattccctttgcctgttgctgccttctattagtatagatcataagactttaatatattaaaagcattgttcttgaatcagtgttattttaggtatgcttattgaacgccagtcataagggtccctttctagggattatttagagaacatttttttcttttttttaatgggacaacacttcattctataaaacagaataagtgttccagaaactattgtttaaaaaagtcattctactggccaggcacggtg

SEQ ID NO: 398229 - DNA, 336 bp, Homo sapiens
tcctggcttcactttccgtttcatagaaagggccacactattgactttgttcaaagtttttatctctatgtaagtagaattttagaaatactaggaatggataaaacatcttacaatctcctttgccttcaggtaggactacactggacctagttattgagattctttaagccaagtacaagacatttcttactaagccattccaatgtaatgataatgactaaggatctcatttacaaataaaggtactcagattgtgtttactcacagtatgtacacccaggaatctggaaatgagtattacttggacagagtggattggaagaaggctgacac

SEQ ID NO: 398230 - DNA, 487 bp, Homo sapiens
ctgacttggacaggcatctgaaacggcacaaaaggctgtgatctggtgccagcttctttctacagctttatctcctgcctctcacatttcatttcagcaaccccaaatggcttgtcatcccctgcacattcagagctgtttcttgcctgttgctttgcttactcagaattttctgctttgactgccattcctcaaattgtcgcttggctgacttcccctcattctttaacactcaatttagatggcaccttctccagaaagccttccttgactccctctttctccatgctggattagtgcccctcttccatgctccctgagtacctgcaaagcccttgatccacatagttacagtgatttgttcctgtgtgtggtttctccactaagtttgtagagcttagttctcagcaagactagttcatgatgcctagcacaaagtaggtgctcaagaaatcttggttgagtcaataaatgactgactgaatga

SEQ ID NO: 398231 - DNA, 370 bp, Homo sapiens
tgcggccgtgggccagcccgtgtcactgtggccagcctggtagggcatcctcaggacagcgcagccggcccctgtggtcactgctagcccagtgccgggggtaccagcccccacggccactctacaccctctgaccacggcgacggcccgccagtttcctcccaggacagtgctgctgcccccggtgggccttcctagccccacgtcagtacggccagccccgaaggtccctgctgagccaggccagccgccccggcggtcgctgctgcgcctcaggtagccccagtggttagtggaagccccagagctgtagggcccactcacgccttcactcctgggcccgggacagccaaggcagcagaagcggccg

SEQ ID NO: 398232 - DNA, 255 bp, Homo sapiens
caatagtaagggaatagataaattaagatacaactgtaagacagaaaatgatgtggccaattatgtctgaaaatattttataacatagaaaatgcttatcataaaatgttaaatggaaaatgataaaaataatatgtagaatatgaatctaattttttttttttctgagacagggtttcgctcttgtttgttgaccaggctggagtgcaatggcacaatctggcctcactgcaacctccacctcccaggttcaag

SEQ ID NO: 398233 - DNA, 712 bp, Homo sapiens
gccgggcgcggtggctcaggcctgtaatcccagcactttgggaggccgagacgggtggatcacaaggtcaggagatcgagacgatcctggctaacacggtgaaactccgtctctactaaaaatacaaaaaattagccgggtgcggtggcaggcgcctgtagtcccagctactcaggaggctgaggcaggagaatggtgttaacccaggaggcggagcttgcagtgagccgagatcgcgccactgcactccagcctgggagacacagccagactccgtctcaaaaaaaataaaaaaataaataaataaataaaaataaaataaaataaagaaataggtgaattgagcaaggtcattgtaatacagaagttattaaaaataatttgaaaaaaaaaaaaacaacactaacaacattaaaacttaaaaaataaatatacaactttatatctacactatcaattacttctcattcaattctattaaaccctcaattcccttataaccaatattcttcctttttctcggggcccaaattgtggccttttttggcaaattccctctattgggggggctgtaaaaaaataagggccgctttttaaaacgctcgtgttgtgaaaaaacctggtggttccacaatatacaaccttggggctctcttttgtccgcgggggggtaatcaggggcctcccatgtggcttttccacggtgtgtccc

SEQ ID NO: 398234 - DNA, 334 bp, Homo sapiens
aatggttaagacgacaaattttgttttgtctattttagcacacacacacaaacacacctttaaataaccaggcaaatgagaagaaaatacttattaggaagccaagaagtgggaaaaaagaaataactagaagaaattcagacaatggagttgtccgtcattgaatttaaaataactatgcttaatatgtttgcagaaattttcttggctcactgcaacctccgcctcctgggttcaagcaactctcatgcctcagcctcctgagtaaatgggactacaggtgcccgccaccgtacccggctaatttttgtatttttagtagagatgaactgaa

SEQ ID NO: 398235 - DNA, 303 bp, Homo sapiens
gtgtttgtgtggggaggtagggctctgtgtgtgtgtctctgtgtgtggaggcggagctgtgtgtgtgtggaggcggggctgcgtgtgtttgcggaggcagggctgtgtgtatgtgtggaggttgggctgtgtgtgcgtgtgtggaggttgggctgtgtgtgtgtgtggaggcggggctgtgtgtgtagaggcagggctgtgtgtgtgtgtggaggtgtggatgctgtgtggaggtgtggatgcggtgtggatgtgtggaggtgtggggttatcccgtccccgtatttcgtagtagtagcgccc

SEQ ID NO: 398236 - DNA, 417 bp, Homo sapiens
ctaggccactgactatgctgtaaaataggaagaatatagcacttatcccatataaaagtgttaaaatgagaatcattccactatctgagcttagttgcagaaactctagtggccactaagccccagtaatggattgctgtcacacagaaatagttatgtgcattctaaaatcagtgggtaggcacatttacagatgtatcaatttcttggcttgggtcactattccagtatgtaataattttttaagatgatgtacagatctatggaggaagaggttgcttcaagcaaactttatagagttgcaacccaagcacatgtattgagctctgcttcccacttcagatccaggataacaaataggtatcagctcatctgattctttggtagtgttttctggagcactttaataaagaggtt

SEQ ID NO: 398237 - DNA, 443 bp, Homo sapiens
tttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtgg

SEQ ID NO: 398238 - DNA, 201 bp, Homo sapiens
agagaaaactgtctggactcttagcagaaaggacggtggttagatagcaacacagacttcccacaagaaagggttattaaggaaaaaaaggctggggccgggctggtggctcacacctgtaatcccagcactttgggaggccgaggcgggcggatcacgaggtcaagagatacagaccatcctggccaacatgttgaaacc

SEQ ID NO: 398239 - DNA, 713 bp, Homo sapiens
attttttgactagccttgattaaaaagggaacaattgtgtacttctggttagcctggggaaagttatagcagcctaaattcaaatctctgcatatatcaaccaacaagtacagcaatacaaccacatacatggcaaaaaacttcaaattacctatgaatggaaaaggaggcaacgaatctatagagttatacctcaagtccctgacctaagcctttgcagagaatgaggggagacccataaaaggataaagaagaaaaggaaagacaggggtcaaaattggaaataaaataacccaagaaagagaaaagtccatcctatgtgtaaaaagagctctgggagattggtaaatgggagtacagagcattaggcagtccctaagagtgagtagggacaaaaacaccgatgttagaaagccatcatttctggaaagaaaggaggataaaaaggggagtgcaagaaggaaaaagtatccagcaggaaaaatgagaacccaaaccaaaagactatccatcactactgccatcaagcacaaaaaaagaagaaagttattcattgaaaaaaatcacactatgctacattttcagaagaggtttgcacctggactagaaaacacaaaataattaatagatgaaaaaatgcctatataaatatccaaagcttctttaagaagataacaaacatgaaagtcaaatatttcagctaatgaaatcca

SEQ ID NO: 398240 - DNA, 292 bp, Homo sapiens
agttggtggtgatgagcttcggaaattgctgaccttgggttctgcctgtccttcggaatgatgtcatccctgtgctggactgctgtccttagggcctgggccgcagagattgagttcttggtctcttgatttgtcagggtgggtgtggtctggggcatctggatggggccctgagattccagaacttcatcgttgagctttacttcagacatgtctgccaactgttaggagacattgttttagttaatgaagtgtatctcaaagatcatgtagtaaaattgacagatgaggc

SEQ ID NO: 398241 - DNA, 477 bp, Homo sapiens
gtggacagctttccatatcaatctagaaacagctactttattcatcttccattataacatatgccagacataccaaaaaggaaggcacacctgatgcttgaaatgatcctattatatggatgcttcaaaatttgtttaacctgtcccctattgctcaacattcagaattttctcaattttccttacaaataaaaacactgcacaacaacaaccactagagctaataaatgaattcagcaaagtagcagggtacaaggttaaccaaaaaaaatccattgtgtttctatacatcaacaatgaataatccgaaaaggaaatttaaaaaacggttctggccaggcgcggtggctcacgcctataatcccagcactttgggaggctgaggtgggcagatcacgaggtcaggagatcgagaccatcctggctaacaaggtgaaaccccgtctctactaaaaatacaaaaaattagccaggcgt

SEQ ID NO: 398242 - DNA, 320 bp, Homo sapiens
gtcttttcaggtgctgaaatgtgtttaattatttctaccttggcatccactcgtgcccgtatggagggtgttcttatggttccaactggttcagtttgcacagatatctctgctaccgtttgaactgctatgctggagactttggaaaggggtttggtcttgtcagcctctgtcatgctgtcaccatatttccctacacgagctttcctccttgatctagtaggcatatcccactcatcctgatcttcatcatcagtttggacgcttgtatccacactctttttagttctccttctcctactcacatagctccgatctgt

SEQ ID NO: 398243 - DNA, 707 bp, Homo sapiens
tataatcccaactacttgggaggctgaggcagagagctgcttgaacctgggaggcgaaggttgcagtgagccaaaatcacgccactgcactccagcctgggtgacagagaaagactccatctcgaaaaaaataaatacatgaaataaaatccaatcaagtaacctgacttaatcgcaatatatttgacttagacattcattgaatctcttctttaattcttctaatagctatgccacaaaaatggggtgctgcctactcaagcatcatcaattttccttgatgaaaacacaaaaaatgtacttggagatattcttttcctttttgaataaaaatttaatcaaaagggatcttacagtcccataagcagcagaaaacaagacactcgtgaactatctcaaacccacagaagggaaataaatcccaacttacactgtttataccacacatttcctccgattctcactgacaagtttatcgacttgtaaaattcaattttacaaattacaattaaaaagacaattcaaattcggcacacaagttggtgagacaactcagataaagatgacacctttcattttcatatcactgaagatgactgtaaatatattcgcacaccaaaaaaaaacctctaagcaaatcagaaatctgcaaccatcactgcaacttctgcctcctgggttcaagtgattcttctgcctcagcctcc

SEQ ID NO: 398244 - DNA, 652 bp, Homo sapiens
ctatatgaaacttaaattatgaaacttctggaagaaaaaaatggatatagtctttgcagtattgggctaggcaaatatttcttagacagcatcaaagccataacatgtaaaataaactaataaatttgacttagtcaaagtttaaaacttctattctttgaaaaacgttaagagaatgaaaagataagctgcagactagtagaaaatatttgcaaattgtaggccgggcgcagtggctcacgcctgtaatcccagcactttgggaggccgaggcaggtggatcacgaggtcaggatcgagaccatcctggctaacactgtgaaaccccgtctttactaaaaatacaaaaaaattagccgggcgtggtggcggacacctgtagtcccagctactcgggaggctgaggcaggagaatggcatgaacccaggaggcggagcttgcagtaagccgagattgcgccactgcactccagcctggatgacagagtgagactctgtctcaaaaaaaaaaaaaaaaaggaaatatttgcaaattgtatatctgacaaataatttgtatccaaaacttaaaaataagaaaataaataacctaatgaaaaatgcaaaaatttgagcagccatttcactaaggaagatacccaggtgctcactg

SEQ ID NO: 398245 - DNA, 468 bp, Homo sapiens
aaggacattggtagagatccagatgtccatcatttggttcagcccaggacttgaagcttctgaaggccctgtgcacgttggctttgccctttctgaggctatgtgcccagtctctaccagtctcacgtgcccagcaagcctcttggagtgtggacagaatctgctgcttgcttttttctgcctttgtgattttttttcctgattataaaagtgtgtgtgtgtgtgtgtgtgtgtgtgtgtgtgtgtgtgtgtgtgtgttttaaagagattcaaacaactcagaagtgtacagtgtgaatgtgaaggcccctagtgattccagtatgcccctccataatccctaagagtttgctatgtccctgtatgtccgaattttttcctattaacatataaacatatagtaacattttcttatgattttgcagcttgccttttcgctggacaaaatttaatggaaggtgtggtgag

SEQ ID NO: 398246 - DNA, 319 bp, Homo sapiens
ctttatcactgcactgagccaaagtggggagcagggggaagtgcccacatgcttattaaaaaccgctctgaaaatatttgaagtaacagggctataacaattattattttaaaagcaactgctgttttggtttgtgtagccccagaggtttagcagatgctgggccctgtcagctcaccaaaacagggaaattagaaaccagtctatctggtagtatctagagaagttgtgataccagataggtggtccaaacccttcactcctcagggatagactaagagatgggagttccttcccgatcatatggcattgtattagg

SEQ ID NO: 398247 - DNA, 500 bp, Homo sapiens
atggtggcgtgcatctgtaatccgagctattcattcgggcggctgacacaaggattgtttgaacctaggaggcggagtttgcagtgagctgaggtcgtgccactgcactccatcctgggtgacagagccagactctgtctcacaaaaacaaaaaggctgggcacggctcacaactgtaatcccagcacttcgggaggccaaggtgggcggatcacctgaggtcaggagtttgagtccaacttggccaacatggtgaaaccccatctctactaaaaatacaaaagttagccaggcatggtggcgggtgcctgtaatcccagctacttgggaggctgaggcaggacaattgcttgaacccaggaagcagaagttgtagtgagccaagaccgcaccattgcgttccagcctgggcaataagagcaaaactccgtttcaaaaaaaaaaattggccaaatatggtggcgtgcatctgtaatcccagctattcattcgggcggctg

SEQ ID NO: 398248 - DNA, 207 bp, Homo sapiens
agggtctccctatgttgcacaggctggtcttaaaatcctggcttcaagtgatcctcacatttcggcctcccagagggctgggattacaggtgtgagccatagcacccagccctatggtctggcagtttcttaaaaagttaagcacacacttaccgtatgcctcagcagtcccacttctaggtacaacagtcctatccccacccatag

SEQ ID NO: 398249 - DNA, 1030 bp, Homo sapiens
agactacaggttgagtatcccttattcaaaatgcttgggaccagaagtgtttcagactctgtatatgtttggatttgagaatacttgcacatatataaaatgagatatgtgggggacgcgacccaagtctttcttttaggagggggggaaaaaaaaagcttttttttttttgggagacagagtcaggctgtggtcaccggggctggagtgcaggggtgcgatctcggctacatgggcacacctctggactccacgggttccagaaattcatcacgagcaaacaagacgcactccacggagaagctgaagatgacagcaacaaacatgacacactaacaacagggcataaataatagcacttgaacaagtcagagacatggggcaatcaacacaatgattgcgcaaaggaacatgcgaacaaacacgcagtccagtgcacaacaccagaaatgaatccaaacacgaaagaaaaatacccaaaagaggagcagagaaaaagacgaaggaacacaagacaaaaaggacaaaaaaacagagatgaaaaaaggaccaaaactaagccacaaaggagaaaaaaaagcagaaacaaataaaaagacaaagaaacaagaacaaaaaacaaacaaaagaaagaccaacagacgactaaaaaacacaaaaacaataaaaaccaaaaagcgacaaaagccgaacgcgagaggatacagagaaagaagaaagaacaagaaacaaagagaggagaaaaatagcaaggaagcaaaagaaagacgagatgcagacaacaagagggtaagcgagcgcaaagacaagaagaaaagcgcagaaaacaagacaaaagaggagcagagcgaaggggaaggaagcaagggaccgcgagcgagcagagacgaacagccgaaaacagcagaagcggacagaaaaggaagaaacagaagccaagagggaaagatagaaaagggaaacaaaagaagcggagaaaacctgaaacagaagacacagaaagggaagcaaacgaagagaaatagaaaaa

SEQ ID NO: 398250 - DNA, 1719 bp, Homo sapiens
cgataaaccagatatttttttaaaacacagcatacagattccaaatgatcaaggatcaaaaagtgttggggatgtcaggaaggatgcaaggatgggcttgaatgatcacaatgagtcaacccagaaatgtgcagtagaatagtttgctaatggtgacatctgagttgcatctcccggaaatattgtttcttattattacactttgggtcgggggaaggggtgttaagggtaaaaagaggaaggagcaaatagataaagagaaaaattcatgcctccaggaaacataagcagaaaaactatagacttgtgtctctgcttatttttttaagtacagtgtttttaatagaccaaagagaatctctatgagttaatatgtatgtgaataatgtttataaaaggggtataatgtgttagtcattatggaatattgtataaataaaccttccatatataaaacatataaaaaatgattgcttagggcagtggacacttaaggacttccaaacctttcatatcttcatcccaaaaaatagagcgttccagggctggcaacttatttccttagtatattccactgtaaagccaagaggtgtgggggcttgttttctggttttgtaatttgtaataatccgtatggattactgtaaaatgtctgttgcatgtgtgttggtgttggtgttggtgttgtttacccacatggagtcatcagagatttgttccacactttgtatcctggaaaaccaaaaggaattttcttttcttcgagacagagtctcgctctgtcgcccaggctggagtgcagtggtgccatcttggctcactgcaacctccgcctcccgaattcaagtgattctcctgcctcagcctcccgagtagctgggactacaggtgcgtgccaccttgccctgctaattttttgtatttttagtagagacggggtctcaccgtgttagccaggattgtctcgatctcctgaccttgtgatctgcccgcctcggcctcccaaagtgctgggattacagacgtgagccaccatgcccggcctggaattttctagtaagaagaaaaacatacagaatatgtcttcactgttgggtaactctcaaatttgtagcaatccagattttttgtaaaactgtgctaatgggatatttaatgtcagagttattgtctctcacttcaatatctagtactggataatgtttctcctgggagcacgtatttttttttcaagtcctcttttcctggacttaacatgttcttctagaagacaccagaagtcatgaccctaagccccctcccttcaggaccactttctaccatcggttttcaaaaaactatccacatgttaattctgttttatgttctgtgattctgtggtagactcagtgctttcagagtccagagcttgacttgggttagtggccttaatgaagtgctaaatttgctctttaccgcgagactgatcagaagaagcaaaaggggaaagggggctagaggtccactcgcaccttttacatcagacaagaggaggactgtgccagaaatctgtgcatgaaacaccatctgctcttcatgcagggaggggtcaaccgtgtgaacgtgcagagattactcgagccttctttgccaaaaatatgcattcttcccagctgtaagcgtgtgaagccaaatatgtcttttagcatgaaacaataaaaacatgtttattttcactta

SEQ ID NO: 398251 - DNA, 482 bp, Homo sapiens
ggcgcatgccaccacgcccagctaatttttgtatttttagtagagacagggtttcaccttgttagccaggctggtcttgaactcctgacctcaggtgatgcacctgcctcagcctcccaaagtgctgggatacaggcatgagccaccgcgcccagccaagaagaaggaattgtctaacaactgtggtgctctccataggagatggatcaatggttcttacaagtttattaaaatgtagattcttgaaccctactcccagcgtacagctcaacatgattcagctgactatgtgagggactgaacttcaaggtacaaaaaatgtagggtatgctttaaaaagtcaggatcagccaggcgcagtggctcaggcctgtaatcccaacactctgggaggctgaggcaggagaggagcacttgagctcaggagtctgagatcagcctgggcaacatagcaagacctcatctctacaaaacaaacaaac

SEQ ID NO: 398252 - DNA, 351 bp, Homo sapiens
acgaggcatggagaggatccatggctcgcccaggggcacccggggaaatgggttgccgagcgcgaaataatccagagcctgcccactcagccacaaggctcagcggctccacaggtccagacacctccttcacatctttgtaggttctgctcattcagaacagccagaactccactcaaacacactttctgtaaataagtgttgatttttttttactaaaccttgcagaatatgggtaattcctgcttcttttatctttctctgtgtattaaatgctgctctcacgagatttaagttttgtttattttttagttaataaaaggaagagggaattactgaaatttaaaaaaa

SEQ ID NO: 398253 - DNA, 320 bp, Homo sapiens
acacgcacgccccacgcaccacacacaagccacccatcccagagcccgccccccagaccaccagcggctcagcggctccacaggtccagacacctccttcacatctttgtaggttctgctcattcagaacagccagaactccactcaaacacactttctgtaaataagtgttgatttttttttactaaaccttgcagaatatgggtaattcctgcttcttttatctttctctgtgtattaaatgctgctctcacgagatttaagttttgtttattttttagttaataaaaggaagagggaattactgaaatttaaaaaaa

SEQ ID NO: 398254 - DNA, 219 bp, Homo sapiens
ctcagatgtcctgccctttccccaacagtctgtcccgtctaatgctatgggcctgtgtctcttttctctatcttacccaggaagaaagagttttttcatttcccttccctcagctactagaggtctttgctgtgctctgggaggttgtttttctttctttttaagttatgctttcttgaaatttataaacccttgcaaactgccttatgccctttttga

SEQ ID NO: 398255 - DNA, 348 bp, Homo sapiens
ctccatgcgttctggaaaaatcaatacttaataaaaattacaggacttacacactggttacacactggttacgtgtaatctattgtaaaattgtctgccctcgtttctgccgccatgcagttttgcttactgtacaaattgatttgacaactcaacttatagatggccgattcctgctgcagatgagcaggccacatattacggttgagctcaaaagatgaacaattacattctgttgtgttcttctcgggttgtttgcttgtacttattggagtattcaagaaatatttgctgagcatttatgtgtatatatgcaaatatttagtatgtgtctgataagatgtgagg

SEQ ID NO: 398256 - DNA, 563 bp, Homo sapiens
cagtgcacaccaaagtttgaaaccactgttggggtgtggagttcttgcttccagacttccagggcctatggattgaacaacagcagccacagtagtaattagaattttcagtctgaaccacaagcctgccatgcaacaagggtttcctcccgttttacagatgagggacctgaggcttcataaggctgttattgacctgaggttgcacagctgatggctcctgggttcttagcgttaagttttgcagccttatttctgttgtatatttgtttctcatatttctgtgtttattgcactgcaattgtgatatcctctaaaagccaaggatgaactcactgctgaccttggttttattcgtttgtttattttcaccttttcttgtgaaatgtgcaaacatactcaaaagtcaagagaatcatatggtgatttctcatagtcccctttggccagcttcagcaaagatgacattttgccactcttattccatccatttctgtcacgccacccctgacatacacacatgttctttctggagtattttcaagcaaatacaggatttttaa

SEQ ID NO: 398257 - DNA, 308 bp, Homo sapiens
tggctgttgtcttctctgatggccaagagaatggcttttgagtcaggggtggtgaaagtgtggtattgagagaattcttcgcgcttagtgttctctagtttgatggtgcccttgaaatgcatgcctgccttataccttcatgcctgggtatatctgtgcataagtccccaaagagaggtcacccatgggaggtagatatagaatacagcatggcaggaggaatggcatggcccttgcaaactgtgtacctgcctgcctttctcaagcacacctgtttttcctctgcacttcccaggtggcatgggcat

SEQ ID NO: 398258 - DNA, 358 bp, Homo sapiens
cccaagctcaagcgattctcctacctcttggaggcaggggagttactgggttagataaactctggtttcaggctatcctcctgcgtctgtctctggaggagctgggactacaggcatgcaccactgcactccagcctgggcaacagagtgagacccagattcattcatgttcgtatctccagctgtggctcattcttttttcactgctgtatagtatttcctgataggaaattgccacaatgtatttattcatttttctcttcattttaggtagctttcagctttttgttgttaacacaaggcatctttggctttcatctgagtacctcagcccctgtccagccccttttccttccta

SEQ ID NO: 398259 - DNA, 809 bp, Homo sapiens
ttttcctccctctgcctctacctctacctctttcaagattttctctttctctttactatggtaaataggcctttagtgagaggagttatgtcagcctggctaggagtcaggctgcatttcaggtttgtgatagctagaggtaccagaggcagtttcatggaattttacctttgcaacactgagagcctaggcagcctcagagtcagaacacccacagttgaatcctcagcctgacagacactgaatccagggcaaatcttagctgaatattcatggtctgtagaggtggacatgagctagatatgagctaaggaccatagccagctcatggcttttgtgatgtccaacaccgctatcctctaagatgtcacaagtgtccctaggcttttattcccatggtctctcctggctctgagttctatcttccattaaggttcttcctgttcctcccctcattcacactgattggcatctcttctgtctgccctcaccaactcacatacagaacccagtctctttcctcttatttccacccaaagccctcccacaagccactgttatatgttcacatccctgtaataccagtgagtaataattgctaatgagacatttttccttttatggaacaaaggctgtcccatttctcctcaggcaccagcctcccacatgttgtcatgcctctttcccccactttccctaaaccttctttctctcttgcactccttattccctggttcctattgatttctcatttagcacaaggaactaggtctttcttttgtggcccttttcccaatccaagcctgctg

SEQ ID NO: 398260 - DNA, 457 bp, Homo sapiens
ctgcatcctgttcttgtcttcataggaaataattactcttctctcttttgtgttactcagtcacattattctaaagaggtactgggtcagttcccagtagctcaaagatggtgtgaaaacagatctttctgttagtttttcaggcttattcacatgtccatggctgttgggacttgtagagaagaaggttttcctgggagcaaactcagcagtagaatagtgtgctcaaaaccacctccccagccctccaataactgagtcattgagacaaaactcatggtgctgaccttctccttctttaggatatgatttaaaggccccttcccagcccttcctacagactgactgatggagccttcagcctgccagtcaccccaaaccagccgtacctgattatctcctgggaatcctaccacagctcaatcagaactgctccccaccctcaccccacctgcct

SEQ ID NO: 398261 - DNA, 313 bp, Homo sapiens
agaaaattgacttggaaacaaatatggaaaggattattatgccacccaataagaagaaatctaaatgcagcaaaaatggcttatattataaacacataaaaaaagtatctggatgtaaaagcctggtaagctttattgtgctatttaaaggaattctgaaagcttattttaataaagtcttaaatccatcacaaatgcatatgaccagtataaggtttccttcttaaattgttctataaaatacacatttgatgtaaaagctttaaatagctgcctgacactggaagcaaatatactaaattacagtggcaat

SEQ ID NO: 398262 - DNA, 441 bp, Homo sapiens
atttgagtggtcagttgagtcccttctaaagtttttttggtagatcactgttatttactgggttcttcctttgtatgctaagtgtgttggatgctaataaaaaataataactccagtttaaagcaaaaactctcaaattaccaccctcccccaccatggtgtgtgtggaaagtgccttgggaacagtatgctcaggaaacaccactgattggagccctgagaaggtgtgggtcatctctggcttgggggtgtggggagtggagatgggtaagcttttgacagacatggagattagcatgcatttcaggtttatttttgtagtctctccctttgcagtggaaattgccattcctcctactccggatggaagctgatgtggtcttgctggctgcccatgtagtcactacaaatttatcaaggtatcgggtccatggcttaatt

SEQ ID NO: 398263 - DNA, 312 bp, Homo sapiens
agcaccgtgaggaaggtgaatcatgccttcatgttactatgacagcagtttcaatataacagaccccttgaaaggtctagggacccccaggagttggctggctaccgtctgagaacttctgcccaggagggatgatctcctgccacaggcctgtggcattcccatgggaagaggcatctgcagatgacctcacagcagacgaagtacaaaccaagcagagaaggagtgcgccgggaataaatgttagcgattgctctcgttaggaggatttgtacccagagacctgagacactagaacagcgatttgaaagg

SEQ ID NO: 398264 - DNA, 354 bp, Homo sapiens
cagtgtttccacctccctgataacccctcttatctgacagctcattttgcagagagcttctcacgtgccaggcactgtgatagtctggagatgcaattgtgagcccatgtcctgcctgcatggatcaacccatccattgagcgacagacattaaatgatcaaatccagtacagagtgaaaaggggtgtgcttgggaaggaacagtgtgttatgggagcacacggcgaggacatccaattcattgaggagtctcaggggaaggcttcctgggggaggtggtgtctaagctgagacctgagcaatggaaacaggaggaggggtctatttcaggcagaaggatcaacacatataaag

SEQ ID NO: 398265 - DNA, 419 bp, Homo sapiens
ttacatcacagtagtctggtttttcctgtaatatcttggggtcatacatgagatttcatttgaaaaaaaagaaaaggatcccatggctgtgaaaaatgtgtgtgaagaccacgtcacggaacattcccgcgtagcctgtgcaagccattgaaagtgattcaaggctctcgactttacagaaacaattttgcattaagaaatgcacagagcaaactccagggaggtcccgcaggccccggctggctgccaggggctctccctcatttgccgtccccttggctgtggagcagaatctccatcgagcagttgctccgctggacaagctcgttctggatggggacatgaatctacgctactaccaggacttccgtggccttcagttagagccaaaaatgtttaaaataactttttctgattga

SEQ ID NO: 398266 - DNA, 584 bp, Homo sapiens
cgtggtggcgggcgcctgtggtcccagctactcgggaggctgagacaggagagtggtgtgaacccaggaggcggagcttgcagtgagccaagattgcgccactgcactccagcctgggtgacagagcaagactctgtctcaaaaaaaaacactgtgtaataaggggtcccatgtgttggctgaattcccggcaagcccaagaagggagccccgtctcacagtgcccagcacagaggcgtgttaaaccatccatgctaagaaatcccccagcagtctgtgagcactgaaagtttccctatcacagagccaaccggccttccagctaagccactgctccactccgctctaagactgtgtcttaagtcttaactcttctgaataagattacttggtgacataatggattaggagcttccatcattggttcaaactaaataacagtttcaatggggacagactacagcatttcagggtaaatctgcctggtctattcaattactataataatgttattctcactcattagaaagacaaatgcatgaagctgttttccagcactgagacagggcacctggcccatcctc

SEQ ID NO: 398267 - DNA, 467 bp, Homo sapiens
ctagaaattgcatcaggcatttgatatagtggtgatgtttaagtcttctctgctaaaaagatttgttctgtattgggcatagcactctgttgatatgtagatattgtaattaagattgccctgtcttgtgatatggtcatctcccaaaatatccctgatttactaagaattacctaatatgataaatagattgctgttgggctatataattctctctggtgccagatctaatagtgccaggtatagaaattttgaagtctggccatgataaagaaatgagaacaggaaggggaacatcacacaccggggcctgttgtggggtgggggaaggggggagggatagcattaggagatacacctaacgttaaatgaagagttaatgggtgcatcacaccagcatggcacatgtatacatatgtaacaaacctgcacattgtgcacatgtaccctaaaacttaaagtataat

SEQ ID NO: 398268 - DNA, 461 bp, Homo sapiens
gagaggcaggaattttataattgagattattacagaagagtgtcctgacataactgattgactttagtgatgtgccttgaaagttcaaattcaaggtgtgcacttatttcagtcagcttgtcctgaatgtttaaataagaaatactatttctgggtattctgaataactcgttgtacatttattcctaatagtgagcatttggactaatgatggattactaatgagcatgtaaatgtaccacctgattacattaatatatgatcttccatgacgaggtctgaaatgaacatttctaatatgtatttcttttccccaaatggcactgtggtgtatactgagtgggactgagacaagggtgttcttaagagccactgatttagtcaattatcaaaaatcacattataataaatgctgttctaagaattttgattaacctttaaataaatgttactttggagaa

SEQ ID NO: 398269 - DNA, 483 bp, Homo sapiens
aaccccagttggtcatttagatcgtctctgccaacccagcctggctggacgtttacataccaaacagattcccatgtttggacatttaggatctgaccgggccactgtagttggtccctgggttgtcccaaacaatctcatgtggggatttaggatattgcaagactctccctatggctggacagtttttagttccaatcaagtcccatatggttgaacatttaggttatgccatccatgcccctgagtctggactcttagcttgtccccaccagtctcttataggtagacattcaggttgtaccaggcggtgtactggtggctaggcatttagattccattcaaatatcttatgattgggggggtgggttaacaaatctcccccgagttgaacattcagattgcagtgttttgccattataatggggctggaaaggaattacaagtaaaaataaataaaacaacaggaacaagcaatttctg

SEQ ID NO: 398270 - DNA, 482 bp, Homo sapiens
agccaaagaaaataattcaggtatcaagttggactagctcagatgactacaaaatggtgagtacattcagatatgggagattatgataaataaagggattagtatctgcccaaaagagaatgtgagctgactagtgtctttataagaagagatgaggacacatacgtgcacagagagaagaccacgtaaagacacagagagaaggcagtcatctacataccgagaagatgggtatcagaagaaaccaactctgccacaccttgaccttggacatcaaacctcgggaactgtgcagaagccagtttctgttgtttaagccaccaagtgtgtggtgcttcttatggcagccccagcaaactaatatactgtttccattcatctttaggctatattacagtacagatcgcttactgtattttaaagtcacttaaaataattcatctctgtaaaattaaatcactaattcaatacacagttaaaat

SEQ ID NO: 398271 - DNA, 450 bp, Homo sapiens
ccaagagacgtgaggaggcagaggctgtggttattttaccaaaaaagtctagttacatgtcacattcaccatttagagaactaaaccagtacacacacaatttccacatcaagacctgggctcccctgaatcatctctttctagacaccatctagcgcccagttctagttatgggaaggaggaagtggtgggggctggggagtcagataataaccttctgccacccttgcctctctgaaggccactcctttaccctggaatattggagaagtttagagagcaggaccagggcaagagccagtgatatcccctagcaccagtgctccagcattcaaaatcaaaccagccgtactacatcaccacaccaacctcagcaacaaccaaaacaaatgacagacaatgcaaaacaatcctcagcctgccactctaaaggtgaaatgagacatgtaa

SEQ ID NO: 398272 - DNA, 582 bp, Homo sapiens
tagctgagctaggtttaatgcctcggattcttagttaaatctcaaaatctgacttgttaagtcaactaagaaaagaaagacctagcagtggcaggagaggcaagttcagacctcagagctgaaatgggccactgacccagaacaggctgggttccagcctagctcaggttccctggcccttctcagtgccactcaagtacagagcccagagcaaacaggggaggaaccagacaccccactgcttttccttggaaggctctgatttaattccatctctgggtggaggagcagctccgaaacaacatgcttcatttcgtctcccttggccagaaagaagaggtcataaaaaaacaagagaggctgtgtgtggtggctcatgcctgtaatcccagcactttgggaggctgaggcaggcggatcacctgaggtcaagagttcaagaccagcctggccaacatggtgaaatgctgtctccataaaaatacaaaattagccaggcatgctggcgggtgcctataatcccagctactcgggagtctgagggggaagaatcgcttgaacctgggaagcagagtttgcagt

SEQ ID NO: 398273 - DNA, 259 bp, Homo sapiens
aaagtccacataattaccttatgctgtacatttaatgtccactatatttatagatatagtgaccagattttaaagaaatcaagtaagcttccctattattgatacataatttgaaaatacatcaacaaaatctccatctacagaagagtgaatgtgaacttcagaattcctagcttcatagtctaaatagaaatcctctaagatcataaaatgtccctaagaactccatgccttacattaatttttttggtattttttc

SEQ ID NO: 398274 - DNA, 198 bp, Homo sapiens
aaacagaccaacactttcaagagtgaggggactctgacatccactcctctaactatggtcaaataaaaagtaacatctgggactacatggtgggaccagcatggggatttcaaacagacgataaaaccatgaagaaaactgggctctctagtgctcctcttctcacctacttcttttaaaagtagtgtttgggggtaa

SEQ ID NO: 398275 - DNA, 440 bp, Homo sapiens
atctcactgaaaatagataaataaataaataaaggaaagaaatagaaacactaattctaagatagaaatattaagcattgtaaaggcagtagttggttctaaatctataaatttagagtggcggttgaatcctagcaggattctcttttggagtgttatagtattgattataattcatgtgtaataaaattttgaggagaataagtaaagaggtggataggagatttgtcctatcagactttcaaggaatattaaaagcacaatatggtattgacaccagagtagattgatggaatcacgatagattcccaaagtatacctcaggtaattggggatttagcatataccttagtgtatgatgcatctcagtagtaaatggtgttgggagtagttgactggccaccaggcacagattttgtaaatgcagttatcagttgctg

SEQ ID NO: 398276 - DNA, 381 bp, Homo sapiens
cagcatgttctcactcataagtgggagttgaacaatgagaacatatggacacagggagggaaacagcacacatgggggacctatcagggaatggggggctaggggagggatagctttaggagaaatacctaatgtagatgatgggttgatgggtacagccaaccaccatggcacatgtatacctaggtaacaaacctgcacattctgcacatgtaccccagaacttcaataataataataaaaagtaaaattaaattttatttttcattattatttttgtttaaattttagacatttaaatcttaaaaaatgttttatatcttgtggggaaggttttggaaagactccacttagtgctaataaaaatgtaaagtcacctac

SEQ ID NO: 398277 - DNA, 556 bp, Homo sapiens
ccactcacgttacctcaataaaatgtcagctctgcctcagcaggaaccatatctgttctgttcatgcaatatccccactgcctagcatagcaccaactggtgtgggggcccttgtcttccttggagtcatgatcagagattctgtagttatcagaacactgaaggaatcaaagtctattaaaacataaaaaaaagtttacgagtgcaggaagtctgtatacagatgagtccctgtcctcacgtggcacacaattctaagatggctgagcaaaaatatgcaattaacaaaagcactttgtaatttcaagtagtgaaagttaccaggatgtgagttttaaacagtctactgtactgtgttcagtaaaatacccgttcaatgggtgatatataggtgttaaaaaaaaaaaaagaaagggttctgtagctagtatattgggaaagtgctggttaacccaagttaaatcgatttctttatggttaaacttctctgagcctttaatatgatgtggatatgtgggactctatttggaacatgcatatttggagatacattgcc

SEQ ID NO: 398278 - DNA, 371 bp, Homo sapiens
tatatttctatattattctaaaaatatttattatatttatataaaaattgttacaaccgtgtacaagtgtgcataaataaatagtgtatttatgtagtctttatttgaatgtcaggccagttagagaagctagacatgtataaccagtttagtcttaacaatcaagttcagaaaataatatgtagacttccacctagttccttttctgaataatattatagacttaaggaagctaataagagtccaagattctctgagtgcctttgtgaattatttcgtctgattcatgtatgtaccttcatataatggcttttaatattgaggaatatttggagattaaaagattagagtaattctgagctcattaaatt

SEQ ID NO: 398279 - DNA, 512 bp, Homo sapiens
agtacaaaaatgaaaagataacagactaggagaaaatatctgcaaatcatttacctgataaaggagttgtacacaaactgtataacaaattcacaagtataagacaaacaacccaattaaaaaaagatctgaacagacacttcaccaagatatacaaatgtttaatatgaatatgaaaataggcacatcactagtcattagagaaatgcaaattaaaaccacaataaggtatcactatacaactaactagaatggctataattaaaaaaactgacaataccaagtgttgaccaggatgtggaaaaactagaagcctctacattactggtgggaaagtaaaatgattcagccattttggaaaacaacttggcagtccttaaaaatttacacaggccgggtgcggtggctcacgcctataatctcagcactttgggtggccaaggtgggtggaccacttgaagtcaggagttcaagaccagcctggccaacatgatgaaaccctgtctctacta

SEQ ID NO: 398280 - DNA, 252 bp, Homo sapiens
gtaaaggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaaggcatacgcccaggaagcaggtaaggaaaatgattatgagggcgtgatcatgaaagatgataagctcttctatgataggggaagtagcg

SEQ ID NO: 398281 - DNA, 181 bp, Homo sapiens
gtaaaggagggatcgttgacctcgtctgttatgtaaaggatgcgtagggatgggagggcgatggagccctcccttaccatcaaatcaattggccaccaatggtactgaacctacgagtacaccgactacggcggactaatcttcaactcctacatacttcccccattattcctagaaccag

SEQ ID NO: 398282 - DNA, 603 bp, Homo sapiens
  misc_feature (227)..(227): n is a, c, g, or t
  misc_feature (239)..(239): n is a, c, g, or t
  misc_feature (250)..(250): n is a, c, g, or t
  misc_feature (416)..(416): n is a, c, g, or t
  misc_feature (419)..(419): n is a, c, g, or t
  misc_feature (421)..(421): n is a, c, g, or t
ccctggcacagtttttgaagcattttctagccagagatgccattgaaagcaagggaaaattgacttgtgctaccccacatcaattaagcgtactctgtttgaaacggggaacccttccacctgggattgagtttgttttataatttacccaaaattaagacaacttttaaagtaagtgtacccttataaatgttaccaacgagaccagaatactttaacttaaaacntgtggtatcgcncgttacctgcntgggtaaccaactcccctagaactcagtggtgaacaatcacatcattaggatgatggcgggcaggatagttcagacggtttctatttcctgagcgtctgagatgttagtgttaatcattttccttatctgcttcctatcctgtatgcccttttcctaacactcacnacnanactaactaatactaacattagttcagacggtttctatttcctgagcgtctgagatgttagtattagttagttttgttgtgagtgttaggaaaaggcatacgcccaggaagcaggtaaggaaaatgattatgagggcgtgatcatgaaagatgataagctcttctatgataggggaagtagcg

SEQ ID NO: 398283 - DNA, 266 bp, Homo sapiens
cgttgaatggccgaggcgttgaatggcccggaggcgttgaatggcccggaggcgttgaatggccggaggcgttgaataggactaggatgatggcgggcaggatagttcagacggtttctatttcctgagcgtctgagatgttagtattagttagttttgttgtgagtgttaggaaaaggcatacgcccaggaagcaggtaaggaaaatgattatgagggcgtgatcatgaaagatgataagctcttctatgataggggaagtagcg

SEQ ID NO: 398284 - DNA, 506 bp, Homo sapiens
tatcagggatataagatgtagcatttcaatgtgtaagatatatgtactaaacatatgtttgctatcttcatcattaacatccttcttttctattgcttggctgtaatttatgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgatatgccattcttgctcagcaagaatggcatatcagtagttcagacggtttctatttcctgagcgtctgagatgttagtattagttagttttgttgtgagtgttaggaaaaggcatacgcccaggaagcaggtaaggaaaatgattatgagggcgtgatcatgaaagatgataagctcttctatgataggggaagtagcg

SEQ ID NO: 398285 - DNA, 299 bp, Homo sapiens
cgttgaatggccgaggcgttgaatggcccggaggcgttgaatggcccggaggcgttgaatggccggaggcgttgaataggactaggatgatggcgggcaggatagttcagacggtttctatttcctgagcgtctgagatgttagtattagttagttttgttgtgagtgtcattactatttgtgcggggacctgggtctccgggcttggagattggagagagtatgaaatcagtcgacagagccagagacgccaagtccctggacctctgggaaccagatgtgtcatctgttcttttaac

SEQ ID NO: 398286 - DNA, 207 bp, Homo sapiens
gtatatgtccctgaatgttgctaatggtcttagggcaaactgctacttattctgcattatgtatttcttagttaattggggttaggatgtcatttttaatgcaatgatgttaatggtgtttgtaaaatgaacgatgtgcaaccccatgaaaaactctgtgctttttgaaggagtaaaggaagcaaggaggagtgataaaaattttga

SEQ ID NO: 398287 - DNA, 728 bp, Homo sapiens
atttgatagctttatatcgtgttttgttcaaagttctcctcttctgtcaagtcggactaagcttgtgtctctagcaatttggaattgacatgagaggacctggattgtttccatctatatctgtcccctgcctgctttcctgactgaacaagtccctgatgtggggctgggagcgcaaaagtgggaaaggacaggggtgtccttgccagggagcccttggtgagtttgcagtcctctcctcggtcagccatggcggatgtcctattggtgatcggtgggatagatacgggcatgcagtggccccaacagccccacaggtaaggggctgtgccccctatagctcactggggtctgctcagcccctgacatgatatggcctcatctcacagttgatcctcagcgtgtggcttcatgccgcattcttctggatcccctccagagccatttgcttaaagtctcaattcattggtgagaaatatgcatgtcatggtttgtttttatttctcctaataactgctattaattgtgctcagttgaatcaccctttcactctggtagcaggcttccttactagcatgtcgacccatttccatcgctttccagttaattttggtcatttaaacagtcacttaccattttttaaacacttcgttctttgcattttgaaatttgactctcatgtcagaatcaaagctctctcttctctgcccactctttccctgaaaagg

SEQ ID NO: 398288 - DNA, 375 bp, Homo sapiens
aagccaaaaccaaatatgctcatttttattgaaacaatataaattcccaaaactaaatgcaaatgtggatatttaagaaattagcagtttccagtagctgcagatttctcagcccttctgtgttttcatttattaaaacacaactgaaggtttctcctgacatggattcacagcagcttggatcagaaacgcatcatactgtagtgtgttgttagaaggacttacttctgaggattccacaactcctcagatgtagtcaaggaagatccttcacctcaacatatataaatattcaaaactgagttgctgcaatcactcacaatagtgagcagcatgtcctagcccagtaccgagcacttagtgggagtagctgga

SEQ ID NO: 398289 - DNA, 360 bp, Homo sapiens
gaggccgcgcttcagcgccccgaccggtttcctccctcgaaagttcaaactccagaacccttccagcctccacttctctctgttgggctctcatcgttttaggtggtagaaggcatatgaccataagagttctaactgtaactgactgaagatcaattgaggtggcttaccaccgtccgaccagccccagtacatggcttcacatttttttttttttttttgagacggagtctcgatctgtcgccaaagctggagtgcagcggcgcgatctcggctcgctgcaagctccgcctcccgggttcacgccattctcctgcctcagcctccccagtagctaggactataggcgcccgccaccac

SEQ ID NO: 398290 - DNA, 2310 bp, Homo sapiens
ggaactgccgcggccgccaccgccgctgccggcgccgctgctgtaggggaccagcgcgggtgcgcagacgaaaggcgctctttgccagctgaaagttcccacggaaaaactaccatctcccctgcccaccatggcagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggttcaccttgttggaattgatattttcacgggcaaaaaatatgaagatatttgtccttctactcacaacatggatgttccaaatattaagagaaatgattatcaactgatatgcattcaagatggttacctttccctgctgacagaaactggtgaagttcgtgaggatcttaaactgccagaaggtgaactaggcaaagaaatagagggaaaatacaatgcaggtgaagatgtacaggtgtctgtcatgtgtgcaatgagtgaagaatatgctgtagccataaaaccctgcaaataaacggaaacatcaggcatgaacactgtttatgtctgaatcaactgcagatctaatttggttctaagttgtcaccaaagctatagccttcataagcaacctcatttctttttttaattgttttcagattgtgctgggttagttttgcaagcaattgataatttttaaaaaattatcaatatgtataattttttttgaattttgtagatatgtttcctataatattcctgtggttttcagtatgtcagtccaagaaacaaacaagatagcttcagcagatgtgatttgtctgagcaaatcattcctgtgttttagttagatgataaaccagggttttaaatcaaacaatgtagcataaagtggtattgaagtaccatatttaagttgaactgctctgcattaattacagatttaatataaaatgaactgattatatattggaattgttgcactttcagcctgtgtagggcaaacacaaatccttaaacaaaaatcatgttatcaaaaactgtcagttattttggtggccacatgcaaccatgtgattactttggtcatactatttaccaaattgttggcaaacttgatgtaaccttatatggtggttttagtcccttcttatggttggcagaagggcactgaactgttgggtgaaagttagttagcaagtaagattataaggaagacacaaaagacagtggcaaagagggttgattaaatctataagtttttatgtgaggactttgtaagtcagcataaaaatgaaaagttgtttctcagttgtttttgcttttaactttgcccccaacgtttaaagggagtgatctgctttacatgatactatgcaatgcttgttttccaactatgttgaataaatagtaatatttatcagtaaatactcctttccaacttccttttttttttttttttttgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatccc

SEQ ID NO: 398291 - DNA, 444 bp, Homo sapiens
tcttattatgcccaaggctgctgagcgagacctctccaatttagctgtttgaaattatgtctttcagcaatgtgtaatctccagaacctccttttgactacaggccccaacagttgttcttagaagagactggccctgcacacgtggagttcggcattcagttaaagattcagaatgatccccataaaggtttctgaagcttctctaagcagctcccttccttccagcagaagccttacaaatccaactgcttcagcagccatgcactccaatcactgtttcctttatcctactaaacctctagtctctatttgggcattatttccctcagctacagtttggatagccagggtgagcttacctattggatttcccttctcctaaggatcatagccctatggttggctatctaatgccaaataaaacccagttgcttcatgtctt

SEQ ID NO: 398292 - DNA, 472 bp, Homo sapiens
cactgaaggcagtgctgacctgagggtctccctaggaggacaggcgtgagcagagaatctgtctgaagacaaggcaaaactgaaggtgcagatgaggacttagtttgttagataagaacagtggattcacgagatctgaactcactggcccttggtgcccttgagacagggacattcagacctgtgttagttcatcctcttcccaaggagctcttcacaacagaaggtgacaaggacagacggacacacagaattgttgttaggagcaaagtagtttccacaaggatcaaaatcttcatctcatcagataatcaaagcacacgtaagaaggctttctcaatcctggaacacaaggagctttcacaaaagaaaaccagagggtcacggggagagtgctggttccagtcgcaggtctcaggccatcctggggaggccgtctcagccgaatcccatgggaacatttaggaccatt

SEQ ID NO: 398293 - DNA, 682 bp, Homo sapiens
gtaagtggctgggttaggatgacattcaaactcaagcctgccaccctaaagctttgtgaccgtaagttccacaccacagctctactgctttcatgtcacacagtccccactacactgcatgtcatctttggtttatccatctccccacactggactgtgaattccctgaagatgtccttgtttttgtggccccaggatctggcatggtgccacctggcacagagtaggagctaataaaggctgatgaacaagtgattatatgaacaagtcaattacactggctacaagaagacaggtgcctcttttggcccccccgcccccaatgcccacataagctttgtggctgtgtactacacacagctctaatcccactacatgggctgagtagcaagaagcatttatttcataagggcttgaagggccgaagcatgccagcaccatcccccaaacctggacatagcaatgttctgtcttccccatccacaaaacctccaacactagagaggtttactctccattgctcctggagactagaggctgagctgtatgtactcagataagcattggctgggttggtccctggtgacaccaagaaggcacaggtcctgtgtggaggagagttgatgccagggtttctccagagttcctcagctctctggggcttcatttaaaacattctctc

SEQ ID NO: 398294 - DNA, 648 bp, Homo sapiens
gcttatcctttttactgtttgatgaacgtttaggttgtttctagtttgcagctattataaattctgcttctattaacttgattatactagtttggcattagtgatcactgcatagagggggccagctcaaatgtctttctttttcccttgaatctttctttctttcttccctccccttcccccagtctcttctcttttcctgtctttgtggcacctctgtcttctgatgaacatgccacaggtcaaggagagtggaaacaaaagacaaaatcctttctttcactcagtttttccctgttgtccccttctaacgaagtgttgacatagtcttccaaaccatgcctatatttacatttgatctgtattcaaattctattgtttctctattcttgatatctcatggacagattcctttctttcatacagttggcagtgctccgatcttctagagactccgtgtctaaggggaccaaattatttgtagaagcaatcaccgtatgttaaatctagttataccaattcatcataacaattatcagctaaatactccgactgcttctaacagcagtaagcagcaataacaatgaaaacagtgtttgttttttggtctgtgtaaatctgtagtgtatacccagtagagtaaaaaat

SEQ ID NO: 398295 - DNA, 519 bp, Homo sapiens
cactcatatgcatcgtctcattaccccttagccactctctgcagagggggcgggggccacgagggctgcacagaggtgagactttgaggctagagagtcagtccaggcagagggtcagcaagtccaaagccagtgaggcatggaagcacgcaggttgcaggcagactgacttccagcatatggtgtgctgggtggagactagggagctgcagcgggcgggactggcatttggtgtggctggtaagtccctcttaggccacaagctgcacatctgcatccatgccccctcccagctcagtgccctgcagcaggcatgcacatgggtagtgtctgatggcaacaaccaattcacaaccaggcagccaggacatttatttttatttatgtatttttttgggacggagtttcactcttgttgtgcaggctggagtgcaatgatgtgctcttggctcactgcaacgtccgcctcccgggttcaagcaattctcctgcctcagcctcctgagtaactgggattac

SEQ ID NO: 398296 - DNA, 557 bp, Homo sapiens
ttaggaatgtgtttcaaaaactagagtcgtaatagcatttctagaacttacacttttttagagaaagaaagagaaaggtacaaaaataactgattgttataatatacagagccgctttgcattgggcaccctgctggggccatcacagttaatcctctaaggtcggagtgccctattagaagaccctgggtttccaccgcattcccttgtctccagtctgtacataccctgtgtgccttgcttgccctcttaacgtctctacctggatttttaacgcatctgaaacactcttcagtctgctgctccccaaggctaagctggaggggtggagaatgaggtatagatagataaaatgatcagatgtctggggtttacttcagaggactctattggcagaggaaatagtatggggagtataaatgaaacaagtttggccataaatcgataagtgtagaagctggatgtgggtacacaagggttcataatgctattctttctactttttattatgtttgaaaaattctataataaaaattttaaatacctgtctagcattt

SEQ ID NO: 398297 - DNA, 685 bp, Homo sapiens
tcgctatgtatatcgatgcaccccaaattattcatttcgtttcaatgttcccagccaacatatatatatttttaaaaatgctggatcttgatatcgctttttccaaaagccacaattctcaaatcctcaccctcagcagcagaggctgtctcagcacaaggattagtagaggggaaagtgactgaaagcacatactgacttccaaggatggaaaagggccaagcatgccgagtttcttctcacatttaacaaccatgcctccattccctggtgctgagtacatggagagataggagaccttacgagttcttgtagttgagcttccgtaaaatgggagttaacaccaatgaagaagtggttccctggcccttacaaacaagagcagtgtctatttatctggcccttatctctttcctaaactggtctagaaccctttttagaaatcactcagtgacttcccattgcttttaaaggtcaaaatgctttaactaggccgcaggccctgcataaactttccccaatctggctcaacttcattccttcctcatcttccctgtcgctaccacacaccagccaaatggactttctttcatatccttgagctaagcaagcttatttctgcttatttcaggacttttgaatgtgcctagaacaatccctgtgtcccacttcccttcacccattg

SEQ ID NO: 398298 - DNA, 447 bp, Homo sapiens
ttatatacattaaatgaataaatgtataagtcgtgccacgtgcactctagcctgggcaacaacacaaggctatgtctcaaaaacaaaacaaaacaaaaacccggttcttcattcaacatatgcttaatgcctccaaatactgacctactattgtttctgttatagatttgctactatatagtattcaaaaaaaccaaaaatctataaaaggtatacttttcacattttaacctttctgaaattgggctgcttctcatgaatgacagtgtcttattatcactgtcaggcgacagtcatgattttagctgatactttctaagaaggccaaggaaacagtggttctccacaaaggctgcacaattcggatcagtaggggagcttttggaacacaaggcccatgctggactcaatctctgaggctgagatctgaatttattactttttatt

SEQ ID NO: 398299 - DNA, 436 bp, Homo sapiens
cgaaaaggccccaaacccgtgagccttaattgctctcattttccccattttacagatgaggaaactgagtcacagagagggataagtttcaccaattcatacaggtataaagtggtggaggcaggattcaattccattctgactccgaagccagactttttttcccctacacaatttatcagaatttgaaaaggttgctggatacgacagtcaaataaatcaatttcatttctatatatcagcaaacaaattactattttaaaagataatcacttataatagtatcaaaaacaaagccaccagaaataaaatatgtaacgagaggactagttaagatgttaaagatctgagccaggccaaagccagacttctagtcactgtgcacttgtcggctgtggagacaacagctcctccgtccttatgatacagcgagatc

SEQ ID NO: 398300 - DNA, 389 bp, Homo sapiens
cttcccgtgctgtggtttcctaacgtaaaacgggccaatagtagcacttacctcaccatgttttggtgcggatggaatgaatgaccacatgggaaatacttagaggccgggtgcggtggcttacgcctgtaatcccaacactttgggaggctaaggcaggcggatcacttgaggtcaggagttcgagattagcctgaccaacatggcaaaaccccatttctactaaaaatacaaaatttagctgggtgtagtggtgagcgcctgtaatccctgctacatgggagtctgaggcagggagaattgcttgaacctggaaggcaaatgttgcaatgagctgagattgtgccactgcactccagcctgggtgacagcaaaattgcgtctcaaaa

SEQ ID NO: 398301 - DNA, 330 bp, Homo sapiens
tcggtccacatgattgtctcacgctccttaggcaacctggtggtcccccgctcccgggaggtcaccatattgatgccgaacttagtgcggacacccgatcggcatagcgcactacagcccagaactcctgggctcaagcgatcctgggaggttgaggctgcagtgagctaagatcacaccattgcactccagcctgggcaacagagtgagaccctgtatcaaaaaagaaaaaaattattcacctaacaccttacagagaccaagaagctaagataacaagtcagacgggtcaagtaaggacatggccatactaaaatattagcatggctg

SEQ ID NO: 398302 - DNA, 600 bp, Homo sapiens
tttcatgttgggcccatagggcggtcttggaattcaccctttcagaggccatacatatatgtgtattggtgcatggcagaggctggtgtacacacattagtgtatggctgagccataaccggagcatacctgagactaaccctatggtctaagaagaacttacgtttggagtcctgggctaaggaatccaggagtagccaacccagagattcactccttatctatgaaggacatccacatccctggcccgtatcttacgctgtacagatcaaggccctttggggttaaatggaggttgctagaaggagagtgctaagtgaaaatgctatatagactacgtgctttttacaaatggtagcagttctccaggtcagccctccaccaccggaccacccttgtatgtaaatcctgaataaaccttgtctccttcactgactctgcctctcttcttacagtgccatcccaactggagtcagtggggtccagaaggacaattggccatttagataacatttgaaaattaaccaaggtaattcacagtaacattaaaaaatacaaatgaacatttcaataaaggcagaaaaagcagttgatattcaa

SEQ ID NO: 398303 - DNA, 310 bp, Homo sapiens
ctctcttttcttctttcataaagttacaaaagaagtagcttattatataagtaggcatagtcaagcagtgcagttttgatcacttggggatacattgttcatgccagttagcatttgcagagccctactgtatgcacagcattataggtaggctccatggtgggcaccacacagcaggcatgaatggcatacaaaagcaaaaagtacatgaaatgatattttaaaaaatacagagcagagagcacaatatttaaaagtacacaggccaagcgtggtggctcacaccttgtaatcccagcactttgggagg

SEQ ID NO: 398304 - DNA, 501 bp, Homo sapiens
gatgcttatcaatttgcaaatgggcagaaaccaaggataagtagtttgctctcacatgtggtggtgagtgatgagaggagagaactcatcctttcaaattttctgctgaactcaggtcaacagctctctccggcacctaagcagatcagcaacactgcaggggtggccctgaggtgagcatggttcagtggactggaagggtcaaaataacttgacccagccaaactgcaatcgggcttcaaacacaaccatccagtcaaccccatctttccttcccagaccctgttttggttttcagagacatcagtgctgggcagaaccataaataaatctgtcacaggagcatgtgtgtaccccaggcttcacggtgcaagaaagaacggaatgagatgaaaatgtatagaagtgatgcagggaggcttctgtggaaagaacctgattttggaaagttattaatatttgctgggctctaatgtgatatctcatggctcagccacagat

SEQ ID NO: 398305 - DNA, 262 bp, Homo sapiens
ctgaggtcaggagttctcaaccagcctggccaacatggtgaaacctaatagtataaatgaaagcataccaagtgctgtccattccataggtacaactatggaaaagtacttttgtattctaagaacgagacgatcacacaaaaaaatgaaaacagttattttagagtggtgagattatgggcttctgtttttctccaaaaatgtattttatattgtcatgtcctttattctacaataaaaaatattaagataaaagtatcaa

SEQ ID NO: 398306 - DNA, 582 bp, Homo sapiens
atacaatgttacattcatttgtgaataatatatatgatatttaaaatagggtacaatataataataatttttgtatctttagtagagacgggtttcaccatgttggtcaggctggtctcgaacttctgacctcatgatccgcccacctcagcctcccaaagtgctggaattataggtgtgagccactgtgcctggactattacattttctagaattttatatgaatacaattgtacaatatttactttttttccccagtgaaaatagcttttattcaaatgtccttacttttatctggattattttacttggactaattaatatgagatccagccacattgctgcatgtagtttaaatgggtgaattctatgctgtttgaatcctctctcaataaagttgttaccaaaaactcaatgagataccactgcattcccagtaggatgactaaaatgaaataaataaacagatggctgggtgcggtggcgcctttaatcggcgccggcgccgatcacgaggtcaggagttggagaccagcctggcgaatgtggtgaaaccccgtctctactaaaaatgcaaaattt

SEQ ID NO: 398307 - DNA, 674 bp, Homo sapiens
ggacctgaaacttaatcgtcgggggttatcatttacatccaacaaaataatggagacttgagcaggcttgtgaatctggaggctggaatctgtggcaggtcatgcacttgaacagccaagttgtagaaggactgactttcccgatccaaagcttttaggactttgagtacaccattcttgtcaacagtaaactgcccaaggctatcacctgaagcaatgctataagtcaattgagagttgatgcctgaaattaaagggaagaaaaaattttcttaaacatatgctgattgcagaacaagctataccaaaacttttagcaagtaatttggcatgtttgatatgccgtgcatccaaacacactttaggaaatcctgtgaacaaatgatctatatactgcttgctatttactagggtgttgaaatgttaaattacaaaagtaaagaggagaaaaatattccagagagcagatatttttctatatatttccttgtttctatcacataattcctgatggtccaacactaacagtgccacacgctatactattagtcaaacatttgtaactttagtaatttagggaggctgacaccaattttcaagaaagggtaataaaatgttctgatgtatggcattagtcatgaatgctgtaagtgtacttctatatttcgtgtcaa

SEQ ID NO: 398308 - DNA, 274 bp, Homo sapiens
gtgttgatagcttctgtctcaagtcttctcgaagctaataagagagttaatgcgaacttggcagcatcaatgccctattggatagtcaataagagtacctgaatctggatgagaaatttggcctggcagctgggggaatttctatagaaggcagtcaaaggcagaaaagggagctgcattttggaatgttaaaacaaaaacctatcatttaaatatgacaaacatatcacaataaaaattagaatttccaccacgggctttgggcattcttggg

SEQ ID NO: 398309 - DNA, 469 bp, Homo sapiens
agctgccatttactgagatagaggcaggggaaattgggaattgggtcttactcatgtgaagtttgaaaaggccattaaatatctaagcagtgatgtcaggtaggaagtgagaataaaagtctggaatttaggaataagaaattggctagagatataaatttgagaatcagaagtctagtgggtatcaggccaggtacagtggctcacgcctgtaatcccagcactttgggaggctgaggtgggtggatcacttgaggtcaggagttcgagatcagcctggccaacatggtgaaactccacctctactacaaacacgaaacttggccaggcctggtggtgggatcctgtaatcccagctgctagggaagctgaggcaaatagtcacttgcacccgggaagcggaggttgcagtgagctgagattatgccactgaattacagcctaggagacagagcaagattctgtctca

SEQ ID NO: 398310 - DNA, 114 bp, Homo sapiens
gggcattgggaattgtcaaagctcccaggtgattctaatgtgcagctgaggttcagaaccactggcttcgagccttacacacagtgctcaagatgtgagaactgttcttactct

SEQ ID NO: 398311 - DNA, 520 bp, Homo sapiens
aagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaaca

SEQ ID NO: 398312 - DNA, 338 bp, Homo sapiens
ccgggtgcgctgctgaatacgcaggagaaggaaaaacagagcccctcatctggctgcctccttgttcttccaccaaataatttttaagcacttttgtttcttttaactttttattctcccgtaatttcagacttacagagcagctgcaaaatagcacagggcatccctgtagatctttcacccagatccctcagatgttagcacagatgttaacattttgccctgtttgttccccccagctcactttccgaatgtgaatatgggtgtgtgtatatgtactgtatatgcattttttgcctgaatcttttgaaagtaaacacttcagtgtgtttttccta

SEQ ID NO: 398313 - DNA, 282 bp, Homo sapiens
tcagaaatgcttttcattgagtgtctgtatttaaagttgcatttttaaacaatagtatgcagaaatcaagatttttgtctgtaatttcatattatgtctatcatcaaagaaaagcacatatgctggtggctaacccgggataaaagtaataagagacagacctgtgagactcagcagaacctgagcaacaaatgaagagaaattgggacaagaacaaataaagacagttcttttattcatgcctggccaaaggacttcactggctctatctaaaaaaaaaaa

SEQ ID NO: 398314 - DNA, 370 bp, Homo sapiens
gctgctgcagggggctaaccttgggggtgagggggcagcctcggagaggaagctgcccaggagcagaggctgggggcggagggccccgggcagtgcccccgtgcccacagcaggaccctggctgccagttctccgcagagggccaggtggtctgaagctgcccagcagggagagaacaggcctggcctggactggaaacctgccatctggcctctctgaacctggggactccgggtgtcctcgaagaagggcctgagcagcagcagaggaccccaggcgactgcctgagccgggcgccgacgacgactgagcacctgatacgtccccggcactcgcagccccgcggccggagtcgctgtgggtgagcggt

SEQ ID NO: 398315 - DNA, 407 bp, Homo sapiens
aacttcagacagagagagaccgtagtaatcaatcctggcacttttaagaagaaattttaactctgctatgggtgcacaggaacatcattagaaatgaaaaaaacaagctctgtcaagaagacagagcaaggtcttcgaagatctatacgacaaaaataattatttcctcacgtgttattcaaggtttttctactactggcacatgggaaaatagtaagttgagggttaactgtagcattagaaacatggtactatatgctttatttcaaggattctcaattataaaagactgacaagagacaaacaagcttctctcacatccagaaagaatacaggaggagacccttttctgatttgtctaggtcagaaaaacttccatgttttcctttgaaaggttatcctctgca

SEQ ID NO: 398316 - DNA, 151 bp, Homo sapiens
tagtactcccattacataggtcagtgcccttaatgatgtccatatttttctctgaggctgtgttcatttttcttcattcctttttctgtcttttgaattgcataatctttacctatctatcttcaggctcattagttatttcttctaccag

SEQ ID NO: 398317 - DNA, 513 bp, Homo sapiens
aaacaaaatagggattgtcattttgatcctgactctgacccaattgacagtcagttcaagcaggctacttttgtattatgcaacacaaacatttcaacctatcttcagttcacgtgtattcataatgatcgtctaagggcatatgtgtaaaatgcacattccaggccctcattctagactactaagtcagagtctctattttcaaaacaatgtttaaagagcaggggctttggagtcccaaagactgggtttgaaaactgtctcacccatttataagctatagtgcctttggcaatgtacttaatattttttgtttgtttgcttgacttcaatatcctcataagtaatgtaggaataaaaattcttacctgtcataaggttttggtgaacactaatttagaatgagggtctaattataatatttatattaatagcttacaaatatcgagtacttacaaagtattgagcactgacgccaatgctgtatctgtattatcttattaatttgtctta

SEQ ID NO: 398318 - DNA, 485 bp, Homo sapiens
actttccatttgacttcctgggatttctgttgtctctgaatggaagacattttctccacccagtgtaaacttcctttcttagccccgtctttaaaagcagttaggagtgagaattgcgtcttttacctttcacatctggtgggctgagcctcttttaagaccttaagaacgtacttttcttgatttagctcagtcactatccccttttttatctttctttttatattttatttttcccttgttatcattttctattttgacctctgtttatgttttgaacagagcctgtctcagtttccccagggtgcttctctgcacccagcagagggtctgtctgcctgtgagcaccagctggggctgttcctcccacgcctctcaccacctccccttacgcatgcctttagccttctgagactgccagtatgccatgggttaaaggaaggtttgggtggcatttggtgcattctctctgccagttgctgctg

SEQ ID NO: 398319 - DNA, 699 bp, Homo sapiens
tgaagcagaggtcacttttctttcactggtgaggtactttgacaaagacgaagaagggagacaatggtgtggcaaaatggctttgttgtggtggaagatgaattgtcgtctcaagggggcagaggactgcctgtgagcttccttaacatggagcccgaaaccggtgtttgcacagtccttgaggaaagggtttgctcagcaaattaacagtgtgaacaagactgcaggagggaccatttacctacctgagaacaaactgttttctagctcttcagcagcaccacttacgcacaattttcatgtgctaatggcaagtgattattacctagttagtgaatatacgtggaagacataaaatagcctttactatcccctggttgagacaactcgctaactcagacttgccaggtgctctgaattagagaggtgctacaggaatgtcctctcggatttttggcgttgagcatgcatgcatgtgagcagggtgccatttcttcagaagaaaaataaatgacaacattctgttttggggcttgaaactgcatgactgaaaacataaaggtgacaactgtgatatgcttttttaatgagggcagagatgtcaagagaaaccagccttctaggaacaaaagaatactctgtcaggtgcagtggacttaagacctttttctctcttggaataatgtccttaaaaataac

SEQ ID NO: 398320 - DNA, 165 bp, Homo sapiens
gtacaagggccagatggcagagaacagcttaaactgagccttcagcctcattaataggaggaagtcttggtacttttggtgactaagaaactggattatttaaaaccttaattatctcctttactcctggtttacagaaggcaataaatatacaactcctttaga

SEQ ID NO: 398321 - DNA, 181 bp, Homo sapiens
gcagcagcagctgtaagtccaccatggatgttactcccaggatgtagccagggctaagtggcattctatagcagagggaaagggacttcgcagtgtgttataaccaaggaccttggtcagctcgggtgtgtccacagggagattactggccaggcgcggtggctcacgcctgtaatctcag

SEQ ID NO: 398322 - DNA, 301 bp, Homo sapiens
aagacaagttagagaccaatacagactctgggcaggacatgagtggcctggattaagacagtggtagtgggaactggagcggttactagagtcaagagaaggtgaggaggcaggacctgtgggacatggtgactgagtggagactgggggaggatgagaaaagtcaaggtttctcaggttctggcctgagtgactgttggtgctgttaattccctgacatgggggacacttggttaggggtcagcttagagaaaagataatgaattcagttttcaacaggttgagtttgctgtgactgtgg

SEQ ID NO: 398323 - DNA, 396 bp, Homo sapiens
tgagacagagtctcgctctgtcgcccaggctggagtgcagtggcgtgatctcggctcactgcaacctccgcctcctgggttcgagcaattctcctgcctcagcctcccaagtagctgagaccacaggaacacgctgccacacccagctaattttttttttttttttgtattttagtagagacagagtttcaccgtgttgcctaggctggtcgcaaacttctgagttcaggcaatctacccaccttggcctcccaaagggctgggattacagacatgagccacagcgcccagctgcaaattcttcattaaatcctcaacagctaggctggatgtcccccctcctctgagaacactgacctcatacttccctgctgccagcccttctgtcgtcttctc

SEQ ID NO: 398324 - DNA, 493 bp, Homo sapiens
tggggaaaagaaagagagatcagactgttactgtgtctgtgtagaaagaagtagatataagagactccattttgttcatcttgtgagtcgatggcgcacgattgcggtgtttctgtctccgtggaggtgcttttctttgcatctccgatgggttcattgtagaacttcaaatgtctagtgggtatccaaacaggaagctgattttctcctggtgaaacacaagcaaaacctctcccccatgttaccaccttccctatttcccatgtcttatttttattatctttctaccaaatcagttttccttcatgtgggctgttctttttaccagtaagatgttgttctgcagaagtagtagtctgatttctataaatgtttaaaaaatataaagtgctagattaagttgcatctgaggcgtggtacattccttactgtctcccccttctttttatttaactaattgagttttgagtgttctattagttctttcaactat

SEQ ID NO: 398325 - DNA, 951 bp, Homo sapiens
gctcagcctcccgagtagctgggactacaggcacgtgctaccacacctggctaagttttgtatttttagtagagatggggtttcaccagattagccgggatggtctccagctcctgacctcgtgaaccgcccgccttcgtcttacaaagtgctgggattacaggtgcgacaagataatgaacctccattcctctgagagaagagtattttgaatattcgactttgcccatgaatttccctttccatggtcttgctctgttgcccaggttggagtaaaatggtacaatcacagttcactgcagcctcgacctctccagttcaagtgatcctcctgactctgccttctgagtggctgagactataggcatgcatcattatgcctggctttttaaaaaactttttgtaaagatggggtctccctatgttgcccaggctgatcttgaacacctgggctcaagggatcctcctgccttggcatcccaaagtattgagattacaggcatgagccaccatgcctggtcctaacatcattttttggatactgcacttacttcctaagatcaagaacaaggaaacaggaagtacaatcatgcactggggtaaagaagattcatctgctcttagctacctaccatgccaacactcctgagaaagctcacagaggcccatgatgcccacctggatctgaggacctagaaagccacaacaggcaaccataatctgggtcttccctcagaccaatcccctgcataaagtgaatgaatgaaaaacccatcttatattaatcagagttctctagagaaaaagaaccaatcagatgtgtatatatagaaagagagaattattttagggaattagctcacatcattatgcaggctggtcaatcaaaaatctgtggagtgggctagcaggctggagacccagggaaaggctaaattgcagtttagatca

SEQ ID NO: 398326 - DNA, 1048 bp, Homo sapiens
gctcagcctcccgagtagctgggactacaggcacgtgctaccacacctggctaagttttgtatttttagtagagatggggtttcaccagattagccgggatggtctccagctcctgacctcgtgaaccgcccgccttcgtcttacaaagtgctgggattacaggtgcgacaagataatgaacctccattcctctgagagaagagtattttgaatattcgactttgcccatgaatttccctttccatggtcttgctctgttgcccaggttggagtaaaatggtacaatcacagttcactgcagcctcgacctctccagttcaagtgatcctcctgactctgccttctgagtggctgagactataggcatgcatcattatgcctggctttttaaaaaactttttgtaaagatggggtctccctatgttgcccaggctgatcttgaacacctgggctcaagggatcctcctgccttggcatcccaaagtattgagattacaggcatgagccaccatgcctggtcctaacatcattttttggatactgcacttacttcctaagatcaagaacaagaaaggagatgtgtgtatgagttctgcagaagtccaccaaatgtgggccagggttatttccctggtgatgctctgaagcttttgccaaaggacaaatggaaacaggaagtacaatcatgcactggggtaaagaagattcatctgctcttagctacctaccatgccaacactcctgagaaagctcacagaggcccatgatgcccacctggatctgaggacctagaaagccacaacaggcaaccataatctgggtcttccctcagaccaatcccctgcataaagtgaatgaatgaaaaacccatcttatattaatcagagttctctagagaaaaagaaccaatcagatgtgtatatatagaaagagagaattattttagggaattagctcacatcattatgcaggctggtcaatcaaaaatctgtggagtgggctagcaggctggagacccagggaaaggctaaattgcagtttagatca

SEQ ID NO: 398327 - DNA, 722 bp, Homo sapiens
cattgcactccagcctgggcaacaagagcagaattctcatctaaaaagaaaaaagaaaaagataatacatggacaaatattaaaacagtattataattttggtctgtaactctactttttttcctacaggatttaaaatacacattcattaaaaattacaaatctatgttaatggccacacagtatataacaacgtagtttgtgaatgatgtcagtaacatagagggggtgaagctgtaaagaagtagcatttttttatgtgactgaagttgttatcaatgtaagatagaatgtcgtaattctaagatgttatttgtaattcctatggaaacaaacaaaaaatccgtagaatctgtgaacaggcatatgcaaacctacccccaaaagctggggaagctcagaggccaaagaaagaggctgacaaacccagtttctcagagagaaatattttataggaacttaaaaacagaagcaatgtcttgggtggctgtccacacctgccatccagaaagcattcattcattcattcattcattcattcattcattcatgtctctactaaaaatacaaaattagccagatgtggtggcgcgtgcctgtaatcccagctactcgggaggctgaggtaggagcatcgcttgaatccaggaggtggaggttgtggtgagccatgatcgcgccattgcactccagcctgggcaacaagagcagaattctcatct

SEQ ID NO: 398328 - DNA, 595 bp, Homo sapiens
tccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataaga

SEQ ID NO: 398329 - DNA, 297 bp, Homo sapiens
ttcacggcagttggggggattattatcaattataattttataaaagtattttaaagaataattgtaaattttccataaattacaacttcctgccatcttttattaaataataatcttgcttaaggcatatagacagacattattatgagtattccagtaaaaaaaatctacatctactgttccgaacactgatgaatatagccagaaggtcagttaataaaaataatgaaaaaggtgtagtatgttggcagggaggcaggtagggggctgaatactgaaaaaatttgcctattatta

SEQ ID NO: 398330 - DNA, 417 bp, Homo sapiens
aaaaccctttttaaaaaaggaaaaacttagcttttttttaatctgtgtaatttatttataagttcttgatttcttgttttctttgcaaaggagaaactgtggtattctatttaaaacatgggtttcagaaccagtcagatttgctttcgtagttgtgtgactttgggccatctgtttaatttgtctgaggccactgtcctcatctgtaaagcaataactcaatgaatcttcattgaggggtgacccttagccagcttaggtgaccccgagcatatgacacacctgtgcatgtgcgtctttccttctgttttcccacccaagtcctgccatggccaaaggcagtagaattctggccgtactcattgttacctttttttgtaaccatactacttttttgagtttctttctcttttatta

SEQ ID NO: 398331 - DNA, 371 bp, Homo sapiens
taagattaggaacagagatttcagttactacacatgactagaaatacagtctctgcaaaaatagtttggtaagccactaaagaaatggactactgtagtattcaacaataaaaaacaaagaaaaacaaaactcagcaaaccccagtaaaggggcagatctgttctccagtgttaatacattataacatccaaatgttcagtgttcaaataaagtcacaggcaaacaaagaaagaggaaagtattgtcattcaaaggaacaaaataaatgaatagaaactattcctgaggaagcacagatgttgaacttactgtacagactttaaaataactgtctctaatgtgcttaaagagctagatgaaaacatggata

SEQ ID NO: 398332 - DNA, 542 bp, Homo sapiens
gtttttgttttccttatttgtgtatctactgcagtgcctcactgtaccttgtacttaatagttgctcagcagtagtcactggagggaatatgtagacatatatttgaacctctggctggcaagtggcatcgaatgtgaatctagacctgacccatctactgtttgtaaattctatgggctggttgattaattttgccaagctgtcctcttctaaactcaaacctggactgtttaagttaaaatttacctgccttttctatatcccttcctgttctttcagtggtaccatcagcttgcaaaattgttcaaggttttcctttgctcctgatgacctgcttaatgtgtatgttttagttggagcagtggctacaacatcttaaaagagcttgtctgcaaactctaatgataacctacacaacacatgaaaacagtgtgctttgaggtaatctgcagttcagtttagcttttctcagcagtatcttcagcaactttaaagctctggcaggttttatcaatgtaaataaagtgcattttctttttgt

SEQ ID NO: 398333 - DNA, 683 bp, Homo sapiens
caacctttttcacacatgcacagtaggaagaaataagcaacatggagtagtaactcaggctaagaagcccacatgtgcactagaaacagtggggcgggggactcagaaattcgcaccttatgtaaatgaagcacccctcccaccagcttttctataaaaacccttgcatttcactgtaaaatggcaacccatctttctgggacccctctctgatccagagagctttctttcttttgcttattaaacttctgctctaacctaccctctggagtgtctgcgtccttgatttccttggccatgagacccagaacttcagtgatatctcagacaatgaggcaggtttcactgagacacaagcccagggttctgcagaatgggagggccagcagctatcactgcgtgtgtgagggcaggcagaggaagtcactgtgttttaatagtccagcaccacgggtagagatgttgtggctgactccatccaaggttcaatttctttgtagtaatcatttcagaagttagagcattaacaggctcttgttggggaagaaaggttagtaactccatctcctgagcccttgctaaaaagctcagcttcctgaattctccaggctcaccagattgagagggaagcccaccctgctccttctcccaccgcaaggctgcctttgtctgtaaatgacagg

SEQ ID NO: 398334 - DNA, 645 bp, Homo sapiens
gttttaagccaatcaaatctgtccagagtcatcttaatggaaatattatattaattattttctaatacaatttgtaaacctctgtatttctaaaccaaattcttaaagactccttaaattgtttaaaagatctaaatgtttctcttcccttcttatcttgtaacctagtaagccaggcaattagcttaacgatcagttaaacctttttttccccagagttgtgttaaaagctatttgcaacaggaacattcttcatgagagctcattgacttttctccctctttttgtgttagacctatgtatctgaactatctgggtgtatccataataacaagaattgagttttgatcaattaatagattaagttttctagaagacagagaaagaaagtgagatgattaccacaaatatgtaaagagttactgaccactataaaagtcaaatcaccttctctttgcaaagagtgggaaagccttaaatgcaagcaaacccatttcaatacatgagaaagaaaggaagtcattacaaccagttcaaatagtatcttgggcacttgataattccatcaagactataggattaattaagtctttaaaagtactttcaagtgaataattgtagtcatatcaaaagtacttcaaaatg

SEQ ID NO: 398335 - DNA, 395 bp, Homo sapiens
gcaacaagagcgagactcggtctcaaaaaaaaaaaaaaaattactgtataagacttcgtacttaataagaaataagtttgtgaggagctttaaaatcttcatttagagcctgggcgacagagcaagactccgtctcaaaaaaaaaaaaaagaacccagtttgtattttaactttggttgttttatttacagactatgttacacccatgtaatatggtcagtttagcctatagctgtgttgaaatgtggcatagcagttagaattaacatggtgaaatattactaagtttatctgtaatttttaacttaaaacttgcattttagcaggcaataggttgtttttcttttgacggagtttcgctccagcctcggcaacaagagcgagactcggtctca

SEQ ID NO: 398336 - DNA, 623 bp, Homo sapiens
tactgttatctctagtgccagttatctcgtgtagcccgagccagcatgatcgtctcagttaagtgccaccttccagttctcagcccctccagtccatgctccacactccaagagtcatctctgaaaaaacatcgaatggagatcagtgaccatccgtaccattaaattcacagtccttagcttgacctgccttggcctagcctttaatcccgcctcattgcctgccctttcccctctcagtgagctgagatcacgccattgcactccagcctggggacagagcaagactatctcaaaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagattatttactgggccaacagcaaggtgtttctgcctttcaatgttggccttgtttctaggaggcttgaagaatgcttatttggcatttgactcagcttccccatccat

SEQ ID NO: 398337 - DNA, 640 bp, Homo sapiens
ctaaaatacgccgaggactctgctaagtgttgggggcaccagggtgaagatgataaagttctcgacttacaaagcttagtttctggagaagacaaacagtaaataagcacttttaataagttacgctcaaattggcatgagaacatggaagaggtggggtggtgaattcttagtggaggcttctgccatgcacaatgcctgggctgacctgtgaagaagtgttttagtgggtgggaaaggtgatagaggcaaagtgaacaacacagtcagtctggtggtttagggaaacagcctagtgttttggcaatgaaatctcttgagttcgggtaaggtagggaaaaaggccagcacatgtctggcccctgtcaggtgccacagaaaagtaggaatttttcttgttccaaataagatctagtccctggccatgccctggtcttccaggaagatacaatccatagggccaatcccaaactacaccatcgaatgttccttgaagccgtcacggcttcaacggaactttaaggagtccttatcattaaggtagtacaagtatctatattgtaaaactgatgtgtagcttgatctctaggggacaggaccaccaacaaataatgcagattttgtgtttgtggccgaaggt

SEQ ID NO: 398338 - DNA, 512 bp, Homo sapiens
atttactgtttccaagtacgttatagataccagattccagtaagatttaataatgataagaagtttttaggcttatattaaaaacagaagtctgtggaaccataacttgttcaccaggtaataacagagcgagcgtccattgttgaggtcagtacttataacccacccgcaggccgtagaccacctcagagaaactcagctccagagggccccatgggctgctgctgtgcagttggctctgcagaggccagagccccctgctgttcccaagtgttctgtgcccagagaacccggctttgcccacctcttcagcactcatcgtttcatgagctgtggtcatgttcttagagagtgcccaggaacagtctgcacttagacatgaaagcctggagaccacattctcacctggtggaatccacatgaaggctcccccatggaagggagtccagggcaatggcaaacactgtctgtcgtcagaccagagcaactgtgggaccagatctgagtttgct

SEQ ID NO: 398339 - DNA, 564 bp, Homo sapiens
ccatagccccctgagtagctgggactacaggtgcatgccaccatgcctgactaatttttttttttaatttgttttaatgtctggcattttgctatgttgtccaggctggccttgaccttgtggcctcaagtgatcctcctgcagcagcctcccaaagtgttgggattataggcatgagccactgtgcccagccagataatatattcttgacgttgtgttaagtacttagactaccatctaaatcttacagctaacttgggaaatacagagtactatttttataaatgaggaaattgaggatttaaaaccaaatgtgattctaaaactgttagattctaagactcttgatattatactatcctgtctaatctgtttcatggtattgttgatgttttaataattaggagcacatctacttggtgttttagtgttccaaatctatacagaatagtctgtatgattaaaaaatataatttgtaattatcacatttattactaattttttctttcatttcctttgatgcaaaaacattactaatttgattatacatgggtacagccttt

SEQ ID NO: 398340 - DNA, 344 bp, Homo sapiens
aactgatttgcatttgtgtgtataagaacggcttgtttttttgttgtttttgaacagagtcttgctctgtcaccccaggctggggtgcagtggcgccatgtaggctcgctgaaaaacctgccttccgggttcaagcgatgctcgtgcctcagcctcctgagtagttgggattataggcatggggcaccatgcctggctaatttttgtatttttagtagaggcggattttgccatgttggccaggctggtctgaaacttctggtttcaagtgatccacccaccttggccttccaaagtgctgggattataagcaagagccaccgcgcccggccaagactgtttgg

SEQ ID NO: 398341 - DNA, 123 bp, Homo sapiens
aagcatctgaaaccacctccattgtatttctatttctacctgggtcaatgaaactatgagcttagtgttcttaggaaactctggggctggaggatccacttcctaggtggcttgctcacatgg

SEQ ID NO: 398342 - DNA, 225 bp, Homo sapiens
acctaagcagtgactcagagaagaaaaacacaaggactccggggctctctaacatttggaggttgggagattaaaaaaaaatagcaatggagatttaggaggagtagccagtgaggaggaaaaccaagatagaatggaatcatcaattgaaaaaaaaatgaaaacaaaaagccacaacaatgagtcaggtcagctatgagtaattaactcgattctgactcatgg

SEQ ID NO: 398343 - DNA, 266 bp, Homo sapiens
tctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgaccttt

SEQ ID NO: 398344 - DNA, 459 bp, Homo sapiens
acctgttagttttatggcagtatattaaactatagacagctatgaaaaatacaaaatattaaaaattaaagtagaagaaaacatcaaattagtgatccactaaatagctagtgatgcatttactctgccactaatcagctgactggctttgggccaatttctctaagccagtttcttacctatattcttacctatgaagaagttaaataagatcaacatgccactttaatttttgtgtagaagtaaattttattcgcttctcagacctctaagaactacctaatggtcaaagtttttggcaaactggaaaattactttttgtgatctaaaagataaaatctagcttagataacttgaataattaatttgattcacgtatcttacacaaaatatttgatatatctgaggaatggctggagttgctatgaaataaaataattttaagttaacgtgttaaat

SEQ ID NO: 398345 - DNA, 636 bp, Homo sapiens
gaatcctagtgtccttgtgcctccttctgcatatgtctggactttgcttagctgatgagatccagttcagataccaccttctgtacaatggcttccttaattcctttaatttctcttaattgcaataaagctatttgcagaggaatgaaagatgctcccctttgcgctgggtacaggatgcactgaaactttcagcatggggcgcggtggctcatccctgtaatcccagcactttgggaggccgaggcaggcggatcacctgaggtcaggagttcgggaccagcctgaccaacgtggcgaaaccctgtctctactaaaaatacaaaaattagccaggcatggtggtatatgcctataattccagctacttgggaggctgaggaaggagaatctattgaacccaggagacagaggttgcagtgagctgagatcgcaccactgcactccagcctgggtgacatagcgagactccatctcaaaacaacaacaacagcaacaacaacaaaaacccaaactttcagcaggagagtagcttggttcagcccagcaacatcggtttgaagattatatcaagttttccagtcaaatgtaaccagtttatggatctgtgtttgcacggggtctgaacctcccctc

SEQ ID NO: 398346 - DNA, 617 bp, Homo sapiens
atttgctgagtaagggccttttagaaaaacaagtctgtgggttgatattattggcacattccctccaaatgacagacatcatctcttctcctgaatttatggggctgagtttctcatttgtagtatggtgtgtgtctctgcatatggaactctaaaattagctttttaaaagcaggcataacaagctgctggcctgggttttatttcatctgtataatatttttaaaaataagaaatttgcacatgaaatccctgatttccaacttctctgggaagatctggcaaccctgggcttgaattttctcctgttaaacgttgcttatctcccatggctgtgagctctgcagtttgctgccacccttagaagtccctgttgtatatccagacggctttatttaaatggctggctcccagcagcctctgagtttgagacctgtgtcatagagtttcaattcattttggtgaaacgatttcttttttgacaaggataggtatttacatctattatggcaactcatgcactcaggatgccttacaaggagttttacattacatcattttatttattccttccaaattttacgataaataaaattattataattacttaaaaaata

SEQ ID NO: 398347 - DNA, 190 bp, Homo sapiens
tttgctcttttctttatccctcagtttttaagaggtatttatcaattagaggtattagccctttttctgttgcacatatcttctcccagtttttcagttgtcttttgatttcctttacggtgtttgggcatgcaaaaatgtttactgtttaaatgcatcaatcttttcttttttcttttctttcctctgt

SEQ ID NO: 398348 - DNA, 451 bp, Homo sapiens
tctgggcccccactctcccgcagcagcccaggaagtgagataatctgaagagttgccaacccctgagtgatccatcatgtcccttggtaatggaaattgtgattacgctcagggctggttcccacgaggcccataagatgtcagcggtctgcaggaaggccccagtattctgaccttgtggtcacctgggcttgtgggggcttcaccacacactgaggctggtttctaaagagtctctaggtgtttcagctgccgccctcagacggcgagatgtcctcagagcctctgagacaccgggcaccgtcctccaagtctcagactccaacagagcaggttgatgtttgtttcatgattctgtgttcttgaaaaggacaaagcaaaaaagagagataaaaaactttggacgcagaccaaagccgctcaggtttttagctctgtgtccccttgcagg

SEQ ID NO: 398349 - DNA, 501 bp, Homo sapiens
cattccaccaaagactctgggggagcatgaagtatctgtcagtgaaccagcaggcaggagagctgatgtttgcaagaatgcagcagaaactataatgcacattgctatcctaagttagcttgttcttactcaaatcattaaaacaataacctcattttctgtctcaatagaatccttctattaagagtgttatacattttatagatgtagaaagaacttaacctcatcttcagtgttccacctgggtgggtgtggctgatgcatttgcttcatttcagactccaaaaagcatattggtttatattcattagctttactggttccttttctctaaagaacccaaggtgctcttgagagctgcttcatataatgagcatgtagtgcctcttaaatcaggagaacaaagaggcagtcaaggagaaagacaagtaaatgaggaatgaaagaccttgaacatgaaagtgggttgagtttgatgatgccatacatttggcattgctt

SEQ ID NO: 398350 - DNA, 196 bp, Homo sapiens
agttcaattaatccaaagttactagaattagaaggaaattcttgaatctgagtaatcttgctgtggaggatacaaatttgatgtatttgttgtttgtttaagaccagtttcagagcctgtaggacagcaccttgaccttgcagggtgctgattctcagatggattctttgactttcaagaatagatggatggctaa

SEQ ID NO: 398351 - DNA, 156 bp, Homo sapiens
cttgattgctctctttcctttctaccaccccctttctgactaattcatcagcaggtcttgtcgacactacctctagcccttatcctgagttgtcctctttttcatctgcacagccatcgtcctagtcccagttatcccctctttcttacctgcatt

SEQ ID NO: 398352 - DNA, 529 bp, Homo sapiens
gggttatatgacaattctccgtacttcccactcagttttgctgtgaacctaaaactactctaaaaaaaagggggttttaagggacatttgttcctgtaattgtagactaatcaaatcaagcaagggtatgttagccaaagaaattcacatatggcacatgatgcagaaacagtgagaaatttagatcctcccaggtgcactatgattacaggataccttgggaaataaattagctagtttataatgcaacaatcttgacacccctcctccccccaaaaaatcatgtgccttgacattttgggagcctgacagcatggatgtggcttacagtaaagctgcaagtgttacagggaagtagaatgatgcttttagctcttggaataggatcatattccatctagcttagaagaaaagaagtttatttcactgttttttccactattgctatgccaagtgctggcacaaagaaaaggtgagagaaaggaaatcagcttaatcctaatcccatcaaaatagctcatctcagtcc

SEQ ID NO: 398353 - DNA, 458 bp, Homo sapiens
taaggctaaaagtagcgcagtttaccacgtaaagacgttagggtcaaggtgtagcccatgaggtggcaagaaatgggctacattttctaccccagaaaactacgatagcccttatgaaacttaagggtttcgatgagtcatcgaaaccctacctgatcccatttcccaaagcctggcttcgccaggcctcctcatctcccaccaagttctggtcccccaggaggctgaggaagaagtacagaaacgagtgtatgcggctcagagaggacaaagctgggaaggcccaggccagaggctgttaccgtaggggaatcggggggagatcgaaccccagcccctctggatgcacatatctgcatgggaaatccagggtgaaaagtcagctgaggaaattggcatggagcgggaagggggagagctagaggaacactattctcagggtggcatggtctatagca

SEQ ID NO: 398354 - DNA, 366 bp, Homo sapiens
tatcatctgtgaatgagtttgctaagttttggagcaaaagccattgaaacctaaggtcagggttttgtccctacttggctttatttactctaccctattcaaagacacagactacaactctaatctcgtttcaccaacttgaacctgcatataggctgcagggaaattggaaggattgtggatgagtaagtacaaatccatcaccattattaacacagccccttacccgtccctgctagacctactacacctactgccattgatctccactccctacgcttaccgactcaggtctccagtcgcctcctcgcccttactagacccctcctcccctactctcctactctccctcccctcgccctccct

SEQ ID NO: 398355 - DNA, 515 bp, Homo sapiens
agctgcttttgccctggtaaaactaacaaacttgagagtattgattttcaatgcctcatagtgtagatggggatagaaaatacaactctgcccatgatcaaggtggagagcccaacaggagacactcccattcagttgagactccctgctgccttaattaagtgtaagggagaacctgaaatgaacccagttccttctcctgttctaggagactgtgagcaggacattctactttaagctcgaaagctgaaagctctgctcaaatgggccagacttacattacctgggtgatattaaaacaaacaaacaaaaaaccctcaagtcatgaaattagttttttgtggttcttaagtaggcaggcctctaagcattcagcagaagcaaacataaactcttcctagagcagcacatcagtgtcctaggtctcgacttactcctataaatatttatatatacttaatgaacagttttagtcaaaaatgacaaaggatacaaggcaacaaagcaccataagc

SEQ ID NO: 398356 - DNA, 500 bp, Homo sapiens
gaaggtaggagtactgcaagaggatgaggttctgtatgagatcagaacctcattaaaaaaaactttaaaattagtttaatttatgtaaactcacccgtatatacaggtgggtgagaactacagaaattcaggttactgtagcaatgagtatttgtaaaatatttatctaattttccaagaggtatattctacactaaaataggaagtctattgaatagatcctagtagcctaataaacaagttatgtgtcttatcctaaggatgcacaattccttgctcccctctttgcttcagaagcattttacttggagttaccatattcatttttctttacatccagcttgtggctactcatacctagaaaccctgggctgacaaacataccaggactggcaagtgcctagagtggctgctgagtgctggctagctgcaggggcaaagcaggcatacctcacacacctagctgccttctcccaaagcagcacctgggctgagaggcc

SEQ ID NO: 398357 - DNA, 204 bp, Homo sapiens
aacctgccccagaactggcccactcaccttctccatggtggctccccaaccacctcgaacctctgtgccctcagtattctagaccagtggtccccaccctttttggcaccagggactggttttatgggagataactgtttcacggcatgtgcagggtgatagttttgggatgaagttgttgcacctcagttcatcagatattag

SEQ ID NO: 398358 - DNA, 714 bp, Homo sapiens
tgattttgtctgcatggacagtgtgtgtgtgtgtgtgtgtgtgtgtgtgtgtgtgcgcgcgcgcgcgcgtgtgtgtttgttggggttgcacgcacagtgatgatgggtgccactcaccgttctcactttgaatccaaatgttaggaaactttttttccttctgtattcactcaggagacaggccctggcaccaggctctggagaccccacttcctgactccagcggtgcgaagatgatacaatactttctggtgctgacattcagctgtctcccaaacaggttggctgatagccctgcccgtccttgaagaggggccgggggctgtctaaaaagacagttctgatgactgcttcgttggtagtggcagaggatttggggcacaggggtggagttaagtccaattgctgtttaaattggacttggcctcctttattttacagtcctaaggggtctccataggagaaaaagtagcgagagaaacttagaacacaggaaagcaagcatagggaagagtttcttgtctcaatcttggtactgccgtgccaaaatgaagcccagggatggttaaaaacggatcctagggaccgggcaccttggctcaggcctgtaatcccagcactttgggagatcaagatgggaggattgcttgaggctaggagttcgagaccagcctggccaacatagtgagacctcatctccaaaaataaaaactt

SEQ ID NO: 398359 - DNA, 393 bp, Homo sapiens
aaggatattgaagatctgaacagtaacttgacctgattaacagatacagggcactgcatacaatcatgagagaaattatatttttccaagtgtgtacaaatcatcacccaactgaccatatactggctcttaaaccaagccttatcacataccaaaaggcttctagtttattcagattatataatctggttacaaagaattgaggtagaataaaaaaacaaaagataggtagaaaaaaccacaaattgcttggaaattatacctcacactctaaataatctgtgtgtcaaagaagacatcacattggtaatgtaaaatctttttatctaagtctgatgaaaagatgagttatcaaaacttgtgggatgcagctaaagcagtgaatagatgata

SEQ ID NO: 398360 - DNA, 685 bp, Homo sapiens
atgcaatggtattatgacaaatggctatccatagcatgaagaaaaataaactatctggaggtacatattcactaatgagaactaaaacatcaacaaggtactactttttacccttcagattactactaatgattaaaatgagtgctaagtgttgacaagattaacagtgggtccactggcacatttctgacaaaaatataaactggtataacttttaagggaatttaatctggcactatgtatcaaaatttaaaatgtacaaaccagcaattctacttctgggagcaaagaatgaaacaagtgtacaaaggtatatatatgcaatgattttcattataccatcactttttaaaatgatgaatttaaaaactatcaatggaggttggttaaataaattatgcctatagtcctagctactcagaaggttgaggcaggaggatatggcttgcttgagcctgggagctggaggctacagtgagctatgatggcatcactacactccaggctgggtgacccagcaagatcctctctccaaaaaaataataaattattacacaaccctataaggtatcaaattttagacatttaaaaatgttttgatctatacgtattgatcagtacaaaaagcaatttacagtatatattatgtgattctgtttgtggattttatttttacaactaatgc

SEQ ID NO: 398361 - DNA, 382 bp, Homo sapiens
taccagacggtagaatataaacagatctttttgaaggaaataattcaacccactatagcatccctctttttccagcaccaaggttggtgcctgacacccagtaggtgcccaaaatatgtttgttgaattgcatcagtagcctgttgtgttagaaaagaagggaagagggtcttcgctaaaaggaaatatgatttgtatctgatatatggccctaaggtcaattttgggaaaggatttcacagttcatgattgctttcataaattcctttcaattagtatgtgaatcttatagtatcttatactcttgttatagggtctattgaagccgccctccttccaaaggagaaaagcaaattactttaccaggagaaattctaaaata

SEQ ID NO: 398362 - DNA, 495 bp, Homo sapiens
tatggcttcctgaggattaccatgagccctcctccaccgtcaagcggcagctaccagccaccagaccagatcccttcgaaggtgcccggagtaccagactgacaaaagcgcccgtacagtgctcagtcctgtaaccaaagctgtctagggtgcagacatcgctcaccggaccgggtagggctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccg

SEQ ID NO: 398363 - DNA, 577 bp, Homo sapiens
cttataaccctaatcgcaaagagccttagtgaattgttggaagaagagtgacttcaaaatgaaactgactccctgtatgttaggagtccatattctctgatacagttaacgttttccttccaacctcttcactgttcaagcaaagtggtattttagctattcactgtttgacactttaataggagttttgatgagcaatttcaggatgtggaattgctacactgcaccaggttcctgcaggagcagcagcctcagcctgtggatgggacgtgagatcttggtgtatctcctggaggaaacgctgtgctgctgtgttgatgacggggcgattagggttagtctgggccgtcctagacaagcatagattgccagtttcagaaatacccaggagtgggttaatttccttgtttttttaaatcctattcaaagaaagattatttccagttggtttttaaaaagcgtttatttctatttacaagcaaatattccctttcactgtgagctcagtgctaggggtacaagggcaggtggatggtgagaggcggggtgttggtgggcagactcactggaccaaaca

SEQ ID NO: 398364 - DNA, 564 bp, Homo sapiens
acccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcgga

SEQ ID NO: 398365 - DNA, 426 bp, Homo sapiens
ggagaaggagcagactgatggcctcagggaggatgctagaaggcagcaagattggcaggtttggagggctgccttctggtgtaggcctggagctgttgagtaggctcattgttggaactcctggcctagatggtcccagaacttgcctggtcctctggggacccgggaggaggtcatactgatgccagaaccttccagggggcagagtgggagtaaagggcatggggaggggttctccaaggacagaggtggttgtggtactgctgggacctgtggaacttgagattgtatttgggaatgtgcttaggctctcaggaagtgggggccttggtctgtcaggtctaggaggtagtggggtttgaggcatatgggggtttggggtctcaggcttggaaagtgatatgcttgtggaaatttggtgtggtg

SEQ ID NO: 398366 - DNA, 634 bp, Homo sapiens
tttgagacagagtctcgctctgttgcccaggctggagtgcagtggcacgatctcggctcactgcatcctccacctcctggattcaagcaattctcctatctcagcttaccaagtagctgggactacaggcacacaccatgatgcctggctaatttttgtatttttagtagagacgggggtttcaccattttggtcaggctggtctcaaactcctgacctcaggtgatccacctgcctcaggcgtgagccaccatgcctggcaatgacttgatcttctgtgaaaacttagaattattttcatctaactgtttctgtcagacaaaagaaattatcaaccccaaatttttaaggatctctaagtctccttctgcattaaaaacaatgactgagggaacagtggaggggtggggcacagggttttggaaccagccagctctgccctttcctagatgttttgactctgagtaagtggcttagcctctctcagcctcagtttcttcaactgtacaatgggataaaaatatttgcttgcaggattcctaatggctgattaagatattcacaaacaggctcttgctatatatattctgaatgaaagtacagaatttgtacaaactttctggaagataatgga

SEQ ID NO: 398367 - DNA, 567 bp, Homo sapiens
tttgagacagagtctcgctctgttgcccaggctggagtgcagtggcacgatctcggctcactgcatcctccacctcctggattcaagcaattctcctatctcagcttaccaagtagctgggactacaggcacacaccatgatgcctggctaatttttgtatttttagtagagacgggggttcaccatgcctggcaatgacttgatcttctgtgaaaacttagaattattttcatctaactgtttctgtcagacaaaagaaattatcaaccccaaatttttaaggatctctaagtctccttctgcattaaaaacaatgactgagggaacagtggaggggtggggcacagggttttggaaccagccagctctgccctttcctagatgttttgactctgagtaagtggcttagcctctctcagcctcagtttcttcaactgtacaatgggataaaaatatttgcttgcaggattcctaatggctgattaagatattcacaaacaggctcttgctatatatattctgaatgaaagtacagaatttgtacaaactttctggaagataatgga

SEQ ID NO: 398368 - DNA, 232 bp, Homo sapiens
tatgtgcccggtgcctaggagggccacgtccctgctcccgacaggtgggcactcaaaaaaagtttgtgaatggcccagggtgccaactttccaggaatagctggaaagcattatactgaaacacgtgcttccggttctctggggagcccttggtttttgttgctaaaacttgtggttacacactattggctgtttaagtgactctgtttttgtagagttaatgttatttagg

SEQ ID NO: 398369 - DNA, 237 bp, Homo sapiens
ggaaacaaagccataaagtggatgtgactttcacggcaaaaagtttcttttgcctctgaaagcacctcccagaaaggacccagtgggagtgaaaggatgatgttgaccataaccctgttgctttgatttggggaaaactcataaaacatgaatttcctggttttggtagtccctcagtacccaataatttagaaactgttcctttttccccaaagagtaagtggtgcactcatatta

SEQ ID NO: 398370 - DNA, 474 bp, Homo sapiens
gccattaaaaaataatactgtagacggagtggcccaaacgagagaaatttatttcttatagttttggcatggtagatttcatcctgaggtctcttctcttggtttgtagttggctgtcaatctccctgcatgctcacacgaccgctttttgtacatacagtaagaaaatacacactgtcatgtcatttttttgtaagggaactgatttcatcatgaggaccctgccactctcatgacctgatctaatcgtaattaactccaaagaccctatctccaaatgtcagcacattgagggattagcacttcagcgatgacttttgggaggacacggatatttagtccaaaacactgttttaactgaaaagagtttgcattatggacgtttatgtttgaaaaatcagctatttaggtagtggtggtctctcactttatttgccattgacttgttagggaaaccttttgctttctcatttc

SEQ ID NO: 398371 - DNA, 964 bp, Homo sapiens
gggggcggaaaactggcaggtcaggccggtgttagcggtggaaggctgaggacacaccttaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcatttcctcctcttcctcctcctcttccagcagtgatttctgactgaatacaggccctggacccttccctcaaggtctcaccagttctgctctcccatcaaagcttcagatgccatgtttgtactgggggaattgtagccccttgtgctccccaacccctaacttcacctgagcctcaacctgcttgtttgaagccctgagtggctaggggcaaactgggcagaggaattgcattggctgggcatcttgttggctgcttgcgtagaatcattattgcctatgaaattagggcagcggcacctattttttgaagaatgattgcactaacttgttgcagaccagttgacgctcttggtacaactgtgcattttaccttccacttatatactgtgattgcggccggttccgggcccttccattttgatgaaaacctattcttttgacaggtggcctactgtggaccttagggcaataacttcccacagcctttgttggtcc

SEQ ID NO: 398372 - DNA, 945 bp, Homo sapiens
attctgttgttggatcagattagacccttggaaatccaactgtgcgtctcccttgctaaaaaccctctggtgactctccattacatatagcacaacactggactttatctggcaataaggacattctgtatcctcctacttgatagatttcctcaagagtttagtgccagggaccactttttctgttctgaagggactaataagctttttctcaggcaataaggataaattaagaggatgtactgggaagtcagactactttgttcaaatcttgtcttttctacttactagttgtttggttatgaacctttctgtaccttgtttccctgtacaaaatgaaaatgaagacagcatctacctcatggcatttctatgaagaataaatgagataatacaatataaaaacacttagcatggtacttgatacgtaataagagctcagtgtaattatagctgtaagactttcagataactggaattgccacatttcattgattccaagatacacattttttattattgtaacttctctgaaatcagatattttgatggtgtcctatagtgttttttgtttcttactatttcataaaataaaggtgcatcttaagaatgatggcatcatagatttgatacaaaaaagtacttaggtgactcattgccagctcacagacatgtttgatgctcagttcagctgctgtgtcaaaaaaaaaagtggcatagagatataaatatgaatgtttaaacacagaaacatactaggtcagaaataacatcctgaaaaataaaatattttatttcttcacttatcttgatagtgacctcataaagtcaaagaatcatttaatcgtaaagatattcatatgtggccgggtgcggtggctcacacctgtaatcccagcactttgggaggccaaggtgggcagatcacgaggtcaggagatcaag

SEQ ID NO: 398373 - DNA, 1403 bp, Homo sapiens
gtcaccccgccccgggaccgctgtgtacgaccgatctccccggcgccgcctccgccaaggcacgtcccgggtggcgtgatgggcccgggccaccaggcgcccgcccgccccgaggccccgccccgtgtccgcgcgtggggccccggccgggcgggggcgggggcgggggcggtgccggcctccggggactggagggggatggggtcccgcatggctaaataactccttggcgcctcctgctctgctgtgccgccagggcctcccctagcgcgccttctggagaggctttgtgcggatacggggctggaggcctggtggggctgtgtccgggggctcgccgggggtgtggggaggtctgcgttcctcaccctccctccttccttccctccctccctccaccccgcgtgtgattgctcaggaagagacgggaggggagaggagggtcgccagaagttgctgaaagcgcttggatcctgatcattttcactgagtgcgttctagaaccaggagtcctacttcctgcctttacagatgggaaactgggctcagagaggtggagtgaccatcccccgagagttagctaggagtcacagcagggcccgggctgtgactaggcctgagctcttgtccacccttagaaccctagaacctgggagtccaggcccctgcgcagccccttccttccgccgcccacgttttaaccccaggtctgccagggctgtgatgtcctgggcgagggtgcccaactccaggggctgggctgatgaggcaggaatgccgggtataattattacatgcttgttaccactatcatggctgttagggcttaatgagccactattaagactggctgggaagggggtgtgagggaggagagatggacccaccccaccaatactcacaagggatccttaggacatctggatctgacctacagcctctgcatgcacccctccagctccccacctctgtctgaatggagcccacaccctcctttccctgacctccttcccctcactctctctgatccttggcctcccagttgcaggactaatcgtacctctgggcctttgcacgtgctatgctctctgcttggtactcccttcccccagtgcaaagatgtgtcttcaggaagtgccccaccctcagactttactcctttattgtagcctctgaatctgccagaatgatggagtggaccatagtccctgaaggtcagggacattgcctatgctgagcctgctgacagggcctcgcatagaatggatgctcagtattaaaggtgaatgcggggctgggtgtggtggctcatgcctgtaatcccagcactttgggaggccgaggcaggcagatcacttgaggtcagcagttcaagaccagactggccgaaatacaaaaataca

SEQ ID NO: 398374 - DNA, 677 bp, Homo sapiens
atttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatggga

SEQ ID NO: 398375 - DNA, 543 bp, Homo sapiens
cttttcagcaaggtgtttggatggtcctgtgcaatgtctttgagggcaagatggtgctatgtggactggacagtagcagcatgtggtgatttgcagctgacccttgaatgcctggacagtggatggcggacaggtgttcatccagagagaaagttccagagaagcagaggactgattaaaacagcagatacgcatcaaaacagggaggaatcagcttgggacagtcaccaggtgggaggaaaggagtccaaggggacagccgagccaagaatctgaaacccaagctgtagagactcaacttgcagataacctggctgcgagtactctgcccccaactggtggaagggaggagatggtggcgagaaggtgcatctacttctgaagtgccttgggttggagtgaaacacctcacgtcctctcacatctcattagcaagaactaaccaaatagccctgctcagatgcaaagggagctggaaaaggtagcccgcaaggagtctacactatgaagggggaatatatggaattgtggtgtttgcctgct

SEQ ID NO: 398376 - DNA, 592 bp, Homo sapiens
ctgatgttaaagaagactagccttttcctacttcaggaaaagtgtactccctacttaaaaaattacccatgtcctttctttcttgtgttactgtggataaggtcaatttggagtagactatatctatactctcacaaactagaagaacctctactttataccttatagattaggcatcacacactctatcactgatttataaaaacatgtcctaaattcaaaagttagcataggacctactggcaagggtccaagcagattttgcttttagttataacctgcatgcagcctaagcaaccgtgtaccaaagagtataccattgtctgaattgtcctaattctccggggtgtagggaatttcaggccagaattgctctggaggtgcagaagtgctaaggtttttatacaatacactcatattcctttttttcaaataaaaacattagaaagaatgtaaaagatattgaaatatcaagagaggtgaccttttgtaagcccactcatgttctcctgggaaataaagaataaagtcattcaccaccaagtgtaatattcctcacttccactcgcctgatgaaaggagtcaacatagg

SEQ ID NO: 398377 - DNA, 381 bp, Homo sapiens
atatagagaggatatatttgtttgtgtataaaaccaaatggaaaagctaactgacatgaacgagaatgagtagttatttttgacttggggaacacttcctttggcaataccatacatatttaaaatgcatgcacatgcacacacacacacacacacacaatcccagacaacgtagaagtgaaaatgctgcatttcagaaaactgactttagactaaagagatggctttactgatgagtacaatgatggtaaaggtgcatgtgataaagcatttgaaataaacttgctttgtgacaatgggaaatacagtctttccaaataatctataacatgaatttaaatacatatgtacttgaattaaacattaaatattataagcaaa

SEQ ID NO: 398378 - DNA, 465 bp, Homo sapiens
aagaaagatgaccagctctacattagttggacgtgaacacaatttttaaatgctcaagatatgatgtcttataatttcccattctaaccaactatgtcagttaacagaccacttcctagtttcaactgcgtaaggcaagaacgtctctactgtgacttcacctagtcactgtatctcagggtgcagctactggctgtcatcatgtccactctacagccagcagcctaatcagctttccctgcagggagtgcgggcagaatcagattgccaggggtctcccgggtggtgctgttaccctgggcgtgagcacaagctgggagacacacacacgtgcgtgaaacacgcacacatgccacccaccacgtccttcctctgtgccagacagtcttattagtttagggggagataaagtaataaatccttcatcttgaattcaaagttaaactaacaatttacaaaaggaaa

SEQ ID NO: 398379 - DNA, 588 bp, Homo sapiens
aggactgtgagacaacaaatgtctgttgtttaagccatccagtctgtggtccctggcacactgacatcacagggaattcccaaatctggaatgcatgagtcatgaggatagactatatttctgtaatcttcacattagcacagttttatttcttgttctaaacatttactgagtggaaattttccagtgaacttccagtcatggggccactcccgacactgcagacgcagccacctgcattggcttggagcggctttgaagggcgggtgcaggtgcactgggggaggggttctcatctccagcccgtggttcaacatatttctgtgcttaaacgagaaatttcacataacaacaacagcactcacaaagaaaccgagctggaagtatttcagttctgtcattctgcatgacctcttggtgtttttattctgtgtttcaaatgtgagactgtgaaaccagagcgaaaacggagatgtggtgctgaagctgagatgttagctcatgcatgaaagaagtcactgaatttgaatatctttaacattgaaatgcattctttttctgttaattgctttaaagaatgaatcaaga

SEQ ID NO: 398380 - DNA, 798 bp, Homo sapiens
catccctcaagacctcacccaattattatttcaaactctaaatgctgatcaactatgtggagctgaccttttcatcctgtaaataagtgttattttctccttaagggatttgccacatgaaaactttgcaaacaaggacagtgtcttattcattttgaattctccattgtgcaatttctagctcactgtcatacagaacattactatcatatttagaggctgaataaatcattaaatggataccatcactgggcccatggaattgacttacttaactcaaatccatgtgaaagtcacttaataaatattaaataccatcaattctcaattattcatggggttattattcacaacttacttgtgatatgtccttaaaggtcatatttacataatgaatgattctgcctatttcattggcataaataggttcatttaaacagatttcattatttaattagctccaatttttcctttaccatctttttcagaaggcaagattttgcttttagctgtcttgcctaaatctgaaagctcatactgatcatttccatttaataagggaagatgaaaagggccggtcaggggactgggatccaaaaggtcaagagttttccattccttcttccatcagatcttcatagtggagttttgttaatttgtgaatttagttcaatgagccaaaaaaaaacttgctgatcaaaacaaagcccctttggtagggaggaaattctgtctctttgttttctcttcctttctctctgtgcgtgagtgagtgtgtgtgtgtgtgtgtgtgtgtgt

SEQ ID NO: 398381 - DNA, 348 bp, Homo sapiens
tgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagc

SEQ ID NO: 398382 - DNA, 516 bp, Homo sapiens
aagaatggcttaaactcggaaggcagaagttgctgtgagctgagactgtgccactgcactttagcctgggtgacggagagagactccctctcaaaaaaaaaaaaaaagtaataaataaatctacaccggagaaactcactaacatagaacttcaaacaataataagagaaatgtttgctcataaaatctggtatactacattgatgtatcatcaaacaaaatttgtcaggcagggtgtagtgattcatgcctataatctcagcactttgggaggccaagggggacagatcacctgaggtcaagagtttaagaccaccctggctaaagtggtaaaaccacatctctactaaaaatacaaaaattagctgggcatggtggcacatacctgtaataccagctacttgggaggctgaggcacaagaattgcttgaacccgggaggtgaatgttgtagtgagccaagatcacccgacggcaatccagcctgggtgagaaagtgtaattgcttctcaaaaaa

SEQ ID NO: 398383 - DNA, 522 bp, Homo sapiens
tgttttaatctagtcaataatctgttacctatatgttttttcaatgtctaccatcttctctgtcaaagagtatttttatttctttgtctttttctctgacctgtgggcttggtaatcaagtctttctcaggatcactaacgtacttctatgcaattctgtgctttacagtctccagtgtgtttaatcatttttagttttctttcagtttttctttatcttgtccatctttctttatccatcaaactcttgcatttttattatgaacaattgcagacctgcaaaaccatataaaatacactacactgaacatctatatttactaccagggtctggaaattaaacattacaaatgaagtttgtctcactgcatcaattttggtatgtttttccaggatattgtttgtttcacctaaatgtatgtatctttctatgtatgtatattaatatatgtattaaattgtacatatctatgcatatatttctggataggtgtatgtaaaatattacatatgaaagccacc

SEQ ID NO: 398384 - DNA, 755 bp, Homo sapiens
aagctattgaagaatataatttgaaaaggaaggagattctttcgctgatttcttctacttccattgtctggtgaatctgtctagaaatattcctatgtatatataaatttatgtatataatttaacccacagataggatcacaaatctcagtggcttataaccactgagatttctttcctttttacacatgggccatgaggactgctgatcatatgcagccatatcaccaactctgctggctccacttggctcccaactgtctttccaggactagtagtcagcgagcagccactctctgtatcatgcatggcagagggcagaggctcagggatggggagaaagctagaccacaaagacacatttaaaacttctgcatggccaggcgtggtgactcacacctgtaatcccagcatttttggaggctgaggcaggaggattgcttgagcccaggagttcgagaccagcctaggcaatgtagtgagaccctgtctctataaaaaataaaataaaaaataaaatttctgtgtgatggtggtatacttgatgtctactcacatttcattgaccaaagcaagtagcatgaccaagcccaaagtcactggggtagcatttaacagacatttgcgaaaagtttctaatgaaagatagggcaaaaagcaaaattataagtataatagaaataaaggaagttggaaaaagcaaagacaaatctaaagaaagttaaaaaaaaaacaaacccatagctaattactat

SEQ ID NO: 398385 - DNA, 415 bp, Homo sapiens
ggacgcaggaccttgacgggcgtgaaatcagactcagaaatacttctggcaagttgtatttgttagagtggaatatgtctggatcccacagtgaactaggaacatgaaatggtgacttggtgggtgacaaaatgtgacaatcagggatgtctggcattcaagctattgaaatttaaatgggctattgcttttttagtgttggctcctgttcttagatttaaaggatttatatgaatcattcaggggctttttattaactttcagtttgtggttgagattggaattggaaggttcagaaagatgtaacagtagtttcaagtaaaggagcttaatgattgtgcctgtgagaatcatgccttcgtgccctccacggaggcacaggttgtttgtgttactggtttggtagggttcgtgt

SEQ ID NO: 398386 - DNA, 278 bp, Homo sapiens
aaagtgatgagagacaagaaaaggtatagaaaacctatttaatacagtaactgaaaacttcccaagtctgaagagagatataaaaaacatccagatccagaaagctcacaagtccccaaatagattcaacctaaaaaggtcttccttaaggtacattatagtccaactgtcaaaagagaattctaaaaacagcaggaaaaaaacgtcaagtcacatataaggaagtccctgttagattaaaagcagatttcttttcttttcttttcttttttttgaga

SEQ ID NO: 398387 - DNA, 434 bp, Homo sapiens
aaaaaaaaaaagaaaagatgaattaaagatttaaatgtaagacctcaaacttcaagaatctagaagaaaacctcagaaagaccctgtggacattggccttgggaaagaacttacgacgaaatcctcaaaagtaattgcaacagaagcaaaaattcacaagtgggatttaatgaaactaaagagtttctgcacagcaaaagaaactatcatcagaggaaacagaaaccctacagaatgggagaaaatattcacaaactacacatctgtcaaagatctaatacccataatctatacagaacttaagcaattcaacaagcgaaaaacaaataaccccgttaaagagtgggcaaaagacgggaacttctcaaagaagacatgcaggcagctaacaaacatgaaaaaatgctcaacatcactgatcatcagagaaatgc

SEQ ID NO: 398388 - DNA, 331 bp, Homo sapiens
ttaagaaccagtgaattatgttcattctcatgatgagaagagaactgaaacagtgacagaaatggaactaaacaagtttcctgccacttctatatagacctaagataaataaacctctcagacataaataaaaattattattgaatcatctgctactatcatcagtctttgtctaactcagtattcttagttagcctactgcaataatccacttccatatttgtacccctacaaactattctctacacagcagctagaatgatctttctaaaactcaaatcagaggatgccatcttctcctctcttcatcccaccccatctcagggacagt

SEQ ID NO: 398389 - DNA, 626 bp, Homo sapiens
tcagtcccttgctcaaaatgattttctagcggttctcttttattgtacaaatttgggatccagactacactctcccatatgatccctgtctattcatatttgacttaattatttaaatttaatttgataggggtcagaagtttatgacaattttaacaagtacaacttactatttgttcatgttgatttaatattcataacttatttattttcctcatatactatttaccttttttcatacaacaattcagaaaggtgattcaaacaagaaacttcacagcaggactatgtatttcttaagccaattctgtctttactgttagaaaagaactgataagccaggcgaggtggctcatgcctgtaatcccggcactttgtgaggccaaggagggaggatcacttgagcccaggagtttgagaccagcctgagcaacatggcaaaaccctgtctctacaaaaaattaaaaaaattagcagggtttggtggcatgtgcctgtggtctcagctactcagggggaggctgagtaggggaggatggcttaagcccaggaggcagatgttgcagtgagctgaggctgcaccactgcactccagcctgggcaacagagcaagaccctgtctcaag

SEQ ID NO: 398390 - DNA, 246 bp, Homo sapiens
ttgctaacatgtctgtgtcccgcaccaaaatgtggtctgatccctgaggacagggacctcctaaggccactgccatattctcatgtcatctctgagacataagcagcctctgagttaagcactctcaatccacgtcactctgcttcccagctcagcaactgagctgtgtgtcatgagaaaatccaaacatctggacaggattgggccaccacaaaatcccagcctcaggctgctcgaccaccagct

SEQ ID NO: 398391 - DNA, 510 bp, Homo sapiens
ttcacttaattgtgaagttctctgtgaggctttccctgtccatcccctttaaaatttggcatgcttctctcccactcccttatctcttcactgctttatttctttccggaccacttactgccactgcttttccacactagaacttaagttccttaaggatagggagtttttcatatcttgttcactgttgtgtttctagaatttagagcagcaccttccccatagaagactttaataaatattgttgactgaattgaatgaatgtcattgaggttttacattttcttgattattaatgaggtagagcattaatgaggtggccactttttattagccatttgtgtttccttttctgtgaaatggctgctcaaatatattgcttatttttctattgggttgtttaatactttcttattgattgatagcagttccttgtaagttcagatttgttaattactcatgtcatacatatacttatactttgtgccttaactttaagctttttttaaa

SEQ ID NO: 398392 - DNA, 1079 bp, Homo sapiens
tagtgaaataagcttaggaagtgttactgttatgtagtggtttgaatctctatgcctatcatttattggcagcttgccttgccagtcacagtaatgcttgtccattagccgtttcccacagcatgctgaatggaacgaaagctattttgtttgtagctcttatttcttgaaaacttgcccaccagctttcacatttaatgccagccacaaggatgtgtgttttaaaatatccatggctcaaactggataaagaactgaagaatctcacctgaggaaacttggcctctgtctgcgctcagaaaaggagctgcacatctgaatccaatataactttaggatttttccatctttaacttccattggttcccttcaggggaagttcacttgaaaagcgatttgagctgaaaaccgtattccagatcaatttgcaatgcattgaggtattaaatgcattgcatttgatttatagccttgtttactctgcatcaccaaaccctagtgggattcagagagaagctgaccacagctgaaaatacccagatctggttcacctgaggagagctcctatttgtatggaaaagaataagacatttcaagagttcacaaataaatgcaagcaaataaaaatcacccattccattttaatcccttggtttagaaaatgccttgactaactatttttctcttttcggcttggttaggtgtcagggtatacttttttatacacttggccttagtctccaatgtatcctacaagttgagcagaagtattctacaaatcatacagaagagtgagctttaaagtttagacactagagagggaaaaatattaggaaggtgtattagctcagattgtcataacaaaatgttataggcgagtggcttgaacaacagatttattttcccacagttttggaggctagaagttccacatcagaatttggcagggtcgggttgtgatatgggttctcttcctggcttgcagatggttaccttcttgttatgtctttatatggttgggggagagagagaaatctggtctcttttcctcttaaaggaacacctaatgacctcattta

SEQ ID NO: 398393 - DNA, 332 bp, Homo sapiens
tttcctcctgcctcagacttttgggtggaaatagagtcacgggtggtgtgatgccatcatgtcactgtagcacaagcatggcaagcatgcgccactcatttactattctctccttctaccctcgctcactgcagacatcattcatcaatcatggcacctgttggtgcagagcctacacgtgacttaataattttcctcatcataaagatccaggcacctattaacaattattttcttactagctgaaatatttattttatctccactgtagcattttaaatcattatgtacatatctacaattaccaatgtattttattaaagattctttaa

SEQ ID NO: 398394 - DNA, 455 bp, Homo sapiens
ccttgtttattttctctatggacagacaatattggcagccaggaattatttataaatcaaagagaccaagaacacaattggtaaaacaaaagtttttaatcaactaaagtaattgctatgaaatattaaataaaataagaaacaaatttttgaactccaattacattaatactttgagctatttcaggaaactatgtcagtatttcagtagcaatttcaactatttcagggagggataacctgatactttgcttatatctggatacattttaaaagttaatgccccattagaggttaagaaatgaaactttgcggctaggtgtggtggctaacgcctgtaatcctagcactttgggagaacgaggcaggcggatcatgaggtcaagagatcaagaccatcctggccaacatggtgaaactccctctctactaaaaatacaaaaatgagctgggcg

SEQ ID NO: 398395 - DNA, 472 bp, Homo sapiens
tttaatcactccatctacaggcatgtgtctgacatgcttaaggcatgtctcaacagggttagaaatttgattatagtggttattgatcatattgacagagatgattttaataaatgagattttcacaaactgtctctaatcccactttttaaaaaggggatgggggctgggcatggtggctcacacttataatcccagcactctgggaggccaaggctagaggatcacttgagcccagaagttcgagaccagcttgggcaagatagtgaaaccctgtctgtagaaaaaaaatttttaaattagctgggtgtggtagtgtacgcctgtagtcttagctactggggagatagctgagaggatcacttgagctcaagaggtcaaggctgcagcgagttgtgaccgcactctagcctggacgacaagagtgagaccctgtcttaaaataaaataaaataaaataaaataaaataaa

SEQ ID NO: 398396 - DNA, 719 bp, Homo sapiens
taatgaattttttctggtgatgtaaatatatacttcctagcctatttatgaatttcacacatggagttttctaaaagcagggcgtagtggaattgaatcttctaagaaaaatagcaggcactttgagatgacaggaactggttttcttcctcttgtttttctcagtctgtgttgtaggtgctgtaattaaaaaccaggctttggaacaggtctccactggagtggtcttgagtagacttacaaatggctgcaatgcttccaatggcagttgatctgtgtgagccaggagtggggtagaaatctggggactggaatttcagtctgagttcaggattgctcatctgcaactggcaacaatggcctcttcctcttttccctgcacagaaagtggtctgtgaaattaaagtggagaacagctgctaggagctcatgctggggacccacagtggaggccacattttgtgatcccagagggattcccaaacccacctgacagctgctccaggccttctctgttctcctgatccctgccctgatggaggcctgacccatctggccagagtgccttcaactcccaccttgaaatacctgtcaccgcccacatccctggccttcctcaggacttagaggttgaggggcttgtctttcccgcttgggcccttccctcccactccttccgtcttctgggttcctgatacctgagcaccctcatacgattc

SEQ ID NO: 398397 - DNA, 369 bp, Homo sapiens
aaaatacattgtgggcaagcaccattgttgcatcaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacggaaccctcacccagaatgaatgatattaac

SEQ ID NO: 398398 - DNA, 723 bp, Homo sapiens
gtctgaggctgttgtgagctgtgactacgctacagcactccaacctgggcaacagagcaagattcctgtcattcattcattcataattaaataaatagaaaatcatctctttcaaaaagttcacagtcatgggaacacttatacctaaattagaggtccaggccagttcatccatgaagcagcaactataactgaagcacgccaaattgtggaatggagaacatatgcccagtctaaaggatgcagccactacctgacaccagcactcccatgctctgggagaatgcaaactcagtggtgtcacagcttctgattttctgagaagacagaaactttgaggaatgaacatttaacctagagaaatcagggaatgcttagcaaaagagctaacatttgaatcgagtcctataaaggttacgcagagtgtactaggtgtgaatgcagatgccttatttcctgtggctacagcttagggtggaaagtggggagtggcaagataagcaactagagaggaaagaagccatgcacaagctaaactctatgcacagaacacaagaacttgttgaagaagttactctataatacaacatacaagagcagaatttatctgtctgcagaaaactctaccaaactcccatacagtgagatttcaaggtttggtagacatacaaagaggcaggtatcttgcttttagtccataaagctagactggacactactgta

SEQ ID NO: 398399 - DNA, 206 bp, Homo sapiens
tgggtgacagagcaagactctatcagaaaaaaaaaaaaaaattccatctaactctaccagactgagttcttcaagtaaaataaaaacaataaacaaacaaacaaacaacaaacaaaaaaaaaaccctgaggctttcaattatccagcacactctgaacatggttttagtaaatattggttgaaatgaatgtgaaataaatgaaaca

SEQ ID NO: 398400 - DNA, 448 bp, Homo sapiens
ttctttactcactctactgattcaaatggtaatctcttctggaaacttccttacagacatgcctagagataatattttaccagccatctgagtatctcttaggccagtcaagttgacacattaaatttaccatcacagtctccttactcattattggtttcttcagattttccatttcttcataattcagtctttccagaggtggaattcaccttgcttatcattagcatgtgtattcagtcaacattcaggcatgatggtgatgtcagaaaactacagattatccacatgggtggctgagatagtgatactttggcttactgatggttcagtgtatacaaactttgtttcaaactttgcattccaaaatctaaaataaaaaatactctggtcccaagcattttgggaacagggattctcaacctatattcagagagagggggattaa

SEQ ID NO: 398401 - DNA, 662 bp, Homo sapiens
ggaaactcaatgagatccaagacaagattaaaaatcataaaagaaaccacaaaagcaattcaggaagtgaaggaagagataaatttttttaaaatatcaatcagaacttctggaattgaaaaattcacttaagtaattccaaaatacaattgaaagcttccacaatagactatttcaagccaaaaaaaaagaacttcagagcttgaagaccaatcttttgaactagtccagttagacaaaaatttaaaaaagaatgtaaaaaaaaaaacaaaatatgggattatgtaaagtgatcaaacctatgacttatgggcattcctgagagagaagaaggaaaagaaagcaagctgaaaaatatttgatagaataattcaagaaaatttctctaatcatgctagagagatagaaaatcagacaaaagaaattcagagaacacctgcaagatactatagaaaatgaaaaccaccaaggcatatagtcaccagactatccaaggtcaatgttaaagaaaaatatcttcgcgcctgcatttagcagctagagaaaagaatcaaatcatctacaaggaaaaccaatcagattaacaatggacttctcaacagaaatcctagaagccagaagagattgaaggcctacttttagcttccgtaaagagaaaacag

SEQ ID NO: 398402 - DNA, 374 bp, Homo sapiens
agaatacacatgactacctgatttggtttcgctgtcagcagataccaccccagagttactctcatggtactgaaaggcatagtcccgaagcctctggttgagttcttgaaataagtagaattttatatttcatattagggagagatctggttgccaaaagtgacacggttattttttaaattcttagataaggtactggatcaagcctctcttttgataggtgtggtaaagaattatactaaagaaatagcatcttgatctataaaaaagtatatgatgccttttaatatattggatagtcaatctctttatgattctctatttctctgtataattagttatatgtatttctttatttttgaaaaattgttcag

SEQ ID NO: 398403 - DNA, 390 bp, Homo sapiens
tctgtgaattcctgacactgaggtttattctattgttattagaactctcatttctttaggctgtttgagtgcatttctgtaaggcatattctcagaaactccagtgaacttttgttcaaggcctgcaagatccttcctggagatcctcctctctgaacaatgtattgcttaggccaaaagagtaagatataacccccttttggctcatcttaattccagcaaactgaagataattcctgctacagaattcccagaaataaatttaccaaaggcttatttagctggatggcttaccttaatttgcccatctagttacgtgttgtcctattggacatctcatttctctatgtcttatcaaatctttgtgcgtgtgtgtgtgtgtgtgtgtgt

SEQ ID NO: 398404 - DNA, 163 bp, Homo sapiens
aatttttctatttcatgctgcacaattggaatggaaactgtcctaaacaatgtgtcctctttccaaaacacagagctccttatgaattctaattctttgagataaatttctgagctccagtgcccagcagcagggcttccctagagattgactaacgtcttac

SEQ ID NO: 398405 - DNA, 524 bp, Homo sapiens
aagcttttctgactggacacgatgctgctatttaataataaacttttttgatcttaaaagaatccagagcaggtcccccaggagcaggttcgtggcgtatcaccagtggggaaggcttttctcagaggctctgaggcagtgtctcaagaaaggggggaggctccgctttctcagagttgcagtgctcaccttgctgctgctgccacacatctgtatgcgccttcctggtacatcaccatcaccacaggctctcatgatagtgagggcttgactccttcgggaacctcagtctccccagctggaagtaggagccataatgcctccctttcaggcttgttgggacaaagagatgaggtcacataggtgaagcatcagcaactgtgcctggcacagaggaggccctgaaagttgccaagctcagcgttttccttcacatcagctctgctccaccccctttaattactcacttttataataattcaaaggtaacccatgaccatggtagaaaaattagcacatataag

SEQ ID NO: 398406 - DNA, 296 bp, Homo sapiens
tttcatctgaaaatttcaagcaactttgttcaacattaaattgacaatctaaactaacaagtcttttgaatttatgcatggtagtaaacattctctctattaactgtattacctaaggctaaacctaaaatttttaagcaaaattagaaaaatagtcttcactcatcaaaaaataaagtttgttacatttagtattttcccaataaaattggtcgttcttggttttttatttggagagtctgtgcaaaatgtcactaaaaataaattagcactagaaattatttctaaataccaaa

SEQ ID NO: 398407 - DNA, 265 bp, Homo sapiens
cctgccagtcaagatgtgaagtttaacctgaggacatgcagctgctgttagctatgccaccatccctctggcttatgagatagaaagttattattactttgaggattaaaaaagttatatccaagcattaattttttttgtttgtgtgcaggtggagactgttttcttactaaaatattcaaaacaccatgtcactctcctttctctttgtcctatggcagaaaacaccagctgaagagacatttgcaaagctccgtgcccctcc

SEQ ID NO: 398408 - DNA, 227 bp, Homo sapiens
tgtagctttatgtatgggaggaagtgttttgcatcctgagggtggtggcctgagctgtggctgagtctcaaggctcatggttaagcagtgacgcttctgtggcctgtgaataccacttgcaatgtggacacattggtgggtgagagttactctgagcagagccccaccgcctggttcaaaagttcatgggcccagaaagagcaatgatagtgtagagactcaagaga

SEQ ID NO: 398409 - DNA, 297 bp, Homo sapiens
ccaagttataggtgcctggccagcctgtgggttggtgcccctgggtcaggtgcccactcctcttgtgtgctaaggattctgagcatgacaagctgtgtaagcaacagtctggagtcactttccttggaggttcaggggagaggaggagaagataagggatgagaatggaatggttagttctagaagggatcagtgagcccgctgatgttttcctatgaaaccattgttgttctctccatcacaagtctttgctgagtgctaccctttccttcacacctcttccaaattttctgtctc

SEQ ID NO: 398410 - DNA, 208 bp, Homo sapiens
aaaaaagccgggggttgggaaggataacagctgctggaatactgggggaaggtatgagagggaacaggtcagaatgaagcctgaggctgaatggagcttcaggtgctgccaccctcataggtgtcaaccctaaggagacatagcggactcattagtatgcccagtgatttcttgattgaagttttctgttaactgcatcctaaggaca

SEQ ID NO: 398411 - DNA, 508 bp, Homo sapiens
tatttttgtcggttttgatagatgtttatcaattgattgattttttcaataaaccagctttttgtttcacattttttctgttttcaatttcatgaatttttgttattgtcatgattatttttcttcttctgcctgctttcagtttactctgttctttttctagttttttgagatacaagtgtatgttattgatttgagatcttttctcatttttaatgaagcatttagtactataaatttctttcccaccacagccttagctgtatttcctatattttgatatgttgtatttttctttcatttgtttaaatatatttttggattttaatttaagactttatattgtatccatagatcatttggaactgtgttgtatagttgaaatgcatttctattaatatattaattatattaatatatcttccttctttcttgatgtgcaaaattccttttttttctttattttgtttgaataacagttttagtaaacatttaatggtaagcttgc

SEQ ID NO: 398412 - DNA, 583 bp, Homo sapiens
gttgcagggatgatcaaggaaaaaagggacttggtttggagcagagaaggtggttgtctccttggagcaattcaggtggaaaataagatctgtggctgggtgcggtggctcacgcctgtaatcctagcacgttgggaggctgaggcggacgaccattttggctgccacatgaatggtggacggtggaaggagcctgctgcagaaacgaggagggtttgaactgagcagaggccagtggagacagagaaaggcagatgggttgcagatatatcttgagtcatacatatatcttgaattcacaggttttgagatctgatagaatgtgggagagaggggcaagggcgagtctgggatgactctgaagtttcttattgggcaacaacttggtaaaaggatggcgatgccacttcccaagcatatgaagaggggtgaagcggggcgagctgcaggacagtgtcgacaggatgtgtttgggggatgctgctttggaggttcctctggtacctgcgatggatctgactgtaagacaagtggatatccattccagagccagagacacagatttaagaagcatttgcaaaga

SEQ ID NO: 398413 - DNA, 466 bp, Homo sapiens
aaaaccacaaggaaaattccagacccagatggcttcaccagtgaattccatccaacatttagggaagaaataataccaatttacataaatttttctagaaaatagaggaggagagaacacttcccaactcattgtatgaagtctatataatcctaatatggaaacctgatgacaggcatctctgaaaaatctataggtactcacgcctgtaatcccagcactttgggaggccgaggcgggtggatcacgaggtcaggagatcgagaccatcctggctaacacggtgaaaccccgtctctgctaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaa

SEQ ID NO: 398414 - DNA, 376 bp, Homo sapiens
ccaaggctcctaaaagctgtatccatcccagtagtaaatgttaacagattaaaactagcattgaaagagttttagaatgtcttctttcatctggatagcccaggatatttcaatccttaaacatggattaaagttatcttgaaaggccagcacatccacgcacctgggaggcaaatacaaatcacctaaggaggaagataccctcattcttgtcctcaaattagctctacaaatagttctttaaacacaatatccagctcagaaaggcaaccatacagacaacacaaatacaaagatggaagataaactaaaacatacccacagaaacaagggaaaacagaaagaccaacaagaacttgagatattagaaataaca

SEQ ID NO: 398415 - DNA, 443 bp, Homo sapiens
aatgcaaaatgtatatagaaaatcatgagttcctgtcatacaagaagtttgtttcatttttccttatactcacccaaccaaaggtggctaggaatgaggtgaataggtgagtcatgtatacaggtgttgttgataaaattgttatctattcccaacgctgcagcaagagatgagacatgattctgttattaaggctaaaatactgcatttctagcaatttttctcctttctgatatccccttacactcaagtgtgcagtacttaaaatagagcctggattgcctataattgtggcttttttcaccctttcttggctatgaaatagttcatttcatacctcttggctttatacaacgatgtattgaatttagagaaggggcatgtgctatcttgcccacttacaaatgtagttctcggccattctatgttgtcggattataact

SEQ ID NO: 398416 - DNA, 422 bp, Homo sapiens
atcgggggatgcagatgaagctccgggacatgcggttctctgtcatacgcacccgatcaaaggtggctaggaatgaggtgaataggtgagtcatgtatacaggtgttgttgataaaattgttatctattcccaacgctgcagcaagagatgagacatgattctgttattaaggctaaaatactgcatttctagcaatttttctcctttctgatatccccttacactcaagtgtgcagtacttaaaatagagcctggattgcctataattgtggcttttttcaccctttcttggctatgaaatagttcatttcatacctcttggctttatacaacgatgtattgaatttagagaaggggcatgtgctatcttgcccacttacaaatgtagttctcggccattctatgttgtcggattataact

SEQ ID NO: 398417 - DNA, 384 bp, Homo sapiens
cattgcacacattgaggtcatgcatagtggaagaagatatattttgaaaaggaaaagaaaagcaaaaatgttgaaataaaagaagaaaaagtaaaaccatctagaaatcctgggtaacatggacagagaaaagaagagtcatgcaggattttggaagtttgggcttaacagtcaagggaatggaaaggagagattcaggaattagctgcattctgcatagaatcaattgagaaggggttagagagagagaggattttaagatagtttgctgcattagggacatacttccctcagagactgtgtaaagatttgaattatggatcgtgactttatgatgtcttcactatgtgtctctgaatatgatccagtgtcaaaattcatcac

SEQ ID NO: 398418 - DNA, 263 bp, Homo sapiens
gggagctccccagaggtccccccacaacactcccacccttagacttctgcatatggctcaggcttcaaacctggccatcccttgttgccagggaggctgagcagatgaacatgtggctttcaatctctatggcaaggtgaggtgaagggggcagaagctggaggggcttctgggggtgctgccatatctagagagcttgttggcttgcagacctccagttcccctctgttactgcgtgtgaggctttgtggaagttattttga

SEQ ID NO: 398419 - DNA, 406 bp, Homo sapiens
aaaaattctgagtaatgaattagttattgagaccactttctgtctaaaccatgctaggtcctctatagggagttgaacaaaatgtacagcattgttctcccagaccaaaagctcagaggccaggcgaggtggctcacacgtgtaatcctagcactttgagaggccaaagcaggaagattgcttgagctcaggagtttgtgaccagcctgggcaacatagcaagactttctctctacaaaaaatttaaaagttaaaaatttccaggcacagtggctcatgcctatagtcccaggtactcaggaggctgaggcaagaggattatttgagcccaggagtctgaggctgcagtgagttatgattgtaccattccactctagcctggccaacagaataagaccctgtctca

SEQ ID NO: 398420 - DNA, 181 bp, Homo sapiens
tctatgaagtctctcgccctatagacaggtgctgaatgaacacagcttaggagtctgaacatgatttaattcaggcctgcaaagaggaagactcaccagcccttgaatgaacatcactgggaaaatagcggatatggtggtgtagtgagggacctgagactagaagcaggcagcctgtttg

SEQ ID NO: 398421 - DNA, 349 bp, Homo sapiens
ggcctctcaaaggacaggaggttttgctcaagcattgatttactccagcaccccaagagagagaaaaagcatcacttgtacgttttcaaagtcatgtactgtgtgtgtaaaaattgtaaaataaaatacagggcatcagagagatttctctatggctgtgtgtggttttggcatatgcttcaaggtcttttctgtaatgtggaatatttagggggaaaaatataagaaatgctgacataatggaaagcatttgggtactaggatcagccaaacccaagttcaaatataacttctgccactaactacttgtgtaaacataagtaaattagcctctccaagtttcaatgtc

SEQ ID NO: 398422 - DNA, 420 bp, Homo sapiens
tagatcacctttaccaccagtgggctttggagagcttatctggtgcatgcaacagccacaaaaagcatcctttctgaggagtgggcccagccttcaagaacctttggtactatgggaaataagaatgtaccatttccagaaaacctggctgggaactcccctcttccacccgcatatctgccctgcctcccccaacacaggctcccctccaccgacccccaagcccccaagaaacgctgccagcaatggagtcaaatgccccacgtctgtggtccttgagtcgacaggacacactcaaatcagagccctcacccccaatgacaggcaaatcagctgggcctgtgtttctcctttactcgcctgacctgccccaggcaaaggacaccaggacaagacattggtatccggcagggctgcttt

SEQ ID NO: 398423 - DNA, 390 bp, Homo sapiens
aaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctgcaaaggaaggacaattactttatcacagacttctcttcatcaacgagaacagacaatacaggaataacatctcccaagttgtgagggagactaacagatgacatgaaattctacgaccaaataaagcataattcaatgggcagcagttaacagaattaagctgtttccagacatctatggagagatttaactcaaagatgtca

SEQ ID NO: 398424 - DNA, 827 bp, Homo sapiens
tgtagggcagaatggctaggcactggcatgcccattcatccccaaatcgggccttgttgaatgtggcacagctccagctctttccaaacatgactcctgccagtccctatgctgtgagataagaatgggctacacctaagcaaagttttgtaggcagctctcccttcctttatgtgcttatgcaaccttttcagcacgttggtacctacgtgtcagggacaatgtgtgattttggtggagatgcttataatccaaagtattttcatggtggttccccaaacaacactaggctcagatttcagtttatcctcctaatattaatgttgtattcaaggatagatttttccctcccaggtgtgacttctactctttctgctccccctcccacaagcagctggattttgcaaaaactcatcaagctacaggttgtcgaggcctaaaacattcttatttctgttgagcttatgagaggtatgagcataattgtgtttttaggtagtgatgtggaatgcaaattgaattttcggaaatactgggaagtacttctgaaggaggaggtagagagaaaaaacttttcattgtaactgtgacctctcccttcttcagcttaagctaaatttagtgatacatagaaaaagttggggcttatgatattgaattcatttcccaagcatactcattgtttgtaagaaatgcaacaaagttttcattttttaataactcggcaaaggtactgggtacaggggacccctttgccctttcattgagaccatttacataagtttttgtagtttctgtaacttttattattttatgttctctctcat

SEQ ID NO: 398425 - DNA, 500 bp, Homo sapiens
agaaagaactaagaacactggcttgggagtcaggatacccaagattcctgtcataaccgtggtgtgtgaccttgaccaagcctcatttgtatctcctgtgaaatgaaagggttattagacctttaatatctaaggttctttctggctacaaaagtctttttctacaaagtcttgtgttatggtttgaatgtgtccctcaaagttcatatgttgacctccaatgcagcagtattgggagctttaagaagtgtttaagtcacaagggctccaccctcacgaatgaattaatgccattatcttgggagtgggtttgttatcttggggctgggctccttgtaaaaggctgggtttggccacctcttgcactgtctctctctttacccttctgccatgggatgacatggcatgaaggccctcgccagatactggcacccagatcttgtacttcctagactctagagctgcgataaaataaatttatcttctttgcaaaaagccta

SEQ ID NO: 398426 - DNA, 1163 bp, Homo sapiens
acacaggttggagcagagaaagaggaaacatagaggtgccaaaggaacaaagacataatgatgtcatccaagccaacaagccatgctgaagtaaatgaaaccatacccaacccttacccaccaggcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttctcttttagagaagtattaggttttgcctctactgctgttattggtggatacccattctggggtggcctttcttttattatctctggctctctctctgtgtcagcatccaaggagctttcccgttgtctggtgaaaggcagcctgggaatgaacattgttagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccacagcccattttgccaaccaagcaaacaccacaaccaatatgtctgtcctggttattccaaatatgtatgaaagcaaccctgtgacaccagcgtcttcttcagctcctcccagatgcaacaactactcagctaatgcccctaaatagtaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcattagaaac

SEQ ID NO: 398427 - DNA, 320 bp, Homo sapiens
ccaccaaagaactcccttatgttacttttttgtatttgtgtccctgcctcccccatctccacttctttcccttgcttactcctaatttgttctctcatttctatagttttgtcatttagagaatgttataggaatggaataatacagcatgtaaccttttgagatggactgttttttcactaagcataatgcccttgacattcatcaaggttgttgcatgcctcgatagttcatatctttgtattgcagaattatattgctttatatggatgttccagagcttgttcaaccattcactcattaaaggacatttgagttgt

SEQ ID NO: 398428 - DNA, 339 bp, Homo sapiens
agacccgagtgcctttttaagttcaggttttctcctccatagtgtcaggaatagaaggtctgagttttcctctgagccattatgcagagcagcctttggtcaccaattacagcaaaataaacattccttacctgctccagttggtaagccgtgctttggcagagagccctcagagtcagagaaatgactgaagaaatgcttagattacaaagcactacaagcagctcacaagtggagcacttaatgaaatgatttttcagtaaagctttacatcagaaaattaaccagagaccttataaccaaacacacaggttttcctctttttgttcacatttctca

SEQ ID NO: 398429 - DNA, 479 bp, Homo sapiens
atttttagtagagacggggtttcaccgttttagccgggatggtctcgatctcctgacctcgtgatccgcccgcctcggcctcccaaagtgctgggattacaggcgtgagccaccgcgcccggcctaaacccatgttttaactgagcatcaggttggggtccaaaccaagaagagctgggcataggagttactttctcagtgctctgagagtagcacttttctacataccacaggtgtactgttatggaggcctattttgtagggtaattttgcataaagtttctgccccgagactcttgaggcattatcctaccatttattcagacccaggagacaactgctgatgtcatgaggcacattatgggcttccctggaaccctaacccagcaaccagcttttggtgtctagtctcacactcattttctcccacttgacttgtgttctcaaccagagcgctagcgaggggaactgtagatgag

SEQ ID NO: 398430 - DNA, 261 bp, Homo sapiens
gtttaagtccaatctaaattttcttttatttagctaagattttcttctatgtcagatgacagttgagtcttctcaatgaaggtgaggcttatagggatgaattcactgcaacttccatcccccaggttcaagtgattctcttgcctcaactattggggaggctaaggtaggatcacttgatcccaggaggcggaggttgcagtgagttgcagtcacacccctgcactccagcctgggtgacagctagaccctgtctcaaaa

SEQ ID NO: 398431 - DNA, 483 bp, Homo sapiens
agcttcttcaaagagtggggatccacactggcaccactttctaggcccttttcccttcctccaccaacttcagtctggattcttgccccaccctccgtgacaactgcttttgcttttttctcctgtgggtattaccactggaatttctgctgccaactccaaaggatgccattctgtcctcatccaatgggacttgtcagcagtatttgccatgattgactgttctctccattgtccaagtaatcttatcttgaatcctatgaagcaccttcgttcttcccttctttctcttctctgaaggctgattctcttcctctgggccatttgaaagcttgcttcaagggtcagtctttggcagtctctttgactttacacattcttcttaggaggtgccatccacaaccatggcttcatgtgatttaatatactcagatcacacacaggttcttatatccagcccagacttctctgaattctaaacct

SEQ ID NO: 398432 - DNA, 210 bp, Homo sapiens
tgaatttatcagtgtatcaaagagaagttatcctggacaagcgggtaaggaagacttaagattattgcaacagggatcaagactattgcaagaggagagagagagagaactgaactgtgctgaaacaaaagaagagttattgataactggggtgagcaagtggaaaagtattagaaaacttaattgggtaacgttggtcatcctgacgag

SEQ ID NO: 398433 - DNA, 551 bp, Homo sapiens
tcctctccttacaaagccactggtctcatcaggggccccaccccaatgacctgatgactaggtctctgctcctagttacatcccaaaggccccacgtccaattaacatagaaatttagggggttaagcttccaacacacgaaatgtaggggacacattcaatccacaaaaatatgtaaaggcaatttatattcaataaggcaatacaaaaaagtaaaattctgaagacaacagttatttcccaatgccttctgagtcactctttgtggttaagataaacaccgtggtatccaggctttggtgcaatttcatttcctcattagctattttttacaaacactgctaggcttcccgatgctcacacagggctggacaaacagacgatcagagaaacaccatacagtgagcctgggaaatgctgaatgtctatgtgtgcaacaaggcatgcgagcaaaaacaaaaccgagatgggaagggattgcaggaggggaggaaggggctgtatctgccacgtatctacacagccgacattttaattttttttagacagcg

SEQ ID NO: 398434 - DNA, 327 bp, Homo sapiens
attcatttatgttttatatgccctttaaacaccatagcctgaagttaatttaatataatatttttaatagttttgtgcatgaaacaaagttttgactgtttgactgtaacccattacctaaagtcaggtgtggaattttccacttgttacctggagtgcatcatgttggcattgaaatagttttggattttggagcatcggatttcagatttttggattaaggatgttcaacctgtattagatagcctggtgcttttctcctcataatcactccaataataatgaaaggataatcataaagatgacaacaattacaacaaagatgat

SEQ ID NO: 398435 - DNA, 403 bp, Homo sapiens
ccactaccggtttccgcgtctaggtggtagtggtcctccgggcccaactgtcttttcttctatctctttgtcttgtgtgtttatttctacgatctcttgtctccgcacatgaggagaaaaaccacagacccagtagggctggagcctatgctcttatttcttctgagagtgctggcatcgatcagtcccaagaggctctgggtgccttgccacagtgacatttctagatgcaaactacctggccatggcaatgagaggaggtgaccccacccagatctcctcggccctgcttgagagcactcagcggactgccctctgacctctactggaacaggaaaaggatgaagccttctgtgctgtgtcctcctgcacaggcttctaggaaacttgggaatcctttatt

SEQ ID NO: 398436 - DNA, 500 bp, Homo sapiens
cgagggcgcgcactggatcccaggctcctccgagagtgcggcgacctcggggctccgccggcgccggaggtggctctgagggcagggacgtgttggacacgctgactttgtaggctccgccaagaggcgccgcaggaggacttccaggattatgttgaatggaagtggtgagagtggacatccttatcttatttctgatgctagaggaaaagctttcagaggcatcctttgggaaaagcgatcaccttctccagatccgcattcaggtgatctttgccaatctctgactgagcctggtggcacatcacttctatctggccttgacctttgaggcagcaggatgactgcagggagtaggcagtgcttccatctgtgaatcacaaagcagatcaaccccaaagcagccacctgcacatgtggtacatcttctgcacctccatagacacttttacctaaggccagatgcatgtacaataaacttaaatccattgacttttcaa

SEQ ID NO: 398437 - DNA, 538 bp, Homo sapiens
aggcttgtcagagtttccaagctaactacattgtatatctcagatgagagaaaaagggtttctctcgttaattaagaaattcctttggagattaatgaggacagaatgcaggatgtacaagagaatattctcaaaccaaacagcttttaacctgggagaataaagagacccaaagggctagtctttgtctagagcagagaaaacacagaagaaaatttaaaaatattcctccattccaatatttgtataatcttgaggaaaaggcctttttaagcaaaagacaaaatctttaatccagaggatatagaagaagaaaaagatttatgtttggctacataaaaattaaaaacagcatagtaaaacatgtgactaaaatgttaaaaagcaaagagcattctggggaaaaatatttgcaacacttaagattggcacatatatttcttacaagtaataagtccaacaacttaataggaaaattggcattctactgacactcgtttgaatttgggaaaaaagtttttttaaaaagaaaattggc

SEQ ID NO: 398438 - DNA, 428 bp, Homo sapiens
aaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaagtaatttatttcttgtggtgtatggctctctaaatgaattaattgataggcatccccttgtcagtctcagggatgtggaaataaaacagacatgagatgttttttaccaaactaatttgtgctttaaacacataaataataaatatatatatattaaagt

SEQ ID NO: 398439 - DNA, 537 bp, Homo sapiens
acctcaagtgatccacctgcctcagcctcccaaagtactgggattacaggtgtgagccactgcacctggccaggcgactgctttttgtaataagaataataatcccttatttatgtaatgctttgtaatttatcaagtgcttttacataaactctcataattaccacaacaccttttgataaataaatagggttatattaagaatctttgaccagtgagcagaaatcacttacacagagtcacagagcaagaaaataacaagccaggactagaacctatgtttctggctgctggtccagtattcttggtactatgttacatatactgtcaacttagccagcttcccattcttaaacctaactgcagatttactggactactttttaatggtctggtcactgaaggacttacttttatgaatattacttagtgctgtattattcagggttgcacagacttgatagctattcatgtatttgaatagccatcttttctttctttgaggttgtatcattcctttctggtagcttgtgttgc

SEQ ID NO: 398440 - DNA, 448 bp, Homo sapiens
cgccatccaatgtccagcttcagcgtaggacttggtgtccgcaagaatgaggcccacatccaggagcaggccagtttcacgtgaagcccagggctgaagccagaggccacgcagcaccacgtcggacagtgtttatctgtgctaatcatgaagtaacacaagtgaggtttaaaaatactacgcttatttcatttcagtgcaggagggagaaagaacacacagtctgtatgagcaactcaaatcaaaaataaatgaggcaaaagagtcaccaaaaatagtgtggcattagagacagcagcctgcgtggctcggccagctgtcctcggctctctgccggcaagcagcaccacagagagggctgcgaggatgccttgatggtgtttactccagagaagatgaacctgatgcctgcgatctgatgagaagtcacagttaccagcagggaagg

SEQ ID NO: 398441 - DNA, 324 bp, Homo sapiens
agcaacactttgggtggccaaagcaggaggacatttgaggacaggagttagagaccagcctggacaacatactgagaccccatccctaccaaaaaaaagtaaactaggtcatgagggttccacccccatgaatgaattaatgctgttatcgcaggagtaggttagttattgcaggagtgggctggttatcgcagagtgagattctgactaaagggtgagttcagcccaatttgcttgctctgtcacatgcttgcttctgccttccatcttccaccatagaatgaccctcaccagagcctggtgtcatgcgcttggacttcccag

SEQ ID NO: 398442 - DNA, 449 bp, Homo sapiens
tcacccccagaagaaatcctacacttacgggttttcccttgtgtataatacattgcttttctcttgctgctttcagaattctttgtctttaacttttgaaattgattatgatgtgtcttgatgtgggttgctttagatcagtcttattggtgtcctttgggcttcctggatgtggatttgtatttccttccctgggttgggaagttttcagtcattataggtatgcgttgcttaccaacagggatacgttctgaaaatgcatcagaaggtgaatttgtcattgtgtggacatcatggagtgcacttacacaaatttagatgggacagcctactacacagctaggctgcatgctatggccactgtgctcatgtggtctgccattgactgaaatgttgatctgcaactcgtgactgttatttctttggataagctttccatctcttctcac

SEQ ID NO: 398443 - DNA, 295 bp, Homo sapiens
tcaataaagaaaatagataatcacattgaaaaatgatggttatagtgaaaagtaaactatataaggtaataagactaatttcttgtgtggctcataaactggggctttaaagagtctaaatatttttgagtaatagcataattggaataagcctagagtccccaaggtgacaatttcaagggacaacacacttaagtaattagaattttggaatgcatgttttaaaaaatcagtttgcttgatttaatgagatatatttattcattcattcaaccagcctttattgaatgactac

SEQ ID NO: 398444 - DNA, 402 bp, Homo sapiens
cttggataaatgttttcagtgtttgtagcaaactaggaaaaccacttatacacatttgtaaaatcttccaagcatttgtaatttgcttgaccctgaacatgttatcctgttcaatgtgatttctgcacagggatttttcaatcaaaataagacatatgaaacccagaaacacatttcacaagcactttagagtttcgagatgttttttgtggggcacacagtaaataaggaaatgtcattttctccatttctttcgtgatacgtcacacttttaaaagaaattatttgggatggatgaagagagaagagtttggagaaagggaaggtttttgtgcaaatattataaaaccaaaaaaggttagtatcagggtcaggttagcctatagcactgtgaaagagaaa

SEQ ID NO: 398445 - DNA, 859 bp, Homo sapiens
ggcgccaggcccgctggggcaggtgtcccgtggaaatcgacggaggggctgccgtgggcggccgtgacagtcacagagaggggaagagaaaacagggacggtgacacacacagagagaaggaagagcagacagaggcacagcaggagacccccccaagcccgaggaggacagcctggggatgcagagcacatgccggccccagtggagggaaccgatttccccggagccgggaggcaagcctggggctcccctgccctgtccctgccggtagcccccccagccgtctccccaccatctgtcccgctgccgtcccaccaggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcggtgtggagggtctcgggctcatgcttgtccacttgagattgtcgctggagaggtctcggtgtgccggatgcgtctgaagctggcgctgatgggttcggcctttggcaccgaag

SEQ ID NO: 398446 - DNA, 2047 bp, Homo sapiens
ggcgccaggcccgctggggcaggtgtcccgtggaaatcgacggaggggctgccgtgggcggccgtgacagtcacagagaggggaagagaaaacagggacggtgacacacacagagagaaggaagagcagacagaggcacagcaggagacccccccaagcccgaggaggacagcctggggatgcagagcacatgccggccccagtggagggaaccgatttccccggagccgggaggcaagcctggggctcccctgccctgtccctgccggtagcccccccagccgtctccccaccatctgtcccgctgccgtcccaccaggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagtcgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaatacaaataaaaaacaaatct

SEQ ID NO: 398447 - DNA, 2406 bp, Homo sapiens
ggcgccaggcccgctggggcaggtgtcccgtggaaatcgacggaggggctgccgtgggcggccgtgacagtcacagagaggggaagagaaaacagggacggtgacacacacagagagaaggaagagcagacagaggcacagcaggagacccccccaagcccgaggaggacagcctggggatgcagagcacatgccggccccagtggagggaaccgatttccccggagccgggaggcaagcctggggctcccctgccctgtccctgccggtagcccccccagccgtctccccaccatctgtcccgctgccgtcccaccaggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccgtcctgctggcagcggactggcccccagtgtcaggcaggaggtgacccaagtattctcaggccaggtgcggggacctcctcccctcctggggcctcagtctcctgtctgttaattgggcgtgggggcctccgaggttcgagggctgcgaggctgtgggtggcgggaccgctgactctgtaagatgagtgtaaatctctctgcttctcctaatccccatcagcagagctgcccactctccaggctcccagtcccctggaaataacaaatagcagcagctcccgcgagcctggtctcctctcaccgtgtgctcgccatgtgagcactcccctctccgttgtgccctggacctcgggcacagctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagtcgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaatacaaataaaaaacaaatct

SEQ ID NO: 398448 - DNA, 207 bp, Homo sapiens
tataaacatacaggaatagaacataaatgacttattgctacaacagtaataaaataatacatgatctgtgttttcagaccttacggccagtctagatgatctgatagtatgaatcttagaataaaatttgaagctaataaaataattccagatagaatagatggtatttcttattgggacctaaaaaagtcatttataccaaggagg

SEQ ID NO: 398449 - DNA, 338 bp, Homo sapiens
aaatttaccacttttgcatacttattttcattttattctattttccagtactagtaccatatatttatgttgtatagttgcaggatgtgctgctattttatatcccttcttttagaaattgaatcaatatcttccatgttaattttagactttttaaaacttttttatttcacaaattataaatattcattcgaaataacttagatgatacacttaattatgaagaagcaactgagaatgtatgtgtaattttactgcccagagatagatggacagataaacagataggtaggcagatagacagatatgcatacatacacatatatacatttggattg

SEQ ID NO: 398450 - DNA, 446 bp, Homo sapiens
atggccctaacagacatttacagaaatttctatccttaaactgcagaatatacattcttattcttattacatggaacattttctgagatagactgtatgataggccacaaaacaagtgtaataaatttttaaaaattgaaattatatcaaatatcttctcagaccacaatgcaataaagctagaaatcaattctaaaaggaactctcaaaactctacaaatacatggaaagtaaacaacctgctcctgaacgatctttggatcaatgatgaaatcaaaatggaaactaaaaaatttttcaaaataaataataaccagtgacacaagttatcaaaatatctggaacacagcaggagtgctatgtggggagtttatagtgctaaatgcttacatcaaaaaggccaaacaatcacgaattgacaacccaacatcacacctcacagaact

SEQ ID NO: 398451 - DNA, 697 bp, Homo sapiens
ataaatcagcttgatctaattgacattaatagactaatccactcagcaacggcagaatacacatccttcacaagctcaaaggaaacattcaccaagatagaccacattttggaccgtaaagcatgtcttaaaaaatttaaagaatagcagttagacaaagtatgttctcaaatcacaatggaattaaactagaaatcagcagcagaaagacagctggaaaatcccccaaatgtttggaaatttaacaacacacttgtaaataacccacagttccaggaagaattcccaagagaaattacaaaatgtttcaaactaaataaaatgaaaatccagcttaccaaaatgtgtgggatgcagtgaaggcagtgcttagagggaaatttatagcattgaatgactacattagaaaagaagaaagaacgaaaatcaataaagcttccacctcaggacactaaggaaggagagcaatttaagcttaaagcaagcagaagaaaagaaatataaaatttagagtagaaatcaatgaaactgaaatcagtagagaaaatcaacaaaaccaaaagctggtactttgaaaagatgaataaaattgataaacttctagcctggctaaccaagaaaaaaatgagagtcacccatataacagatgtggagatgatttcatttgaacatgtgaggtagtatatttggccttgta

SEQ ID NO: 398452 - DNA, 358 bp, Homo sapiens
actatattatactgttttttgtttatgaagtataagaattaatgctaaacttttcaatctagacatcaagctatatgtaagacttgatatttgtaggttcattttgtattacttttcaaaattcaagtcacaggtttctgttttatttcaaaaagatcttttaagaacaggaaataaaatacagcggttcaaacaggccactttttggcaggtatcttgaaataaaatcctatattttaccagcaagatttctgggggaatattatgactttttatctgctttcctgtacccttgggttagagaagtttttccatgtgtgccaattttttaataaaaatgaaacaaaattcaatataa

SEQ ID NO: 398453 - DNA, 489 bp, Homo sapiens
taagaatgtaccacatggttagcacgaacctacagaagtgtattctcataatgataaaaagaaattaaaacttaaaacacacacacacattacaaaagaaaagaaaaacatttgtaaaactcagagcctcagacaaagaggacttatggtctattatgccaggcagtgggacatcaaagctcccaaagacccgagtccacctctctctaacagtcacagaccctcactgcagactaagagaaagacccccgagtcacctctccaacagtcacagaccctcactgcagataaaagcaggggagtgtcctcactttcagccggagttttctaactcctgtaatgacctcaatgacaaaaaatcatggtgcaggatgtttactaaaaggattgacttgtaacaactgcaaatattcaaaatatatcactattctaaaactgtctcagtattcaccatgactttaatataagaatcatataatggacgttaac

SEQ ID NO: 398454 - DNA, 241 bp, Homo sapiens
atggtggtgagctccacagcttacagaagtcctagtggtgtttagcaggatgttttcctaaatcttgaacatggctttgaggaattcacagtctgacctccactcacttcttcaagctcatctttacatcccacctccttagccactcacacatcattcttcatccagatttatacacttgtggaccctaaaagtaccattttctctctagcccctatgtctttttactcaagtaaacctg

SEQ ID NO: 398455 - DNA, 281 bp, Homo sapiens
tcctgagtagctgggattataggcacatgccaccacacccggctagttttttgtatttttagtggagatagggtttcaccatgttggccaggctggtctcgaactcctgacctcaagtgatccacccacctcggcctcccaaagtgcagggattacaggcatgagccacctcgcctggcacccctcaccttctgaaaggagacagacatgccaagaggaagtttacaagctcctcgggctgccctgtcttgttttctggaactgtcttggtgtgagtctgg

SEQ ID NO: 398456 - DNA, 749 bp, Homo sapiens
tctcttgctggagtgcagtggtgcaatctcggctcagtgcaacctcccactccctggttcaagcgattctcctgcctcagcctcccaagtagctggtactacaggtgcccgccaccaacctggctgtataatgaaacatgagtaggaattagagaagtggaaaggagaagggatagttttgttcgttgaggtaaaaccatatccagagatctttatcttctgaactttggcatgactaccttgagtggttgttgtacaaatgtttccggtgctgatgggagagaaggagatggcacacacactcacaaaaatgagtagatggcacagaaatggtacaggttctatatttaaccatgcagtatattggggccccatactgttgtagaaaatgtgacttgctaggaattatcagaaggtttgttcttatattactcaactttcttcttgggtactcccaagatatggtagtggcaaaataaattgagtttaattaaaaaatctcaatagcttggaataacaacgttttagagcatggcacctttcctaaactcagttgtctaatctgctctagaggatgaatcactggctttcagagggaaaaaaacaatagagggtctggggcatacccagggttctagtgacttccaagggtgtattagtccattctcacactgctatgaagaaatgcctgagactgggttatttataaaggacaggtgtttaacggactctccgttctgcattgctgg

SEQ ID NO: 398457 - DNA, 360 bp, Homo sapiens
tgggggaaagggggagagggcgaggctggcgaatagggctggtcggcgagagtgagagaccgagggagaagtgctgggcctgggagccgaaaaggctgagtaggaggggagggatgtgggagctggaagtggggtgggaatagcggatgacccgaggcgggagcggggagatagtgggggatcttggggtgaaagaaagcgatctgacctcaaacagacgctcaggaattattaaatgaattaatgtgggtggatgaatggctgcagggaacagttggggagaggtaaattggcgggatgagagggagcagggactgcttcaggtcgacgcggccgcgaatttagtagtagtagtcgacc

SEQ ID NO: 398458 - DNA, 368 bp, Homo sapiens
acacatccttaagaagcaagcaggtgactgtgaccagggactccatgtgggaacatggcccaggaggggtgcagagctgagggagaagtttggctcagcaaacctatgggaaaatagcctgagagggttccatgtgactgccgggggcaggggtggacagtgggccctccagacccttcagaaggaccaggtggtgtggggcaagtgcaccagcagggaaaggcagttttccagttcccatgtggaggtcttcccctcccctgagctgcagggaggatgttacggctcagaatcccaggccaggattggagggagggcctgggctgagactggaagaggagaaagatcctggtctaacttcccacccc

SEQ ID NO: 398459 - DNA, 590 bp, Homo sapiens
ggtgtctggcttatgcccctgtgtgaacgtgaagcctctcattgacatgcaggttacaggagaaaaagcaggtttatttgggaaggaggcttctagaccatgacttccattttagccatgtagtttttgaagtgcttgtacaagttctaggtggaaatgtccaggaggcagtggggaactcaaagtagatctcaggagagaggcttaggccagagggcttggggaatcatcagcatgggggtgggaggagagctggtatttggatgagattgcagtggagcatgaacagagtgggaaaaggtggtgatgaacccagggactccagtatgcggtagctggctgtgagattaggaagcaatgaaggaggccgagaaggatgtgggggagaagcatcaataaggaataaatgagttgcacgtgctccagagaggccaaataaagactggatttggctctcgcaggtcatacacgaaagaatcttggaaccaaaaggaaaacggtggtggtttaaagggtatattcagtttctaggtctgctgtcacaaaataccagaaactgagtgtcttgttaaaacaacagaaattttttc

SEQ ID NO: 398460 - DNA, 281 bp, Homo sapiens
tgtacagacttgctaccttaggcctggtcgatctttgtacaatgttcgtgattggaaaaccccttcggagcccctggattctgcaatttacaatgatgcgagatgtgtctgaggccaaggccaacctctcttgcttgtttgaattttatattcctgtgaaaaagactttgaaaaagattttgaaatcattttgagatttttaaaaaatgtttacttaatgaagcacatgactctggtctcaattataattctgttaattttttctaacaatggaaattttt

SEQ ID NO: 398461 - DNA, 121 bp, Homo sapiens
gggaagcttcatgaagaataaattgaagttgtacaggtaaagggagaaaagaagggaagaaaagcattagagatggaaacagcagctcaagttgtcactgaagaaattacagtaagtttgg

SEQ ID NO: 398462 - DNA, 1056 bp, Homo sapiens
ggacacatttattcattttctgttacgtttattgctttctgtggcctgtttgtctataaacatttgcctgtctccaggttatgaagatgctctcctatattttctctaaaagttttatgattttatatttagccctacaataatttagaattaatttttgtttgtgacgtgagaaataagttaaagttttctttgtgtgtttacttctgaacatctagttaatacagcaccatttttgaaaagacttttctttccccatggattgattgctttggtacctttggcaaacaaatgaccatgtaatcatgggcctgtttccagctctcttctcagatccactgatctatttgtcagtccctatgccagtaacatactgtcttaattataaaaccaacaatgtcggtattataatgttttaaagtcatgtagtttgagcactccagatttattttcctaattcaagattgttatagatacgctagattctttgcatgtctatataaattttagaatcaatttgtaaatttctacaagcagattcctgctagcattattactgggattgcaataactctacagatcaatttgtggagaactgacatctcaacaacattgagtcttccaatctgcaaacatgatactgtgtgtgtgtgtgtgtgtgtgtgtgtcttctttaatttctttcaataattgtttagttttcaacatagagatcttgtccatcttttgttgtttattcatgagtattttatgctttttgaagatactgtaaataaaattgtttttctaatttcatttcccaaattcttgctgctgatatataaaagtataattgatattttaatattaaccttgtatcctgtgaccttgttcaattgatgtattagttgtaatagttgtttcttgcatttcttaagattttccacataaacaatcacatcgtgtgtggagtgagttgcaattcttctttttaaaatctttatgccttttttttttacttacattattgcaatagttaagactacctaaaataaattggtaagtgttcttgcctcc

SEQ ID NO: 398463 - DNA, 329 bp, Homo sapiens
tccataagcagaatgggggaaattgcccaatcgtggtcacagaccctccatgccactggctgtgtgcaattggagtcccggacccagcgaccagcaagacccctcccctctcagggtgaccctgggcctccaggtcacaggtctccactaaaaaggctgcctcccctcaatcctagaccccgagttttcttttgttcacgtcattgggccattgccctatgtctctttggaagaaatgacctatatgaaaagctttacttctgggattccctaattccttcatcccttaggacagtgcagtttttcatctcctgatcttggatccagta

SEQ ID NO: 398464 - DNA, 994 bp, Homo sapiens
ataatttatttaacaaatcccctaaggcatatttaggcttcttcgagtttttcactattataaacaatacagtgatgaacaccttgcccattagccatatccagaattacttaggacatagtcttagaaaataagatgcacccaaacttttgatatttactatcagaaagtttgtaaggagacaccttaattttgcatatctggttgacaaagataaacacgtttggaaacataggtgattggtaaaaatgaaaaactgggcatcttgtatacatcagtgtaaggtaatttggtattgtcaatcaaaactgttacaaactttggtcaggtgcctctgagccttctcaaccgtgcctcggccttggccttggcctgtgatatggtttggatctgtgtcctcacccaaatatgttgaattgtaatccccaatgttggagttggggcctggtgggaggtggttggatcacaggagaccaattttatttagatagtgactacctatcttttaactggatctctgagctctgggaagaggccacactgaatcctgggtctgcaaaaagggagaattattatgaggctcgaccacatggatgcttttacagtgtacttaaaaaacattaaaaaaatatttctaagtgtctaaaatatactcttccttaaaaatgcaggagtagcttctgttgcaataattaataaacaaaaaaatcaggtaacacaatacaaaagcaaacagtttaggagctgacatgaacttgtgtgtttacactcttggggatacacaaggaaaaacaattttctccacaaaagggagtctggtgccttctccattttctttaaggaacctcaggctattataaactattttaggtccctcatgcagcagagcgttcaagggaaaggagagacagcagaactatatgaagaaaatagcattcagtcaactgaaaagaaaaaaaacttttgcccaaaaaacacaaggtcctaggagaga

SEQ ID NO: 398465 - DNA, 199 bp, Homo sapiens
ggctactctgagcacgctgtataggagttagacctcatccacaaagagcagctctggttcaataaaagattgctgtcggctgggcgcggtgctcacgcctgtaatcccagcacgggaggctgaggcgggtggatcatgagatcaggagatcgagaccatcctggctaacacggtgaaaccccatctctactaaaaatac

SEQ ID NO: 398466 - DNA, 441 bp, Homo sapiens
attcagtccatagcacagtgggtactctccagtagaataaaaaaaaaaatttaagaagaaatatagtaaatgtagaaaaatacagactctgttcagcaaaaccaatgtattcaaaattctaaaactctagtgtttactgagatatttgaaataacttgccaggtgcggtggctcacacctgtaatcccagtgctttgggaggccaaggcaggtggatcacaaggtcaggagatcgagaccatcctgcctaacacagtgaaaccccatctctactaaaaatacaaaaaattagccaggcgtagtggtgggcgcctgtagtcccagttactcgagaggctgaggcaggagaatgtcgtgaacctgggaggcagagcttgcagtgagcagagatcgctccactgcactccagcctgggtgacagagcaagactccgtctcaaaa

SEQ ID NO: 398467 - DNA, 270 bp, Homo sapiens
aggggaaggaagacacctgccaaatgctggaggctgcagcctgcggcaccgcggctcgcctcactgtgggtggtggccgagatggcgactgcagtgcgaccggagtgatgctgtcctcacagtatattcaaggcatctgatggcattgatgagcaactgaggaatcatttaattaatcaccaagttcttcatccttacttaaaaatgtagagtcacaaaatcatgcatcaaaacacactctttttttaataaaatatggtcttttatcca

SEQ ID NO: 398468 - DNA, 114 bp, Homo sapiens
tgtgcgccaccatgccgggctaatttttttttttttttacttttaatagaaatgaggacttcctacattgtccaggctggccttaaactcctggccttaagcagtcctccggcc

SEQ ID NO: 398469 - DNA, 603 bp, Homo sapiens
taaatgtgccttgctgagaaattttctaagtgctggtttttctttgtggcaccgagcacttgtctgtaacatttgtgtgtctgtctccttcaatacactgaaaagtccttgatggcaggaactgtatttatcttttatctgtaaacccctgtagagtgcctgtaaatgtgtactgaataaatgaatgccaccaacaaatccagacccaaccctcaatggcacaaatcatatgttataatcaatgcctcccaacaatttgaatctcacagatatactttgcactaaagaagccagatacgaaacaggacattttgtattattccatttgaagttcaataacaggcaaaactaatctttgtgacagaagccagaactaagcggagtagggtagagtgaggggggggtcttatccaggaagggtcacaagagaaccttatggagtgttggaacagtctctatgttgatctgagggtggcagttacacaggtatatacatatctaaaagaataatcaagcagtatacttgagattagtaccatttactgaaatttatcttgtatttcaaaaacccaagttctatatatggccctcatctgcctcaac

SEQ ID NO: 398470 - DNA, 363 bp, Homo sapiens
tcagagtgaatgttgctaaatatcctaaagtgaactggacagccctcacaataatgaattatcctgcccaaaatatcaacagtgctaagagtgagaaatcctaaaggcatgttataatcaaatgtttaaaaccagtagtaatatcaggcaagagaaaaaaataaaaggcatccaaatagggaaataagaagccacattatctcttcactgacaatatgattctatacctagaaaacccaaaatactctgccaaaaggctcctagacctgaaaaatgactttactgaagtttcaggatacaaaatcaatgtacaaaaatcagtagcatttttacacaccaataactttcaagctgagagccaaa

SEQ ID NO: 398471 - DNA, 324 bp, Homo sapiens
ctttgccagctcattgttactcctttcatgcctcctctgtcttatgatttcttctttgatttcatttttgctcataattttaaacttactcaagttacaaaaaaattgttaactttctcttacatcacctgggggtaattttatttttctgtggttatactttctctgccttttgtgtatttgtgtttttgtgttcctttattctctttctgatttctttgtttcttactttttatggacaatgtcaacccactatctttaaacattccagtttattacttatttttgaattatggcaaccttttcttggcctgacttttgctt

SEQ ID NO: 398472 - DNA, 921 bp, Homo sapiens
tcactggcaaagtaaaaacactccccaccagacccaggcagacctcacactccagctgctccaaagtctcttccagcctgaattgcaggttctccagagccaggctacagggccagccacacgtgggaggcaacctccactggctcactgccaagagccctgccaggtggggcccagacacccccatggagcccaccctccagtctcccaggaacacctgcgcctcaggtcagtcagaggctctaagagaggaaaacgctgcctttccttacacacagccctgcatcctgtgtatccaaaaatcaaggacttgaagaagccatttgttttccagaaaaccacacaccctgacaatctttgtacacactgagcccccaccaatcacactgggctcgaggctccccagccactgtggaaacagtacttggatccacatcttagtcaaattattaaaatacagcagacaaggacaggatcatagtcctcatctttctctcttcccccacattaatacattattatttcaatgaaatgagccaaattttaaacctaaactacttatgtactcttgcaaattttctgataatttttaatataaattcaaaacataaattcattttgaagttggaatttgaataaaatcattgtggttcaaataagagaccaacgacgggttgttacattattttctaactctacagtgatgttaaatttagtagacaaatctgaaataagcattaataatatttcagccttaggacaggcgcagtggctcacacctataatcccagcactttgggaagcggaggcgggacggatcacctgagttcaggagtttgagaccagcctggccaacatggtgaaactctgttgctacaaaaaacacaaagccaggcctggtggtgggctccttaatcccag

SEQ ID NO: 398473 - DNA, 376 bp, Homo sapiens
gagcaagccaggccaagagggcactggacgtcgagtctcacctccttttcctcccgtctcctccctctcaccaagtgacaccgctccctctcaaacggaaggaaggggaagaggatgctaagctgacataatggaagtctggagctgcctgtgaccaaggtttcccctgtgtagaagcctactgtcggaaaaaatgaggccagcacacagagactgagaggagtggagaaagagagctgggttgggaggagaagaaaaggatcttgatggtgatcacgtccttggttctagtgcttaaagtccccagggtcctgcaactctctgagttccttctaggacattcaattttgggattaaattggtcacttcatcagaa

SEQ ID NO: 398474 - DNA, 524 bp, Homo sapiens
cggtagtcctggcccacagggtctttttgcccaaagctctgggtgaagaatgccactgtgaacagctgcaggactaggctggaattccagtcttatctgggcccctgggacacttgaggggagcaatttgctccaactggcacactttccctgccccttccctggacacaggagtctgtctggttcactcaagccctgccttactcttgccatctgcatctccaccctcttcctccctctttccttccttctttcatcctctcatccatcacacacattctttctccttctcttttctcttttttctctctcccgtcttcccttatccccttccacctagttatatgataaccccttcagtccttgaagatgtctccccaccagaagagtgggcattcctcatgttacataaattccacaactaaggggctgctgatgggagagccatccctattagggatgcaatctctctgaagggaagtttttttttttttttgggtggtggtggtttttccctcgggaga

SEQ ID NO: 398475 - DNA, 485 bp, Homo sapiens
atatatatataatgtacttggagccttagtaagcacttaataaattttgaattaatcacaaagaaggctaatggaatggaaggaacatttcaggcagagatatctgtaaagatacggagggttgacatttcatggtgtgtttagttaactgggctttcagagtggctcttgctcagaggaaggtgaagctgtgtagggtgggttgagttcagtttaaggactgctctgaaccattattaaaggcgtgggctttatccttaaagcccacagttgggaacattaaaaaattttttttcatagcttaccattttattcatttctagttatatgtgcatacattatatgaatttgtctttatcacctcttcctgccacagaaactgacctatatggggttctcagtaaatcagtttgagtacatgagtaaaaaaccaagtcattcacacaatgttctcccattagatccagctagagaagagctttagg

SEQ ID NO: 398476 - DNA, 457 bp, Homo sapiens
ctcttggaaggctggcagcagcgaacctcctcgctcctctgccttagatctcgtcaagagtttaacatgctgtgtaacctcctaaactttgaaaaggaaactttctaaaagaaagttaaggaaaaataatttgatgcttaagggaactttttttcttgcatgagataatttccctggtaggagacactgttcttaaatttgtccaaggaccggttaacccaagaccatgtttccagggcgggggaaacatctaaatcatatttgttcaactcctgctctcaaagtggcttgagaataggttctgcccctggcaagatgacgcttgctgtcttttcctctcagctacccagaatggcatttgcagcatcgctgagaacgttttgggaaaatatctgtgcagttttcccaactcagttttcaccatctgcagcctgcctttgctttggtaggttggtta

SEQ ID NO: 398477 - DNA, 355 bp, Homo sapiens
aatttctataacatttcataatataatatgaaaattcactgctgatttttagaggacaaaatctatagcatggtgaactttcacagctccagctttatctagttagagttatttaacccacaggttgacattctcccctcctcagggtctctctttccccagaaggtattgcctcttttcttgctttcctggcctccctcttcagtgtttcatgtttgtccttttgtgttaacctttggaattatcaaacaagttgttgccagaatctggggactcatggccgatgtgttcccggctaataaagcaaaaccaagagaaaataatcctcagcattgcatttcagaactatgtgggc

SEQ ID NO: 398478 - DNA, 468 bp, Homo sapiens
agcagaggcaagaatgtctccagggtattcatcatgggtgatggcactgaggctcatcctttccaattcaggccaagggatgagctgaaaacctccaccacagacccctggcatatccacccccatcttcccaccacgtgctgcactggaacccactagcaatggaatgtggcagcttggctaactgctgcagggcaacagcatatggctgattctcagccccgcccctgccaagatgtccgaacacaacctttctaaagctgggggtgagggggctggagggataggtgttaatcaatacaggactggcgaaataaaattatggtctgtgtatcacagaatatgatggagctgtaagaaaatcagggtgttgttctctttatgtattgatatggaatgatctcaaagataaacttaaatgaaaaatgcagggtgcagacagtgtgtacagtatactacatgtgtgta

SEQ ID NO: 398479 - DNA, 633 bp, Homo sapiens
ggggagaaaaaaatattatagaatgaaatatatgttctgtaacatgacttccaggtttctaaatatgtattcatgttacagaatacatatttagaaacctggaagtcatggtaaaaagtacaaaactggaaaatttgatatagtggattaatttcattttaaattttttatgctttaattttaatttttgatgttaaatttttttctttatatttcagtgaaaatttagtgttcaatttcatttatatcatcttcttattaccattgcgtttcctggcactctttgattgaaatgggagaggaagaaaccctgtgttcattcccctgggtgtgtgtttggcagttgtgtcctgaaactctattgcctggggagtgcttttatctccttgaagcctatttgatgaaaatattaccaatacctcatagttacacaaagatgactggaaaggtcgttttttaacgagaaagtcatttgggcataaagaattgaaatattttgcactttttcttagtaggaatcagagcagagcgacattggaaataagaacagaaagaaatgaaagttttctgtcccctacacagtgttgttctcctccttcccttcctcgttacttaatttagagaagggaagca

SEQ ID NO: 398480 - DNA, 393 bp, Homo sapiens
gacctctgttgtcggaggcttgcaggtctcactcgactgtgatttgggacatgaagctgttctgcagtgtcctgccactttgccctcagagggctctcggcagcctgtgagtatcccggccttccatcccagcactctcctgctccgagtcctgagctgcggcccgctgcggtattagcctcagcctgcaggaagacaccctcacccctggggcctgggaaccatcacggtcctggaactcacaaagccacgtctctcttcagcttacctgtctcaaaaacacctctgattttctttccagggtcaggcagaaaagtaaactctaggggagaaaagacggacaggttactaggaacagagaaaacagagactaaagaattgacttttcctctc

SEQ ID NO: 398481 - DNA, 653 bp, Homo sapiens
ctggggtgaggccgcatacgtctcgttactccagcccccaaagaggcttccagatgcagccaccccagaccacgactgagaggccagcgccacacctggtcccacccgctggctgcactgtcccaatgcttctgaagccaaattacccccaaacgcttggccttcggaggcccccaagtgaaaagtgacccaggccccgctgtgacaggagagtttgccgctggcttcgactcaggcactgatgcatcatgctcagaacgcctgcctaggcatcagtttggaaacctttcccgttgccatttcagggcagtaaatatagccaattatacatcagctgtctgatttaaccatctgcagtggcacatgggccaaacttaccttctccctcatttctgaggtccaaagttgtattttacagtctagctgctgaactattagcctcagcctgcaggaagacaccctcacccctggggcctgggaaccatcacggtcctggaactcacaaagccacgtctctcttcagcttacctgtctcaaaaacacctctgattttctttccagggtcaggcagaaaagtaaactctaggggagaaaagacggacaggttactaggaacagagaaaacagagactaaagaattgacttttcctctc

SEQ ID NO: 398482 - DNA, 439 bp, Homo sapiens
aaactatggagacagtataaagataagtggttgtcagagtttggtggcagggagggggcaagtgatgaatatggtggagcacagagaatttttaggcagggaaaatatgtagtggtagatacatgtcattatacagttgtccaaacccgtagaatgtacaacaccaagaaagaagtctaatgtaaactgtagactttgaatgagtataatgcatgaatgtaggttcatgtattgcaacaaacatatcactttggtggggggtgttgataataggggagtaggtaatgcatgtgtaggaacagtgagtatatgggaaatctctgtgccttcctcttaatttggctgtgaacctaaaaactgctctaaaaaaataaaatttttaatttagaaaaaattaaatagaaaaaaggaataattaaggttagaatggcaatcagta

SEQ ID NO: 398483 - DNA, 227 bp, Homo sapiens
gcccatttacatctattctaatattttcctttattcatgcttatgtttaccaccttatagttttaggtcactcctctcctcatcaggcatacctgcatggccaaagtctggtggtttctgagtgttaaccaattgccaactgtatgatcttggaccacttacttggcctctctgtgctttaatttcttcatatattaaaaagtcatggtgagccctatcttttaggg

SEQ ID NO: 398484 - DNA, 311 bp, Homo sapiens
tcctctgtcttaaaaaaaaaaaattgttctgagaattacctcctcatcaatcgtgaacttagagcagtagggcatatcacatagtgatcctaggaaactgctctcctgggctccaggtcatacagcccagtgtggtagaactactgaatttactctgtgcaataggagttggaatgacccatagcattctaaaaattggtgaagtcttcattaaaatatttatttattggccctcagtccagatgacccaaatctttattattttcttcagtaagtgatgttttagggggaaaaattttaaaccacccttt

SEQ ID NO: 398485 - DNA, 587 bp, Homo sapiens
gggattgggcatgtctttttttgggggaaggggacaccattcaacccactgcaacagataatggatgacattcaaatccaaacggcatagatgtatatatatagctaataaaatgacacatcccatgagtggactccgattttgagaaaatataagatttttttgttttgttttgtttttaaagaaacagagtcttgctctgtcacccaggctggagtgcagtggtgcagtgatagcttactgcagccttgacctcctgggctcaactgatcctcccacctcagcctcctgagtagagcttggggttacaggctcatgctcctgcacccagctgattttgagaaaatatcaaaaatctggtagggaagtaaggcaaataacgctgcttttattttccccagggacattgataaacacattcatccacatgagtaaagcagccatgtaaaggtctccaaaaactagtcactgaaaatcatttaaaatgtattttattttttagttttttttggagacagtctcattctgtcacccaggctggagtgcagtggtgcaatctcagctccttgcaacctccacctcctgga

SEQ ID NO: 398486 - DNA, 448 bp, Homo sapiens
tcctttcatgttctccagcaagccaagttctttcctgcctaggggcctttgcacttgctgtttcttctgtctgtaactctcttccttctgctcttcctataactgcctctttctcttcttttaaagcccagctcaaccatcacctttccagagatcacttccctgatcatctaattgaaggacctcacccttcaccctggtcactctcaaccctatcatcctgtttattcccttcataactcagcaatgtcgggagctcacttacttgttgacttgtttattgtctatccacctctcttccccagaatgttggtcccatgaaggcagggatttaatatctttcttattcagtgcattagatggaaaccaggtacacacagcacagtgcctggcacatagaaaatgctcaataaatattggatggatggatggatggatgagatggatg

SEQ ID NO: 398487 - DNA, 900 bp, Homo sapiens
aaaatttctagttctggcgtcttgtttatctttctcaaatcctgtctgcaggggcccaggacatgcagctgtttcaggaaaccgcccttgagatggggcagatgtatgctagttcatgggctataaaactcaacaccaaaaatcccatcgtcctaaacagtgacctgttatgttgtgtgaaggacagtggcgatgggggcctggccgccagagaggctgctggattctatggcagacacactcaggagctggaagtgtggctaagctttcagcagcaccatcacttccctccccatacacatgcacacaggtttcctttgtctcacagctgaagaggcagcgcccagcttcagtaagcactgtgtatgagaatggacttactctggccacactgtgcacacgcatgtgtgtgtaaaacactgatcacatttcccataaagactgttgatttgcagagtttccaggcccatacatctagggcgggatgtgtgtgttttcatcaggggagagtagagtggccttttgtggaagggataaaatggttgagctgctggagacttttctagctccatttatacagcagcctttctgcctgggtgcagacttgaacccaagtccaagttcaagccatgtgtgtagatgaccagaacttagccttcaaacttagccttcaacttcaggactctcctggagaaaacatccatctccttttggagatacagagaattcgtgatgagctttgagtacagaagttcaagttatattttctggcaacctacagaataagttgggaaaggatatgtaattatagaaataaccagcatgtcgccaggcattgttgtccgtgctttagatggtgtggatattttgtaatttctgattctttacctactgttttca

SEQ ID NO: 398488 - DNA, 442 bp, Homo sapiens
cttccatctatggcaggtggacggttaggactaaatgtttcatgtagcttcgcccttggttccagctcttccctctcacgcctcccagacttctccaggccggtttcatgttaaccgtcttacactctgacatcagccaaggcgtctccattctgttcttgtgccattcatgtcttggattcccagtaagtagaaccttggaaataatttgatcttgtttttgcataaatgaggacactcagaaccaggaagagccctaggctcccacagcaaaaccaaaactaaacccaggactgctatttcccaagccagattctgttattcgagcccagccttagaagggcttgatgtggagcaaaaggtgaaaatggtgaaactaaaatttgagtatcaaaacccattgccttctaatagaatcagaaggaaatgttgctaaatcata

SEQ ID NO: 398489 - DNA, 231 bp, Homo sapiens
tcaatatttctacacaatagagaacaaaaactaaatgattatttttaaactgtgctaattcggctctcaagttcattctctagtttacgaagagtcacctgatcaaaatcatttgaaaatcatttgattactaaatcaagtaagccataaaagctaaacccaagtgaaactagataattgtgcaattttcttagatggactccttcttaagttcacctggctctctactgg

SEQ ID NO: 398490 - DNA, 344 bp, Homo sapiens
gacaggcggctggcccaaaagaaagaaaatatatatacgaaaattattaataaataatgaatgaagaaatggataatttcccagcaaaacacaaacgaccaaaattgacccaaaaagatttgaatagattaccacagaacacatcagaaaggtgattaagggtttacccattgaaaaatggcaccaagaccagatggcttcacagattatcttacctttaaaagatacataatttctttttttttttttttttttttgagatggagtctctgtcgcccaggctggtgtgcagtggtgcgatctcatctcactgcaacctccgcctcccaagttcaagtgattct

SEQ ID NO: 398491 - DNA, 357 bp, Homo sapiens
attaaaagaggaatcttaaaaatgagagacacaaatgacatatgagagtgtatcttaatagatggactagagttttcaggtaaagttaaaattattctttgcctctctacttacgaaggcagggaggtacatgatatgttttagaatgcttttcttccaaagttgttaatgtttaaaaatttgatatttgaagaggtagagttacttagaaaattggttatgtcaaacacttcattttctaaaaactgcataaaagaagtattttattttcttaacattttcctcgaggtggcttgacgaaactaacggataccattacccattcaatatgttgactgtcttttgcctatagttagt

SEQ ID NO: 398492 - DNA, 320 bp, Homo sapiens
catttgcaatttgagacaaacctgtaaatggttactgttaaatgatcattcttcctcccctgtcatgtctgcgcacttgtatttatcagtcattgggcatattttgatatattatctattgtaggtaagtatctctttttctgttgggaagagttatattggtggtcacagacaaccagattattttaattttagttccaacaaagaattacagactgctagctgcatataaactttataatgcatagacattttctaatttgtggctcattatgaaaatttccacttacaacgatcctatcattggatctcaggtacaa

SEQ ID NO: 398493 - DNA, 365 bp, Homo sapiens
ttctgtagttcagtagagtcaggtgtgtagatctgggtaatcaggcctgggcaacttcaagttcatgctcttgttattttgtccaggatttgggcaccagaacagctccctaactgctgaggaggaatgaaggacaacagacactcacagctttcctatttcagggctggcagcaaaggattccaggctttaggaaactcctcagactgggaagctcaggggagatacttaccttgatgtaagcagcacctgttgaagggcagcccgtctttttttttttttttttttttttgagacagagtctccctctgccacccaggctggagtgcagtgaagtgatcttggctcactgtaagctccacctc

SEQ ID NO: 398494 - DNA, 422 bp, Homo sapiens
ctgccagggagccctgggattgagtgttttactcttccagcctctgtagttaaggcaaaagatattggggttgtgaatggcttttgaatagccagtccacactcttggctgcattcgccttccattcacctggtgatgcctgaggtgcctccattaaggttctgttttctttacattaaagagaaagatagtctaccagaaggattttgagtgtaacattgaaggaactgaaatgcagccagccactttgatggggctttttgaattgaaacatatagtaattgtttttcttttattaattgaaatctggttgagtcccctgcatgactaggaagcatgagtataccaaaattctggccatagtattgccactaactagttttatggcctcaggccagttatgtaaccttgctgggcttgtt

SEQ ID NO: 398495 - DNA, 496 bp, Homo sapiens
cctgtgtctggactttttagaatttccaagagctgctgtttctggaaccagattaatacaagtcagtcttccatttatttatttatgtatttatttgagacagggtctcactctgtcacccaggctggggtgcagtggcatgaacacagctcactgcagcttgggggctcaagagatcctcctgcctcagcctcccatgtagttgggaccacaggcacctaccacccagctaattttatttgttgtagaaatgaggtctcattttgctgcccaggctgttcttgaactcttgggctcaagcgatcctcctgcaacatcttcccaaagtgctgggatcactcttccatttaacatgctatctcaacgtcaagataaactttaaaatctttagataataggctggcattttacttaaaaacgaatctttttacttttttcaggaaccggccctattccttattaaatatggtggggtccttccaaacctggaagaagt

SEQ ID NO: 398496 - DNA, 500 bp, Homo sapiens
tcatggttggtgggactgggtgggcagcggccccgcccctgctgtcacactgggggacacaaggcgcgagggcagctcccagggaagcagcagatggagaggagagctgtgacagcgcggtgcaaggagccaccacctggagtcgcctcctcagaaagcaggactaccctacagcaaagatgggaattgtcctaactcccgggcaccagggagatgaggggacagcagttatgttttttaaaaggtatggagaaatatgcctgctttgagggccgaagtgggagtggacactcatgcctcttcctctcccttcaagaaataagagacagtcaacactaactccttcgcctcctcccgtcctcagcccccaggacattctggttcttcaagcacaggtgacacacagagacagaagggcacagagctgccagcagtctgcagtgttggactgatttatttccaagccctatcttgagaaacagaattttttttttcctgtt

SEQ ID NO: 398497 - DNA, 157 bp, Homo sapiens
gaagtggggatcggcttgtgagtaaatatgagaaccaatagcatttggaggaaagcataggtgagacttggagaagaaagaccagaaatatgctttggtgctaatgttcgtaggttgggtgtaacagaggaagacagccaatgaggctgagaggaga

SEQ ID NO: 398498 - DNA, 404 bp, Homo sapiens
gataagctacggacgctgagggaaggcacggtgttggcagcatgtgtgtctttctacccgaacaagaaactgatgcctgttaatagtgtttccagggaccttgccagtgaagaggagagtatcactgatgaatagatgagcaggggtgaatagtgtcgccctgtgctcaccctgtcatacccttgtgtggtcacaagactccaggcctcctaacacatccaaaatcttatttactaagaagcctaacctaaaaactgcaatccctctgggttttcctctctatgtagagttatccagaatatatctagactcaagcataaattatgtcacttggattttgctaccacctttttttttataattacattaagctacactcaagagggtgagttttacaattctct

SEQ ID NO: 398499 - DNA, 430 bp, Homo sapiens
tgaccacactattgaaaatagaatgcttttaatgtctctttcctctgctttgttttcctgcaaaacaattcatcacccaaattattttcagtacctcctaattgcaattcatttatctcctccattctcactctatgagatggctttttttcccaattctgaggcactgttgtgtacccaaagcctggaaaaattcactgtagatgcatgataaatatttggtgaatgaataagtgcacggatgaatgaatgagagggaggaaaaaagtacttataagaacataaggggagatacagaggttataaatacacaagaaactaaattcagtaacttactattttgtttagtatgactaatccacagatctcaaaagacatcaagaaaggagtatatctctgtaaaagacaacataggaaagagcaatcatat

SEQ ID NO: 398500 - DNA, 548 bp, Homo sapiens
atatgcaaagaacccttacaattcaataagacaacccaatttaaaaacaggcaaaggatgtgaataggcatttctccaaagatacggaaaaacggccaataagcacataaaaagatgctcaaaatcatttgccatttgggaaatgcaatcaaaaccacaatgaggtatcacttcacgcccattagggtggctatagatcagaaagtcagataacatgtgttggcaagcacatggaaacactgaagtccttacacactgctggtaggaatgtaaaatggtgcagccactgtggaaaacagttttccaatttctcaaaatgttaaacacagttatcatacacccaagcaattctactcttaggtatatacccaagagaaatgaaaacatatgtcttcaccagaacttgctgttcacagcagcattatgcataatagaccaaaagtggaaacaactcaactgcccatcaactggtgaatggataagtaaaatgtgatgtaaccagtcattggactgtcattcattaataaaaagaacaaggtactgattca

SEQ ID NO: 398501 - DNA, 292 bp, Homo sapiens
tggatttagtccctagcttctaaggaacagaatatgatacaggtgatgggatgtcacttcggagattactaaaaaaaaaaaaaaaaaagtagcttctgtcttagacttgagcttgcatgctttctctttcactttgaaagaaatcagctgtcttgtgaatggacagaggccaagtagcaaagaaatgagagaagcctccagtctctagccagcaaggaactgaagtcttcaatccaacatagctcacaaggaactcagtcctgtcaacaatcttgagagagctcttagaacc

SEQ ID NO: 398502 - DNA, 531 bp, Homo sapiens
gctttgagttccccttggagcccatctagaagtttcaggagtggtgaatgagtaccgaattttgacaactacatgagagaagaatgaatgaagtgcaatctgagattcaagcaactttgaaatcattttaaacatttggtgggggaatgacttatccatctgttgatttatctagtcatttctaaatctaatgcctatactctgtttccagagttcactttcaaaaatacagcattaatcatgtcaccccatgttttaaatttcccatggacatacaccatcagagagcctgaagacagttcctccccacccagcactgcccctgccagtgcctgcccacatcattgaggcctgggtaccaacccagcctgccggagtccagacacattgtccagggatctgaggattcacccgccctgtctaccaccactggtgtctgtgcactcctcccaggggtctaaggatgggtctgtcaagcctgccatcaccactgctgccagcacccacctgcatgagccacaggggggcctg

SEQ ID NO: 398503 - DNA, 357 bp, Homo sapiens
gggcatgagaacttcccttaaaagacctttctgataggatcagtagtgatattaacaaatgtaatttttttttggtgttacattgtgtgatggaaaatgcacatacctcagtgaattaatgctttccaaatgaccagtaatgatgttacaaataaacattggtcaagtgcaaaatagactgatggattttttttgtaggagaaattttattttttaaattaagttgtagtaaaactgaccatttttgtgtacagttgtatgaattttacctcatgtataaatttatatacccaacaccacaactaagaaacagaatagtttcatgacctcaagaagttccctgtgctgtcttttcta

SEQ ID NO: 398504 - DNA, 323 bp, Homo sapiens
gccacaggctgcacatgagtgggcttcccaagggtccttaagctgtaactgaaacgtctcatgcttaggagtataacagagttctctgttttaagaattattcttaattattggttattagtctggcaactggatttgagatttgtttgcatttttaagagtatgtgtggtgttttaaaagtgttagattatttaggcaaagtgctgggattacaggtgtgagccactgtgccaggccaagaatatttttctatgcctttttgtcagagagacaatgccgggagtgctctggccagagcagagtgaagcctgtgtctttggat

SEQ ID NO: 398505 - DNA, 510 bp, Homo sapiens
aatgatttccatatacagatactgttcctctctctccagggctctttgatgtttcattacagtttagctggcatttgaaatagactcacatttctagacctcagacaatggacgtttcgcagaactattgccatgttttcaacacattgttaaaaacaacaatacgagtaagtgaatagaggcttcacatgtcacctcgtgtgaattcagttatgcatatttgttagttcaaaacaggaaaaggagagagaggagaacaatgtatatggcatgggcattgcctgtgctgttatctcccatgagtgagtgtccttgcatgagcctgagataagagaggggacctcactcctcactgcggatctcagtcccacaggcctctgggtttgtgagtggtggggattcccatgctgcaaacagtatactcttacactattaaatacatgctggctaatttatctgattgtcagtggaaaaagtaatgatggtctggccgggcacggtggctcctgc

SEQ ID NO: 398506 - DNA, 867 bp, Homo sapiens
ttattgatggacatttagaaacaattgtttctatttgtttttataaacagtggttggttaaccatccttatcaatgtctttgtgcccgcatgcaggagacctctctagcataggctcctggaagtcggattgctgggtcccaggacagacattcaaacttcgctccccaaaatggctattccaatttatattcccagcagcagtatgagtttcttttcctgaaaatcctcactggcacatggcattaccagacttctttttaaaatatgaaatattgagtacataaagacatacggagggctgagcgtggtggctttcccctgtaatccctgcattttgggaggctgaggcaggcagatcttttgagcccaggagttcgagaccaacctgggcaacataaacctctacaaaaaaaaaatacaaaaattagctgggtgtggtggcacacgcctgtagtcccagctacttgggaggccaaggtgggaggatcacctgagcctgggaaggtcgaggctgcagagagctgagattgtgccactgcactccagcttggatgacaaagcaagatcctgcctgcaaaaaaaaaaagacaagacacgtggggagtaagataaggagtttccatatactgtctttccagctttagaaataaaactgcaaatacaaatggagcccttcctgcactccctgacttcatttccctcctttgccctccccgatgaacgtcatcccgagtttcatgatttttattcccaggcaggttttcgtagtttatattatttacacatgtgtctatccataagtatgccttacaacattggcaaaacgattttaaactacatgaactttataccagtaataacacac

SEQ ID NO: 398507 - DNA, 669 bp, Homo sapiens
attgaaatgtgtttgcacacaccagtggttgtatgggggatgaacacatagaaataaaacggataaacagaatagcctactattactattaaaatgataaagaggacataaatatatcaaatatgataaacctccaaaaatgtgttaaaatggtgaaaaacaggtacacgcggtataaattttaaaatcataaactgatatcaaataatgccactcataaaaacatagagggctgggtgtggtggcacacgcctgtagtcccagctacttgggaggccaaggtgggaggatcacctgagcctgggaaggtcgaggctgcagagagctgagattgtgccactgcactccagcttggatgacaaagcaagatcctgcctgcaaaaaaaaaaagacaagacacgtggggagtaagataaggagtttccatatactgtctttccagctttagaaataaaactgcaaatacaaatggagcccttcctgcactccctgacttcatttccctcctttgccctccccgatgaacgtcatcccgagtttcatgatttttattcccaggcaggttttcgtagtttatattatttacacatgtgtctatccataagtatgccttacaacattggcaaaacgattttaaactacatgaactttataccagtaataacacac

SEQ ID NO: 398508 - DNA, 539 bp, Homo sapiens
aaacaagagaagttactagaactgactgaaacgagcgatcagagaggcagggggaatcagaaggccagccttcagaccttggctccagccagttaaagtgaaataacctttgacaagttgaatatcttatgttctgttttctcaaccataagaaaagtatgtttataccagctaatatcataaacttgttctgagaaaagtgtgggatgattgttaagtacatattgccacacacacacacacacatgatcttctatatggaatatactaagattctagctatacataataatggatcaaatgactggatcatttcatatagactaaagctgtaccctaaagtcaaaaccatatcttaactcttcctagaacctagcaaaagataaaaataatgtaatggattttcttttgtattcattaagtggttctacagacagttccagacactgaacactagcagcatcacctaaataaatgtgaatcacaacaaatcattacagtataatagtaattcattggaggaaagtataaatgcaatt

SEQ ID NO: 398509 - DNA, 597 bp, Homo sapiens
ttagtaaaaagtaataataataacactcttcagagtgcaggtggcataaggagattccaagaatggagagaatttgggtttgcatgcagcagcctcctgcaaggactaggctgcaatgaaagccccaaacagagtaactctgtgttcacctttttcttatcacatacatctgcatgaatactctgggtaacatcagaagtaggtcaaggctagcagatcctttctctgtagtctccctcatccaaaataaaaaaggcttagatctaaaacagagtgaagaaagacaaggaaaaggaaaaaaatatatgtgtgttatatatacaactataaagctaaaaatggatctggatacaaagaaatcatagaaagggtcaacaaaacaaaaacctagttctatagaacaatagcaagatagataaatttctggtaaaattgacaatgaaaaaagagaaaagaaggctatgaatatggagattataattacagtttcagtagaattttttaaatcctaagaatactatgaacattaaaaaacttggctgaaatactttcttcaataaattaatttttaattcaataaaagatgaaaattaaaat

SEQ ID NO: 398510 - DNA, 471 bp, Homo sapiens
acctggggaaagtgatgttcctgtcatctattgggtaagcgtgagaacaaaaatgtagacctaaataaataaacaagcaaagaaaatatcacctagagaaagaaacactgaaaatattacacacataactatagaatgatatgaccaagttgagaccacacatatcagtcatatcaataaatatgaattaatttaacacacttattgaaagctttttaaaggtggtgatgatgtggaaaaataggtatgcattaaaggataggaaaacaccacaaaaagaaaagctaccaagggagctagccctgtcaagcattaaaacataccctaaaacctgtatcattagaacagtgcagtactggctcataagtagacaaacaggctagtagaataaaatagcctagacatagacccaagtacatgtggaaattgagtatgatgcaggtggcatctcaggtcagtagggcctcagtc

SEQ ID NO: 398511 - DNA, 602 bp, Homo sapiens
atgtcctcctcattccaaagatatgctccaacccagggcagcattctcagaaagaattcaggtggaccattctaaatccatgtgtgtaccacaatctgtatcttactgagagtctgaccccttccttgagagtttctgttctagtaaaataattccatcagttacttcaattcatcctattcccttccctaccgtcaaaccgccaatgcttgaaaactacaacattaaaataatcaactatctagaagttaggctttgtgactaaatgctttctggtaatgaatgaacacatatgacacccatccctgatggtttgggtttatgaaagcaacagaattgaggtctgaggtccacacagctggacctttccctttagtgtgttcacccccaaaggaagcagggtctcctttctcacatgcaatcaagttacctcgcagaggtgactaagatactcacccttcccctgggttcctattactcagcctttactgaacaaatatatgtggagcgccatttaggtaggaggccctgtgccaggcattgcagataaagtggtgaacatatgtaatcacaaccactcttcccaacagcttatggccttt

SEQ ID NO: 398512 - DNA, 587 bp, Homo sapiens
tcttatgattacccaactctggttcataaactcctgaagaatctgtccaactacagtgaataaatatggttcctccagattgctaggttgaatatttttgacttgaactcagaagctcttcttagattttttttaacctcctagaagctggtttaatttctttcagttcagtgccttgcatggagccatatagatttggagcttttggaaggttgttggtgatgtttgctgatctaatgtgtattgatgacagcagtagacaaaacgtagaattcagagcagcactggctaagaacgaggcagggctaaagagtaaagttatacatattagctgttgccttaggctgtatttcttttttgaactcagaactgggacagaagaagaatatcccccagctcttcttttatagagaaggaaacagggactgagagtggttaggtccactcgagggcatatgtgatgaagctgggataactactcaactgccctggaacatagtgattggcttcctagtggtttccagtgtacttcactggaaaatgttatgaaggttactataggctgccctttccatccattggtattg

SEQ ID NO: 398513 - DNA, 460 bp, Homo sapiens
tctaactaaagagggcactttaattttttactatccttttatgtaaatgatttcactggtttatactgcagcagtttcttcagcagtagctttgctattagataagaaatctcaaaagtggttgctaaatatgtataaatatttcataagaagttttaaaatactggcctgagactcacacgactttactcttgaaacaaaaccagaggctcattttaatattgtgggttcttcatttcaaattagtttataatattgcaaagcaacactatccatggctcaatgtttgttggtaacaataatgcatgttaaaaagctatatttcaaatatacttttaaaagaaattttaattcaaaagaattttaggtttaccagaggattgcaaagatagaacagaattcccatacacccttcacccagcttcctcgaatactaacatcttacataaccatagtatat

SEQ ID NO: 398514 - DNA, 294 bp, Homo sapiens
tatcgctctagcaggatccggctgatgcaggaggactgcttgaggccaggagttcaagaccagcctgggcaacatagtgagaccccatcactacctcacacacacacacaaattaattagctgggactacaagtgcatgccaccacacaccctgctaatttttaaatttacttttgtagagatgggggtcttccaaagagctgggattaaagttgtgaggtaccacacccagcacagccttgactacattatttttctgtcttctattgacagaagcagtcatatagcatcact

SEQ ID NO: 398515 - DNA, 383 bp, Homo sapiens
gtcttaaactcctgacctcaagtgatcccaaagtgttgggattacaggcgtgagccacagcgctagccctgtagtttaaaagcctaggcctgttggatttctggggatttacattgatcatatctgtcgcttggtttttttggtctgaaaggaagcttaggtgtttagttatgattggatgacttatttggccaagttaacaggttacagagcagtgatttttagtgttttttaatgttcccattgttagtctattgaggcccctagtgtatttgttgaaacacaaaaggccttctaaaaaagattcagtccttgtgtttaaaaagcttactttctagttggagagacaaaataaactgagagtactgaggtaattaatatca

SEQ ID NO: 398516 - DNA, 556 bp, Homo sapiens
cgtagtggctcatacctgtaatcccagcactttgggaggccgaggcaggtggatcacctgaggtcaggagttcgagaccagcctggccgacatagtaaaaccccgtctctactaaaaatacaaaaattacccggatgtggtggtgcacgcttgttgtcccagctacttgggaggctgaggctggagaatagcttgaacctgggaggcaaaggttgcagtgaaccaagattgtgccactgcactccagcctgggagacagagtgagactccatctcaaaaaaaattttagacaataagaactcctccaaaaactctcgaagacgattaattgttccttatattttaaaattttgaagtaataacaaacttttttcctgaccctttgacattagatgcttcatgacatttgaatagaatgtatttcctacccagtacattctttgacatcactacaatgtaaccataaaaatcagaaaattaacattgagaattactgctgtcctaatcctcagaccacattcaggttttgccagttatcatcttaatgttctttata

SEQ ID NO: 398517 - DNA, 333 bp, Homo sapiens
tcggaagcactgggctagggcagtgtagtacccagtgggatgaggtgcatcagagcagcacctgctgaggcaggagaatcacttgaacccgggaggcagaggttgcagtgagccaagatcatgtcattgcactccagcctggcaacgagagtgaaactctgtctcacaaaaaatttggaagcaacccagttgcccatcatttgatgaatggaaaaaaataatctatacagcggagtgctcttcagttataaaaaggaatgaggtgctgatacatgctatatgtggatgaaccccaaagactttatgctaagtcaaagaagccagacaaaaaac

SEQ ID NO: 398518 - DNA, 1245 bp, Homo sapiens
ctacgctagtggatgctaaaaggaacatcaatgtctcccgtttcagctgggaatgtggggttatgactcagaccattcctaaggtccagggccccatttctcgggtctccctaggtgcctttctgcagttctccacagttctcatccagacaaaaccaggagaaagtgcacatccacagctgtctcttgggcatagaggggagcagtattaagagaggcccatttgggggtaatgctggctggcatttgactctattccttaggctttaagttctgtttctttggtgccaactggccaatctctgcattttgcacccccttctctcctttcccattcccaccctcaccctctattgcctgcctcccaaggctttgtccaccagggtaaggtcccccatcccagggcctggcctcacattccctttctccctggactcccttcctcccacgcctccttctcctagaagcacttctgagatgcagagagggttaaatggtgcttttgcacataaccgtctgatgaaaggcagagaagtgttcctaacccctgccggggttccagataggcagctgtagtgtgtgaatcctcctccttgcccccacccccttatgtctccagctgccagattaaggctaggtgttgctgagcaagaaagcatggagatcagatgtgtgaagcgggtaactgcttggcggccatccttccccaggggacacagaggtgttctttgtgaggttcgctggagcatgccacctctcctgctacagaggctgacacgtcccctctccatcagtttaccactcatgtaaacaactgccgaggccagcttatctatgggtggaagaaaatgtttttcaccaacttttctctccaagaacacagggacaagactcagttacagaaagtagcataagtgccaccaaagagtgtgaagcgtccgagacttcagccagtcagagatctgaattcggaggcatttaaaaatgcctctagatgtgggagcaatccacatggtttctgccaacttactgaaaacatcccggcgcctcccgccacaccatgctcataaggcagatggaaagagtcgtttctcagggatgcctttgtgcttgtgcgtcttttttccaaacacatcagagggcgtgaccacattcttctactatcttctgtaaacttctctagaggagccaacctttttcgtttgtttaatctcacaaattaaataaacctttatgtgaaatgtt

SEQ ID NO: 398519 - DNA, 398 bp, Homo sapiens
tgggattacagacgtgagccaccgcatctggcccaacatttattttaattactagaaaaagaaactctgtattacagaaaagcaactgggtacaaggtacctcaaaatcacgacctaccaaatgcagcataggcacagaaaaagaacagtttaaataagctgaaccccttattgatgaagagatagagttaacacagggatttaccaattgaactcagagattttaaccagcttatcaaagctaattaaaatggggttgtgatattgaaaatatagcaagagaagaagagggaaaaagcttacgggaggtccttgaatactcaactgtgttctgggaaaaacgcaatgagctccaggacatagacaagattatggctcagagtgaaagggagagataa

SEQ ID NO: 398520 - DNA, 458 bp, Homo sapiens
tgtgaagtttgaagcctattccaatttggaatgtcctatttatggaaaagtatacaaaattgcaaatgcaaacttgctagagctcatcacaagccttggaagatgccaattaaatgagagaccctgaatcctaagctttgttagtttttgaaatgtctgcttccaactatagcagtgctgaccagtagaaatataatgtgaaccacgtatgtaacttaaaattttccatcatgaacatcaaagaagcaaaaataagcagtatttcgaccccactctagacctactgaatcagaatatacatttttaataaggtccccagattattcatatgcatattaaagtttgagatacgcttttgagatatgtcgctctatagaatgaagaatagagtgtctgaaaatagttgctgaaaaaaagagacaaagaaattctcaaagaaggcctagggaagggaatta

SEQ ID NO: 398521 - DNA, 442 bp, Homo sapiens
caagggactgatgggaacccacatctattccttatctacgaagtgcctggcctggtacgaggaggcacatttgtactccttgtctgaaattacccacgcaaaatctcagtgacataaagagtgttaccctgcttcaaaggaggaaactgaggcttggcaagcttatttggagcctagtctctgatcccctgaagcgcactttcttcccactgccacagcacatctctctcagactgtgttctgtcctctggacaccttgctctgattaccctgatcagataaagtaatcttgctggccgctaactgggatcggctcttgcttagaaaggccattgtaagcattttgtatctcttatctcatgtaatcttatagcaaccttataaggtaggtcctattcttatccccattttacaggtggagcatgtgtggctctaagaagga

SEQ ID NO: 398522 - DNA, 249 bp, Homo sapiens
cttggaaggggaaaaattagaaagagaaaggcaatacagtaactgttcacctacaactgaccaggtccagatattttgatttttcaaaggaagagcagagtcatgcgacaacagatcagagtcataaacacaaataggcattccaagaaacggagcgcccacatcctccacatacctgtcttttcctcccattaccccacactgaatagcaccttaaataacaccactgctaatgcctcaataccaagg

SEQ ID NO: 398523 - DNA, 392 bp, Homo sapiens
ccttctccttgctgcaagagtgctttgaagatactggattaattacattgtaccttaccttgtaatgaactgtttatatcattttattcaaatacacaaggaagtttttaggacttcatctattttttttaattcttttaaaattctgggcctttaatgtagctcctgctgtgtaatcacttgttaaatttttgcagaatgaaaataacacatcagtgagtcttgccctgttctctcttgatgagccttccctgttctctcctaacttccctgcacccaaatcccttgtatttgtagccttcttgacacaagcagggtctagttccaaatgccttttgcgtgttgcttataatcctcatagcagccctggcagtaaggacctattattgtcc

SEQ ID NO: 398524 - DNA, 243 bp, Homo sapiens
gtaaaaccacctgctggaaaacgactgcagactctatcctgacccaaactgagtaggatcaaatgccagcagagagggggaagcccgagggctcacctgtccagggagcctccactgttagctctgccctcccttatgagtggatccaatgctgcccccgccccaactgcctggcagattcttcttcattcttttaaagcctttgaggatatcatctctttttctggccttctctgcccctgc

SEQ ID NO: 398525 - DNA, 216 bp, Homo sapiens
ttatgtaaggtcacataggtaataagtatcagagctgataataaagttcaatccagatgttctgcagcaaaaacatatttttaaaaaataatttcaagttatttcagattcgggggtacacatgcaggtttcttaacaggatatattgtatgatgctgagattaggggtacagctgatcccatcactcaggtgttgggcataatacttaatagttt

SEQ ID NO: 398526 - DNA, 337 bp, Homo sapiens
ctcagagcgtcactgtcaactacataaaattgccagagaagctctttgggactacaaacacatacccttaatgtctttatttctattttgtctacctcttcagtctaggtgaaaaaataggaaggataatagggaagaactttgtttatgcctacttatccgcccctaggaattttgaaaacctctaggtagcaataagaactgcagcatggtatagaaaaagaggaggaaagctgtatagaaatgcataataaatgggcaggaaaagaactgcttggaacaaacagggaggttgaactataaggagagaaagcagagaggctaatcaacaaggctg

SEQ ID NO: 398527 - DNA, 365 bp, Homo sapiens
gacatcctacttttgataacccagttccttctaaaagtgaagcaaaggataatttcttcgaagtgtttaccccagtgtttgaaaggaactccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggcctcttgctcccatcagacaattgcattgctaccaagtttcataccaaatatttgaaaggatggtattgaatctaaaaccaaatattagtttttattaaactgat

SEQ ID NO: 398528 - DNA, 504 bp, Homo sapiens
caagattcaacttatatatatatataaagctttaaaaacatctaataagatgcaacatgaagtatacattacctaagatataaaatgtttcacttaaattgactgacactttagatctaacttcaagtttgatgtacatacaggaataaaataaagaaatgtcatactacaaataaataactagacaattccaaaagggtaggacatctggtccagcctgtcaaaagtcaatgtaatgaaaaatgatttattctagactataagaaacctaggagacaatggccaatttttatatatagatccttatctgaagaaactagctataaaggacttttttttaacaaatggagatatttaaatatggactgggtattagattttatattatgcaggaaatattctcattttaaaacacttgtactaaaataagggcagtaagtaaacgcatacatatatatatttactacacacacacacacacacagtaactgggaaccaaaacag

SEQ ID NO: 398529 - DNA, 1876 bp, Homo sapiens
cattccatgcagacaagcgtgtccttcatgagacaggattcagtactgagctagatcgtgtaaagaatctgcctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcacgggacacccttgtcaggaaagtcagccaatgccgttagcgtggccaagtactacaacgcagcctgcctgagcatcgactccattgtgctggaagctgtggccaacagcaacaacatcccagggatccgggcctgtgagctctgcatcagggctgccatagagcagtccatgaaggaaggagaggaggctgctgagtgactgctaccgaggagtggtgtttgatggcctcgacactctctttgctcggaatgctgcagccgccctcctctgcctgctgaaggccattggcagccgggagcatatatacattctcaacatggcccaggattacgcagccatgaaggcccaggagaaagccaaaaaggagcaagaaggcaaggcctcctacctttccattgggcttaagtgaaactttgacatttgctattccgttggcgcctcacctctgccctgtaaggtggccaggagttgtatttctgctttgctaggagggaactgggacgcgagtggctggctgggaagttctatgatgaacgctttgctgacagcaggtgcattcctgcttccctcccatcacactgtacccctccatcctttctgcaattacagccattttgggtccc

SEQ ID NO: 398530 - DNA, 1038 bp, Homo sapiens
tctcctgtgctggtatgataaaatttggtacaatttctctgtcaccatttctttgtctatctccaactctttttgtagctgaattccatcatttttggctcttctgagttttccacattttctaagcaaatgtataattttagttgctaaacaaatgttaaaatgtagaaacactgtgcacagagagactgaggaatagccaactgactgcagttcttgtttatttgggttgaatggtccagggtgatgggagcccgtatggtgaatctcttcttcatcttttttttccttttctgcctccatctcccttgtccccctcccaactcttcccctggtgttttcatcctttgctacctggcagaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcacgggacacccttgtcaggtaggcaacagttctgaggggaggttaagaccagcagtgccatgtcttctctgtaaactctgcggcttccagagtggcaacatcagctgtgtggtcatggcaaatactaatgactttatttgaggaactgcatagggtagtgaatatacattaatagctgtgtgcctttgggaaaattaactaaattgtctgtgctcagtttccctgtccgtaaagtggtattaacgctgtctattttatagggtagtcatgagaatttaatgagaacatttatataaaatgcttatctcaatacttggcacatagtaaatactcaaacgaaa

SEQ ID NO: 398531 - DNA, 378 bp, Homo sapiens
cctcaacttatactgtgaatcagaataatctgggcagcttttaaaaaatataaacgtcagtgcctcatcagagatctgattcaatggcgtggggtaaggctgccatcactgttatttgtgttttgtcttttactgttctcaagcaatctaatatgcaatcaggactgagaagcagcgtatacccgattcaggtgcttcatcaaactgactgcacacccaaatcacctggggatcttgttaaaaatatgtatgtggtgggacctgagactctgcatttccaaaaaaagctctcaggtgatgctgatgttgccagttggtccatggaccacaggtggaggagcaagggtataaagcctgggccccagtctttcttatcag

SEQ ID NO: 398532 - DNA, 721 bp, Homo sapiens
ccctaatgaggtaggctgaaaatgaactctgagagcgaattctgtttagagatcattttaatctagcagcctgccacctcgcttagcttcctgtgatagcttgccagtcagtttcacaacacaagaccttctgaagacatagctctgatgttttcactctcttgctccaaaccccgggcatggaggctaaacctgctgtgcagcatgctggctcgtctttcgcgcccctccacctccgccagtcaaagcaaaccgcagcatggaatttgagcattatttgcgtcattcggccagcggggagaatgtgactgacgcccggtcctgtggctatgctgttcctgttgcctggattttagtgtccatgcatctctgcctattgacaccctgccagtccttcaaaagccaccttcaccatggagcctccccaggactcctcctctgtgtggccatactacagggcacattgcctggcaaggggtctgtgtgtataggtcacctgttacagtgtgaactacttggatgcagacactgattccttcccctctccatggagcccagcaggcgctctgcacacagcagccactgaatccagatggcgttgctgaatttaattgtatttcagaggggataggatgttaccctagttagcagcttagctatggttcctttttgccccgcaaagcagtagaaccctttttccaaatgaaacttttctagaaat

SEQ ID NO: 398533 - DNA, 385 bp, Homo sapiens
ccaggcaaccacactcatgccccaggatattcagtggggtgtcttcttcctcttattgcttcctcttactgcttaaaagagtagactatatccggtcgggcacggtggctcacgcctgtaatcccagcactttgggaggcccaagtgggtggatcacctgaggtcaggagttcaagaccagcctggccaacatggtgaaaccctgtctctactaaaaatacaaaaattagctgggcttggtggcgcatacctgtaatcctataatcccagctaatcaggaggctgaggcaggagaatcgcttgaacccgggaggcagaggttgcagtgagccaagatcacgctattgcactccagcctgggggacaagagcgagacttcatctca

SEQ ID NO: 398534 - DNA, 208 bp, Homo sapiens
tcctaaacttattagcccagctactttttaactgcttgaatttactattattatttttgccttgattttatatgtaaacatattcttgtctgagaatttactttttatttttcatgttcatgtaaatacattgtgttttgtttctgtttaatatactctattttttcccataattttcctactactagtgcacattttataaaaacaa

SEQ ID NO: 398535 - DNA, 389 bp, Homo sapiens
taggttgatgaaccaccctaccttccacagaaacctgagactggggatcttacagaactgatctacattcttctagaaccagtctgcaggctcatagccagaagggacttggctcgtctcagatgagactttggactgaagacttttgcattaatgctgaaatgagttaagactttgggggactactggcctggacctcaatccccaggtgtctgcaactcttacttgatatacacacaatggataatcaataatgattcagctaagtatggaaatagagcagagaagagcccctccaggtgtgagcagaaccttgaaggagacagggagcagccatgtggctctcagaggaacagcatttccaggaggaattgtgattgtatttctgg

SEQ ID NO: 398536 - DNA, 485 bp, Homo sapiens
caaaaagccttttgatacccaaaggggtaaatacccattatcagaaagtttattttccctcatgatggaagcttaataaagggtttctatattttggacaccagagaattgctcaaatgtgattttagtgtaataggtctttcttttttcattgagttgatttttaagcatttaatacattgccttgtacaactccaagcttctctataatcaagagcccaagctagatattttgtgggaaacttaactttaaattccaaacctttgctgaaattgacattgtcactttttgtgctgtgccttggatttgtattcttactcttcttgaggaaagatagaaggcagttgaactttgtgaccaagagcgtttcattggcagtccctgcatgattgataatttgtagatacaatattattgcatttctttacatgtattcattttcctgaagagtattatcttgtgcttttaataaaataacatgtga

SEQ ID NO: 398537 - DNA, 592 bp, Homo sapiens
atcgagtcggtactctgtaacatctatgcatgcttcttttttattcaggtttccctctatcctttcaaatttatcctgagtgctactttgctctttaatctaaaatcatttaacaatttgcctaattggtgtgtaaaacgtgctttttaccaaaatcggctctataactcaggattggaatttttcttcccttgactaaggctgcctgccgctgagatgagcccacagtctaaaactgcacatacaaatgttcttgctgttgtcattatcaaaacaaatgctattgctgcgcatgcttgtctgatgttgtactgagcagatacgaaggagtaggaaggagaaagaatgattctcgcactgtcttaaaattcctaatgtgtctctgacctcagcaccttaattttaaataatcagagttgcatatgtactgtgcttttggtttaagggctgaaacatacacacacacaaatcatctagaagaagataattttatatgagatatggtaatacattcaggccatgagagtgggacatttttcacaaacatgtctgatctcctagaaaacttttaagggtgtcccatagttggtaa

SEQ ID NO: 398538 - DNA, 481 bp, Homo sapiens
ctaatttttgtatttttagtagagatggggtttcaccatgttggccaggctggtcttgaactcctgacctcaggtgatccaacttccttggcctcccaaagtgttgggattacacgtgtgagccaccatgcccggcccatggctgtcttttgggagtattttttttttcatcgcctgaacagtttagatgatagtgtctttctattttcttcttaaagtaattttatgtgaatataatttgccatttgtctgtattcactttcaaattccttgaattgctctggtcttcagatgtttctactttagggtagctggaggcagggcttactcactaggttccttagctcaatactaccctcttctgttggcacagtgagtgcagtttctaaagtttactagatcaagcctttttgggagtgagggtttatatgatgtctgattctgtaatactgtctcatttgtataaacatattaatttcca

SEQ ID NO: 398539 - DNA, 449 bp, Homo sapiens
tgagtgagacatcagggcagcggctttgttacttgtgaaggaacaggaaaggcctgaaccccatccagggctttagatcctgggcttccctttctggcaacccctctacctcaaggaggccttggctaagagccttagggcaggcccagctcaagctgaagtcagctggcctcctcctccaggaagtcctccctgaccaccatgctctctctctgtacttgccatgttctttctctctgctgcactgtgggtctttttctacaggggaagctgaggccctccaggtacagatggggttaatacccacctcctacaggcaatagggtatgatgctgaccagggattttcaaacaaagagccaaagagctcagccaaggtcctgcctcagctctggaaagagtcttctgttacttcatcccaactgcttggtgccatcctcacacccacat

SEQ ID NO: 398540 - DNA, 502 bp, Homo sapiens
attaactatcttttttgggccaccatttgccttgggcctaaatggttctgtgttcaaaactaaaacaatgccaaatgcaaaaataaggaccagaaccaaacagggagcccctgtaagaaatgtgcagaaagaaggtaaaagccaggggaggggtgtcccagaccagaaggcatgaaggactagagggtgaagaaaggaaaaatgtagagggagagagggagaattccaaggccctggtgtcttacacctctctgggttttgaaatcaataaataggtattgagtatctataactctgattctcaggggtacttgtgttccttgggtgtaagatagtatgccagggatacaaaagatgggatacaattagtccgttttcctgctgctccagtgttataagtagaacttgaggagtatgaggttggggaagaagaggatcattttatatcgaaaccaataccaatatagagtcgataataaatttcgtatgattacaaaaattc

SEQ ID NO: 398541 - DNA, 431 bp, Homo sapiens
ctcctctaatccaccctctaccccatgggtggggcaatctgggtacacacccacctgaacatgccccggccctggcctgaaagctttctgtggctgccacaattctcatgatagaaccaggactcttggcctgccatgtaatgccctagaaatctaggcctggcacacatgtccagctttgccttgggccacctgtggtctaaactagcaaacagggagccacacaaggttccccccaaatacccttccacttcttttctccctgcctgggcagtagctgttccctttggctgggacctccattatctctcacacttgcctctgccttctgccagccctcccaaatgttgagatctggctgtttcatcctcagggccccatgtgctgcacaccacagcattgatgcacgtgtgcccattctcccatcagac

SEQ ID NO: 398542 - DNA, 434 bp, Homo sapiens
cccccaccccgtactccctggctccctcgtccagccctgttacttcagcggcagctccccgatgcacccccaccagcccgaagcttcccacaccttctcaggctctctcgcctccaggaacgcctcttccccctcttttcttcccctgtcttttaccccgttttctcaccccctgcctgaaatagctctaaatagttcctttcttttttcattaacacatttgatttcttatgagtcgagttaacacagcgtcactttgtaagagtgtctagataattgtctgggaattatggctttagctttttcaaaattatactttgacagtattgtgaataggcagagttcatctctgacattgccagcacctgttgcccatggctatgacatacttccacactcttcctcagttctagtcccgtcagcctccctccagg

SEQ ID NO: 398543 - DNA, 112 bp, Homo sapiens
atgcacatcagtaaggggcttggatagataaaattataatgcatgtaaaatgcaatactatgcagtcattacaagggatgaagaagtatatttactgatgtggaatgatacc

SEQ ID NO: 398544 - DNA, 315 bp, Homo sapiens
agaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatgtgagcccacacg

SEQ ID NO: 398545 - DNA, 2168 bp, Homo sapiens
agcgacgggaaacgtctctgaattaggtgttccgctcgcctcttgtgcggtgtggagctgcgcgccccccgccgaggcgggcccaggtacaggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgctggactcctgggccgcagcctgggccggactccgggggaaacggctccagaacagaaactgcaaaatgccgcctcggttcagggtccggagccctccgggcggtttttcgctcttagtgtttgtgggtttaagcctccccctactccgtttcccggagtttaaactttagatttactcgtttttggcagtcttgcacgtttggcagtgttttcctacagccagtcctagagtgatttaactatttctttttttatttaccgtaaccatgtccacttgctacgtttcttcccatttctctaaattttaaatcaatttctagctagtgatgctgttttcttgcgcccttgtttttttggggccagggagaatgggtaacgctacctttaagcagctttgataactgtttttgataaaggaagtaaatcttacaagaggaagaaaagaggactaatttttggttggctgttcctaaaaaagagcatcagttcttcaactgctgtttttcgtattgaacaacatccaagtgcagatgtgtggaatattgtgtcatttcctattactttatctgaatgagccttgcctgattctgcccttgaccctgttaaggcacggcagatggtcttcatcccttcgctcctttcgtctttatcgtaaagcactggcagaaaggtagcaggcccggtgactctgaacctgcttcccacactggtttaagtggccggacttagggcccctctggcctgggcagttccaggctccttctctgcaggtgctcagcttatggcttctaacctggtctggcctaatgagggtgggcatgcaggctggatgaaaagacctcacagcttttttctccattccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggcaaaaagaacagacttttcagtaaagtgttagttaccatcaaaaaagtctacatgaaggagaggagctttaaaggtgttgaatttgggaaaaatcttggtctaaaatcatcgcttattagaaaaccgagaatagtttccagaggaaggagaccccgttcacagcagtattcagttctctttaaacaactgggggtcaacacagtgcgtaaatgttataaatgtaatatctgtgggaaaatcttcctccacagttcctccctgagtaaacaccagagaatccacactggagagaagctctataaatgtaaggaatgtaggaaagccttcagccaaagctcatccctaactcagcacttgagggttcatacaggagagaaaccttatatatgtagtgaatgtggaaaagccttcagtttcaccacatctcttattggacaccagagaatgcatactggagagagaccttataaatgcaaggaatgtggaaaaacatttaaaggtagttcatctcttaataatcaccagcgaattcacacaggagagaagccctataagtgtaatgaatgtgggagggccttcagtcagt

SEQ ID NO: 398546 - DNA, 793 bp, Homo sapiens
agcgacgggaaacgtctctgaattaggtgttccgctcgcctcttgtgcggtgtggagctgcgcgccccccgccgaggcgggcccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggccaccgcaccgcactttcagtacgtgtcattaccatccacaccgctccatgcaggacaggctccaggtgagattgggaccactggctaaatctcgctttgcgacaatttcgagcagaacccgtcacgcgatcagtttaccacgggccaccggtctgttatgcacgggactctcagtctctgtcctgacctggacccacgcgcggcactacgccaccagagtcggcattcgtcccccttacgaggcaggagatacactgtgcacctcgagacgacccg

SEQ ID NO: 398547 - DNA, 1800 bp, Homo sapiens
agcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatattgttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaaccctgcctaaaatgttaatcttgtaaaaagtatgtatttggaattttcttcgttttaatagaatattataaagtcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaattaaaaaaat

SEQ ID NO: 398548 - DNA, 559 bp, Homo sapiens
tgccaggcaacgtgctgcatgtttacatacagggtctaattgaaaccttaaaacaagccactgagttaagtaccattacacccattttacagtttgtggaaactgaggctcagagaagttaagaaatatacacaaagtcatgcaagttgtagatgatggatctaaaaatcaaatctaggcttttctaaccccaagatctaaaatcttatccactatattagactagcccctccccaaatagcacagctaccaccagctgggtgcccactgtgtgccaggcacatgatttcatttaactccaatcccatgtcatttggtgatggccctatgtcccaacctctgtcctaggtggcagaggttttagccactgaactcaggttcccatgtgttcagagggaacatcctcagctgtaggtgggttaatcatgacaatgactttacagggcttttagagaattaaattaggtaactgcattctgtgctctgtactgcacatgctcaaataacagtattagtgcaaagtcagaatcagagacaagctgtgatcttatacatagca

SEQ ID NO: 398549 - DNA, 169 bp, Homo sapiens
atcaccatcctaaaactaatttgttgaagaaactggatttttttgtcctgtagatgttccctcagttgcgattttattgattgcatttctgtagttggttgaacattccccatttcccttatgtttcctggaagtcagtagttgtatctagagctcctctgcccaatat

SEQ ID NO: 398550 - DNA, 139 bp, Homo sapiens
gcctgcctcggcctcccaaagtgctgggattacaggcgtgagccaccgcgcccagcctgtttttttttgttttgttttgttttttaaataaaagcagaaaaactttaacaaatataatctacagtatttattccattca

SEQ ID NO: 398551 - DNA, 477 bp, Homo sapiens
accagatgtttggggaagggaagaggtgtggagataattactagagtaggggatacatgtgtcacttcttacaaggattgaaaagaagtttcctattatgccaagtgagatgacacaagaagcagatcttatttctcaatattgatgccttagtccaaaaggaatgaatccattcttctgcctccaggcaatgcaacattcaaagagattgggtttttgttcttttttcagcattctcaaagaagggcattccggccttctttaaccttgcattccagagcctcacagtgcctatactcaggaaataacttcctcaggtttaacttcaatccctctccctgcaatgtgagaccattgctatcctccaaggattggaagaacagctgcctggcaccttgccagtcacatcattccactttcccattgttcagcaaaggaaatggctctgggaatctgttgcttggctcctcgtccgtc

SEQ ID NO: 398552 - DNA, 857 bp, Homo sapiens
gactagttctagatcgcgagcggccgccctttttttttgcctcagcacacattttagttttctcattctctcgctgttagatagaatattcttatgtatttttttgctgttccaaagttagtttcatctgtttgacctttttgtaaactgattcttacatgcatcttacttgactgctaaattaattttttaatttgcccacaccgtgacaaaaaggcagtcttccttatgagcttcaagcgtgaagtcccggagaaagacactgattggcccagcttgggtcatgtggccatcctgaagaaaagaaatgggctattatgatcatatgcccatccccgagggtgaatggacagtgggtactgtggtgacagctctatcacaacaatgtgagatgtgaaatacaggtttccaaaggaaggaagaatgttgggtaggtaaaaaacatgctggataatgcctataatcccagcattcaaggaggccaaggtgagaggatcccttgaggccaagaattcaaggccaacctggccaacaaagcaagacttcatctctacttaaaaaaaaaaaaaaaaaaagggccgggtgcggtggctcacgcctgtaatcccagcactttgggaggctgagacaggcggatcacctgagattgggagttcaagaccagcctgaacaacatggagaaaccccgtctctactaaaaatacaaaattagccaggcgtggtggcagatgcctgtaatcccagctactctggagactgaggcaggaaaatcacttgaacccgggaggcagaggttgcgatgagccgagatggcaccgctgcactgcagcctgggtgacagagtgagactccgtctc

SEQ ID NO: 398553 - DNA, 452 bp, Homo sapiens
cctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaag

SEQ ID NO: 398554 - DNA, 305 bp, Homo sapiens
ttttttgagacagagccttgctccgttgcccaggctggagtgcagtggcacgataacagctaactgcaacctccacctcccggggtcaagcgattcttgggcctcagcccaggaatttgaggttacaatgagctatcagtgcgccactgtactccactctgggtaacagagtgaaactgtctcaaacacaacacaacacacaaaaaaattgctttaatggaagaactcagtaaattatacctttctccaaggagaaagatgtttagtttttgaaagctggcaagggtattcactgaaacattact

SEQ ID NO: 398555 - DNA, 614 bp, Homo sapiens
aaaccatgatggcaaaaaactaagaaaactgccatctgacaagagattaataatcagaaaatataaggatctcaaacaagtctataggaaaaaaatcctagtaatccaattaaaaatgggcaaaagatttgaatacatatttccccaaagaagacatataaatggcaaacaggcatatgaaaggtactcaacccaaaacaggcatatgaaaaggtacttgacatcactgatcagagaactgcaaatcaaaactacaatgagatgccacgtcaccccagttaaaatggctttatccaaaaaaaagaaaataacaaatgctagcgaggatgtggagaaaagggaacctccgtacactgctggtggtgtgaaaggaaaatatcttaggcccccagaattacgaagctaaagggaaaagtcaagctgggaattgcttaaagcaaacccacctcccgttctattcaaagtcacccctccgctcactgagattaatgcatatctgcttccctcctttggagaggctaatcatcaactcaaaagaatgcaactatttgtctcttttcttcctatgacctggaagcctcatgcctgcattgagttgtcctgcttttccttca

SEQ ID NO: 398556 - DNA, 288 bp, Homo sapiens
tagagtgatcccggcagctatacggttcaatgagtcacaaatcaccaaggaaactagaaggaggtcaatgatggtttccaaaaaggagcatctctagaatttccttttggagttaggtaacagaatgggaacttgcttttagaatgaatatattccaaagaaaaaattcactcatcttttcccctcatgaccctgggaactgcctccaatccttgttactcaaaatagttaaagatgtacacagaacgaacatgacaatgtctgcatctaaagctgggggccagtgag

SEQ ID NO: 398557 - DNA, 540 bp, Homo sapiens
atattgtctatggctatatttgtgctttgatggcacaattgagtagttgtaacagagatcatatggttcgcaaagccccagatatttactatctggtcctttacagagtttgaccacccctgcactacattataagctccatgaggatggggacccagtctcagctcttatacccccagggcttcacacactggctagcacataatggaagttcgtacaatcgaaaaagttctgtagggctccccatctagaggcagtatatctggtggtggaggatggattctagagtcagacaacattgggtctgaatccctcttcctccacttactagctatatgacattgagaaatttaatctctccaggactttttttcactgtctgtaacatttgggggaaatatgaatagtggcaatttgttgtagacattaaaatcagatgatgaggtcaagacaacttccataaatgctagataaacattagctattattatcatcatccatatgtattatgacctcccatatgtctctgtagattagacc

SEQ ID NO: 398558 - DNA, 480 bp, Homo sapiens
ctttggatgcggcctattggagggcatagggtgggagaagggagaggatcaggaaatatgaggagggggcactagaatttatatcctggtgatgaagtgatctgtacaacaaactcccatgacacacgtttacctatgtaacagacctgcacatgtacccctgaacttaaaagtcttttaaaaatgaaagaaacctccttctattccatactctacctgtcaaagtgaagtataaaacagtcacctcacccatccttctgtctggatggtgagctcagtgtgctggtcatgccagtcagtattatatgagagggcagcagccaggctgctagatatgggattgtggttctgtgtactcacctgctgtcacaaccgcaatgatcattttacctgtcacagctatgacagtgcagtcctaggatgctactatatttttatttatttatttagagatggagtctcactctgtcacccaggctg

SEQ ID NO: 398559 - DNA, 537 bp, Homo sapiens
agccgagaggcccacctttgcaagggaattggtgccttccaagaagacactcagctctgtgacagccaggaccccagtcaccaggttcaaagccgcacagagatctaataacatgtatctgaggccagagtaaatgaggaactttttgcaaagaagcataaaaggaaagagatcttggaatacctagctaatctcagttgctgtctctgctctgaagccctgcctttgaaagctctatttctcctcccatcctctgcgaaagccagatgagacttcttgacattaagcaaatgctggtatactgactttggtgtggggtttgtacatgtgcctgttgagagctggatccttcccgtgggtggatgctggcatggtggctcttccatctaaggatccatctggaaaagtggccgatttcatcacttacgtgccaggacctcagatgccgaggcaggggaatgctgcaatctaaacatttacattctaaaaaatgggaaatcatctgcttcgatataaattagccagggcctgacgggt

SEQ ID NO: 398560 - DNA, 318 bp, Homo sapiens
tgattgttggaccaacagcacctgtagccccccaaggtgaggttggtgagatggggcatgttggcccctgtcagcagtggctctaggtattgttcatggtgttctttggggccccctcactttcctgttggagggactgcgtgaagaccccataccactgtgtctggctcccactctacctgctccagctgcaaggtaggcactcactggcaccttttgttgcagacaccaagaagacgagaaagaagccaagacagaagaaaccagaacccaacctcttgtgggaccggttgacctccccatgcctgccaccaaccc

SEQ ID NO: 398561 - DNA, 600 bp, Homo sapiens
agccgggtgtggtggtgcatgcctgtaatcccagctactcgggaggctgaggcaggagaatcgcttgaacccgggagatggaggttgcggtgagccgagatggcgccattgcattccagcctgggcgacaagagcgaaactccatctcaaaacaaacaaacaaacaaacaaacaaaaagctgccttggttcctttgggtcccctgctatcccaggtcagggtagggctgagtaaggagggaatgtggttcagatttgtgccagagaagaaacgctttaaactactcggggttgggggacggtgttccgctgggcctttccagaagtcttcctaagtcaatagttctttcttgacttttcttctcccatccaccaactggccatatcaaatccaactcctcccatccctaaaaagctgagtgggaagctgctgtcagtcagccctaaccccagggatacgcgaggcctcatcttgcactgagggaagatcaacctcagatggaattcagcttctcggaagctttgtgactgggaaagaagcaggcaggcctcgaagggtttgcagaaggagcccagagtgcccctagggctgggtcactga

SEQ ID NO: 398562 - DNA, 547 bp, Homo sapiens
gtgcaatggcgcgatctcggctcaccacaacctccgccttccgggttcaagcgattctcctgcctcagcctcccaagaagctgggactacagatgggtgccacacgcccagctagtttttatttttattttttgagatgaagtctcactctgtcgcccagactggagtgcagtgtgagactccatctcaaagaaaaagaaaaaatttgttcaagatcacacaactagtcagcggcagaaccaggtttcaagcctgggcaggctgactctaggaagtatattctcaaccacctgagctgaatcactgggcaagatcctgggggcacaatgcatatgtgtgtatgcgaggtagcgggtacagaataaacacagaaatctggatatgagaaataactgtggaatttataattccaaccaaatgaaatccagcaccttgataatcatgatctgactacaatattattaaacaaagctcgaagaggaaaataggaatactaaaaatatcacattaagaccaagatgagtccattatcaccaatgctctacag

SEQ ID NO: 398563 - DNA, 323 bp, Homo sapiens
cgcagcttagtggctcagtttgctggagatgcgcagtgtctgcctcagcagtctcagcagtttctaactaaagctgactttagttagaccgaaaccgaacacatggcatcctgccaggatgacctgaagtcatcctcacctttcctttccacataaagccggcccatacaccttttctttggaactaacccaccagatcttagaagatgtacacgtgcttctttcctttttcctactctacctggctagtctttagatatgtttttcttcgtatgtggtgtttatacatttcacatgaatatatcaaacttttcattcaaatc

SEQ ID NO: 398564 - DNA, 526 bp, Homo sapiens
cttcccagggccacttttctcacttgccagatctgggatttcttattaggagtatctcgagaaagatggtggaaggcatgacttgatcccaagagtttctctttttgactcctagaaatagcctttctcacctatcatccttctctgcctttttttttttttcaaactttcttcaagtactctttaaaaacagtttaaatttcattaaaaactgtagcatgaattcatattccaactcattccagtagcactttaggaaggacttttctaggaaggaggttttttgttctgttttaaacgcagtaagacctagcttcagagcactctagggctctagctaatttgttcccctttgtccctaggtgctagtcatctaatgaatgaggtgtttcttagcattatctacagatatggctttaccttcaattgtgtcaggttacatttacctaatgtcagcaagacttcacatttcatgtatgaatatccagatgaaataaagtcctggttgtattcaccatcaaaaaat

SEQ ID NO: 398565 - DNA, 107 bp, Homo sapiens
catgcatcttcaggcaattttcctgtcttcctgtttacaggctgtctatgttcagctcactccagtagggctatgctgtcattcattctccccaaagtgtagtggga

SEQ ID NO: 398566 - DNA, 566 bp, Homo sapiens
ccagccatttgagtgtgcagttgtctggagcagccacgcagcaggtctctgtagccctgatggagagagttttcttcttgggagggcttcccaggatgatgtaacacctctgcgttttgcctcagtggctgaagagtccctttggacttgggttttgcagaaagagaggggagtctgagggcagagtgtaaagtgacacagccggtgtgtagagctgagcagcctgtgttaggaacagtcagagcctgtggacttgtgaggcttccactcacgtgctatgttagcagttcttttcctcaagctctactgaaagacctgtggacctgacattttatggtcacaagccctggagaagatagccattcattttgctggatgaccttttaaataaacctctagagtaagttccaggcaaatactggaggtggctgtgtttgcccaacagaatccagcaaaaacacttctctgtgcttgaaattccttcttgtacctgatgctttggaatttaggcaggtgataaattaaagatgaatttcttctttttttttaacgttacaatatagtta

SEQ ID NO: 398567 - DNA, 643 bp, Homo sapiens
cgagaattcgttttaacctcgtcactgactggactagactgtaaactccttggcgtctgggatggctcagccgtgcccagcaccaagtgcaggcactcaaacccctgtggagtgcctcagactacttcaccatagtcataaatcctgtcacatcccagggatgcagttcatgagtctcttaatctagcctgaactctacttttgcattcagacaggcaggggatgcctcatcctttgaatactggcacattaagagcagtgacataggtaagaactgaacccaagcactataagagaggatgttaagcaagatctaaaaatcaacgtgatcaacaagagcagtaatcttttcttttccaagaaaaaagaatggaagaaacagaaggtactgggcgcaatgtattaaacactgtgttttgaatgactcgagattctacgactgcctggaggggttttgctggatcggtgcaatgtcatgtgattattggaaattaatcccttttttcaagaatttttcaagaattaggttaagttagatttgagcaaacttaattaccttgccaggcatttgtttttcagaaacataataatctatgtatttgattcaattagtagtaggcccatgggttgttctgtaaatcac

SEQ ID NO: 398568 - DNA, 476 bp, Homo sapiens
ttaaagaaaattgcctaaagacaatgcaagataaaggaaataataattaagccatccccagggatagtggatgtacctgagaaccagttactgatcatgatagagtagaacaaggactggcatgaggaataggaggcctgggctttattcctttcatggtcacaagcccaagttttagttgtttcatctagaaaataaaaggcttgggggagatccatgctttccaagtgtactatgcatgggattcagctgtgaagcgtgttaaaaatacagataccttaggtccatctaagtttggaagaatttgaacttagggccagtgcccatgaatctgtgttttttactaactccatagtgattgggacctacaacaaggtttgggaaccactgttccagggatgtctaggatttttatttcagttcggaatggatatgacactcaatgtctacatcaggggaatttcatcactgagaca

SEQ ID NO: 398569 - DNA, 484 bp, Homo sapiens
accatgaccacaggggcctcttccctgtcccccctcgcctacccccgtctgtcctccatgcagcagccagccagccaggtgatccttttaaaacacaatccgatcaagttcttcctctgcttaaaacgctcagtgattcccctcagacatggattaaaatccctgttcctcgccctgacctacaagggcctgggtggtcagtcctggatctgtctgcctctggcctcagcccctcccagcttcctctgcacagccctctgcctggctccttcctggaggacccatccctgctagtggggttacccgacctacccctgccctgcactgacccccgccctcctacctcgttgcacaccagcctctgagatgaccttctcggtcctgtttaccgaagtttcctggtactgggggcagcgcctggggcagagcaggctctgtcaacccccactgaatacatacgctgtgcaggtgcttagcactcggt

SEQ ID NO: 398570 - DNA, 511 bp, Homo sapiens
caaaacaaaacaaaagaaaaaaacacctagagagtgagtttgcaacacagatttgcaggactggtgcctacaagtagagagagttttttaaaccttatatgaggttaggatttcgggtttctcaggagccaggtttaatataacctatagcaagttagtttctcagtcatccttcagtcatgaaatgcattatggtgcacacacagggtttagatttgtgcaacccaagtgtaggtgtattgtttactttcaaataaagacttacagtgacattgtatccctgagtctcctcttgacaagcacagtatttcagaaactcttggcggcagttccagttcagtatggggcctggttctcattttagtccaagtcaaagcagctgagggggttctaccccagtgtgtcagggggacctgtcataggcatgtcctctacttggttccagatttaacccctgaatgattcagggggattttagtcacatgagatctcagacgctgacttggaagtg

SEQ ID NO: 398571 - DNA, 922 bp, Homo sapiens
actttttgcgtctttatgcaaaagattttttttaaactttttagttctgcagtattgttttggcagttttataccatttggaaaggcttagtattcttcagaggcactgttacaatgaagcaagttattcttcagtccaacattaggtaccacaatagccatagcatctctttttagctatttttaaatgtgttttcataagcagtatctatagtttcccattccacattttaaaaaatatttgatatgtcagtcatttgcttagaaacttttttagaaagtatattgcaaaatgatagacaaaaacattaattgatgatggtttaataaataagagcatgcaattagtgaatctttaaaaggctgttctcacatggatgattatttttgcagaattgaatacttaaggctttaattttatacttattgctagatcattatatccaattattttgaccatttattcaaataataaaccaagtctgaatatttatagtgaagaatgagttttgtgaaaggagaataattatatgtctctctctctgctattttattctgcctgccatcagagtacaaaaatatacattcacatcatctgtttgttgtatcatattcttggatcatacagatttagttacaatacacacacaggtcagccagcgttaaaagactgaaaagaatgaaaactataaatgaggacagatgagctatgcattatgtaatgacaaaacaggtgtctcggaagataaacaatgttcagaagcaaagaagatttaaatacttttgaatctctaattactttattctggttattagacaaagcaaatagctttcaaatgaagtctaaactttctgtagtacaattgaagtacataatgttgaatagctctagcttcgtttacttttttttagaaaggcaaac

SEQ ID NO: 398572 - DNA, 972 bp, Homo sapiens
acttggaagcctgagtgggaaggactgcttgagcccaggaggtcaaggctacagtaagctgtgattccgccactgcactctagcctgggcagaagagcaaggcctatctcaaaaaataaaaaatgaactggactagtgatagatatccaaaaccaccagcctgaaaaattctaatagtctcctacctgattttgctacctgcatttgcacttcacttctggtttgtcttcccacatggtcagcatggacagcttcctaaaataaagacctgcttatggccaggcacagtggctcacacctgtaatcccggcactttgggaggctgagatgggaggattgcttgagcccagaagttcgagaccagtctgggcaacatagtgagaccccatctctttaaaaaaaatttttaatggaaaaaaaaaagacctgcttatgtcaccccttgcacaaaagttctgaatggctctccagtgcctgcatatctgaggccatacttctttgcttattatacaggtacactcaaaatatactgaaacctctttccagctttattctcttgtcaaataaaaataactagtatttataaaccatgtgtcagcctctggcctaagacttttgcctacattatctcctgaatccttgtaacaacccttaaactaataactacttttactatttcagttccacaaaggaagaatctgaagtccagaggtgtaatacgcccccatgttacccatctagaaggccctcatgaatatcacagtaatgttgggatgctggcattcttccccaaaataacctacattcccactttccacacctttgcagtcaaggctctctctttactgaatgcccttttcctatcttcccactctaatttcccacctctaattttctccattcagccttcaggcactagataaaatgctatttcctccataagccttctctaaacatcatcctattcatttt

SEQ ID NO: 398573 - DNA, 487 bp, Homo sapiens
gcaccttgaatattcctttttcaagttcctcttcctcaggagatattcaaggtcactttgtcacccaggctggagtctacaatggcaggatcttggctcactgcagcctctgcctcctgggttcaagcaaattcttgagcctcagcctcccgagtagctgagattacaggtctgtgccactacacctggctaatttttatatttttagtagagacggggtttcaccatcttggccaggctggtcttgaactcctgatgtcaggtgatccacccacctcggcctcccaaagtactggaattacaggcatgagtcacccctcccaggcccccccctttttttttaatcctaaaaagcttcctaagggttggtcagagcagttaactccagtgaatacctcttctaaagactcagcaaaagggtcatttgtgcctctttaactgttcttaccaaactgtcctgtctcttttctgctgccaactaagcagc

SEQ ID NO: 398574 - DNA, 354 bp, Homo sapiens
tggtaaacagggaaaccatcagtggcccccacgctctcaggcctgggggtttctatccaattccttaaatccagtctctccttggccagcccagattcttctcttgatggtgtgcccagtagctttctctttaaccacagtcttagtcctggatgagccctttgtattccaaggatctcttctcctctacttccttctgccaacttcttactcatttgtcttcaataatgtattcaaacatcttaactgttgtatctactccatgccaggcaggtacttgagcactggtgggggaggcattcggagatgagtaagacaaagacaaagaactcaccattctatcctggtatcagg

SEQ ID NO: 398575 - DNA, 536 bp, Homo sapiens
cagggactgcacagaagcgaggtcttgtccttcttgatgcattggatcaggaggtacacgacactccccatctcatggccggtgatgccagctttgattgttcagttaagatggcatctgccaagtttctccactatcaatttactattttaccctttgtaattcatacgtatctcatgggggaatactttgcaactctatgagtattgtgtttctcatcaaacttttgcctgctactttcagcattcactgatgatgcttgcctgaaacagtaactactgcagatatactgtatttgtttcccagggctgccttaacaaaatgccacaacctgggtggctttaaataacacatttgtcatctcagttctggaggccagaatgctgaaagcaggtgttggcaggttggttgcttctgagagctgtgggaagcatgtgttccatgctgctcccctagcttctggtggtttctgcaatctctggcatcccctggcttgtagatgcatcactccagtcctgtgcctttacatggtttct

SEQ ID NO: 398576 - DNA, 428 bp, Homo sapiens
aaaatcgcttgaacaggaggcggaggttgcagtgagccaagatcacaccattgcactccagcctgggcaacaagatgaaactctatctcaaaaaaaataccaacctctaaaaaatccacgttggccacatggccttgagcaaataaaagagtaccaaacttcatcttgagttcgagttggcctcagttcctcttcccctcttcagacatagaggactgtgagcataattgcactgggggtggccttgcagccattttttttcttcaccaaagagaatgagagccacaggtcaaccagagcctcttacgtgcctacttacattagggttcctagactgcctggctgccaggagtctcttccatctcccatccttgggcggaccacttgaggtcaggagttcgagaccagtctggccaacatggtgaaac

SEQ ID NO: 398577 - DNA, 414 bp, Homo sapiens
caccccatcaggcctctgtgcacctaccctggatccagaccaccacaggacatcagggaagtttgcctgagaccccaagtgcgcaatacttgtgggatgcttctgaaacacatgtacattatgtacattactctttgccaatgcatcttgcaagaggctagaatgtggtggggtaggaaacttgccatttaattttaccttcctggagatcctagagtcaaactagtgtgtggatctgctggacacccgtaatgagctgcaccttgtcccaagtgttacagaggtctggaggcctcgggactcagggtcagcttggcagtttccacgtgccttcccccatctatattgtatttttcagtaagggattgcacacagaaatcaaataacagaaggtgcctgtgtgagaaggggatg

SEQ ID NO: 398578 - DNA, 497 bp, Homo sapiens
tcttgccttagctccagtctttcctgcctgctgcctcctttctgctctggtcaagaaccacccctctccagcaccccctacagaagtatcccgctctccccaggccacagggcacagcccctctcctttgttctgacacccctcccagagatggagcctcagactccatctcagaccctggaaaggggtcccgatccagaccccaagagatggttcttggatctcgcacaagaaagaattcagggcgagtccatacagtaaagtgaaagcaagtttttaagaaagcaagtaatggccaggtgtggtggctcatgcctataatcccaacactttgggaagccgaggcgggtggatcacttgaggtcaggagttcgagaccagcctggccaatatggagaaactttctactaaaaatacaaaaattagccaggcgtggtggcacatgcctgtaatcccagctcctcaggggctgggacaccagaatcacttgaacccgg

SEQ ID NO: 398579 - DNA, 590 bp, Homo sapiens
aagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggtacttga

SEQ ID NO: 398580 - DNA, 230 bp, Homo sapiens
gttgatgaaatcaataagtatacagtgactcaaacaagatgtggtggcttatttccctcatctaacagaccaggggcgggctggagtccacagcataggagatgtgtttctctgtcctgcaaagttgtcctggagaccagattccttctgtctagatgtcccaccatccctagagttgtgtcctcatctgcatgttcaaactgacacacatcatcacacccaccagatcg

SEQ ID NO: 398581 - DNA, 192 bp, Homo sapiens
tcaaagattgctattatcataggatgggacacaccctcaataatacgatggcgctggtgattctcatctgtgtccagcattgaacatcaaggcagtttcccccatattgagaactgaggtcagtctgtgatccacagggaggtgagggggctgtgctctgcatggggtttggttagggccagatctgtgtcc

SEQ ID NO: 398582 - DNA, 369 bp, Homo sapiens
tgaagagagtctaacaggtttaagtgggtcagatgccatgactcaacagcttccccttgatcctttaatctcacatctgaagcataagacctatccaggttacttggggcagcaccaccattgtaccattaaggcttctctttcagaaggatgaataatccatctgcagcactattttacactctagttcaattcaagactctgaatatgatttataagtgtgagtgattattttaagatcaaccagggttaagccagggaaattctgtcctctggtagggagcctcaatgaccagaccactgtaaagccccaggaatgccaagaactctgaagaagaaagattcacctctaagtgagttggaggaggc

SEQ ID NO: 398583 - DNA, 359 bp, Homo sapiens
aaggatcaacatagctagtaagttacagactcaaaacttggatgaatggtaagttctgtaccctttatatatcatgatgttacatcccagaagacccaagcctcacaaatctgtagaaattcggtttatccacttactaatcatatccttcttaatgctctgtctcacatatggagaatgtgcttttagagacatgagtaaagattctgcttggaggctcaagcactaaatgtgtattacatgcttgcttggtttctggaaccccttaaccacacagtatagttggagtggtgttgatactgggacctctgtaagtttgttgtgtgtagttttctgcagctttgcacctcctagggccc

SEQ ID NO: 398584 - DNA, 534 bp, Homo sapiens
tgctcattcttctccatgaagttgaatccttcacacaaaagagaagatgccatactctctttcttggacccaaacactccttccaccccttgtttcaggggctgacccaagatgaaaagccccatttcatcaaaggctcctcagtggtctcacacgaccctccagagggctggggagtaggaatctggctgttgctgccaccaaagggtggattgtggggcaccaggcttatctaccctagaacacaagaaggtgggagtttcctaaagtgtagaccagttccagaatcatagaatcttagaacaggaacttaccagctttgtgactttgtgcaagttataaccactccaagctttagtttataaatctgtaaaatgggtaaaaaatccttgcctttcagtgggcacctgtaatcccagctactcaagaggctgaggcagaagaatcacttgaacccaggaggtggatgttgcagtgagccaaggtcgcaccaccacattccaggctgggcaacagagtgagactctgtctcca

SEQ ID NO: 398585 - DNA, 360 bp, Homo sapiens
accaagttggaggtgcgtcctccttttgccagacctcctcttgtgcctcttgctgtatgcagagcgtcgtgatgacagctcgtcaagctttccaatttgagtcttcagctatccagaagctgtgaaggggcagccccgtcaccagacacaatccttgcaaagggacagcctccatcagcctccatggaagactgacagacccacacaggggagaataaatcaacctgcaaatgaagcattcagccagcttgggagttctgctttccattttaaattaatacaccggccttctggtttgtacatcggttgtcctcccgtgggtctggctggtaggcattggtttctgaggggctggctgtg

SEQ ID NO: 398586 - DNA, 326 bp, Homo sapiens
agctttgatgaggccgatgcacagtgcgaatttccagaagcgggctcgtcaagctttccaatttgagtcttcagctatccagaagctgtgaaggggcagccccgtcaccagacacaatccttgcaaagggacagcctccatcagcctccatggaagactgacagacccacacaggggagaataaatcaacctgcaaatgaagcattcagccagcttgggagttctgctttccattttaaattaatacaccggccttctggtttgtacatcggttgtcctcccgtgggtctggctggtaggcattggtttctgaggggctggctgtg

SEQ ID NO: 398587 - DNA, 439 bp, Homo sapiens
cccagatgggtccacagcctttgggggactgtgacagcatcacggcaggacgggtgctctgtaatcgttacgcaccaggtgtcttgggagcagaggaggtggctccccacaaggtcacgttgtgctgatgtgatgggtgagaacggtgaacgccaggctcgtcaagctttccaatttgagtcttcagctatccagaagctgtgaaggggcagccccgtcaccagacacaatccttgcaaagggacagcctccatcagcctccatggaagactgacagacccacacaggggagaataaatcaacctgcaaatgaagcattcagccagcttgggagttctgctttccattttaaattaatacaccggccttctggtttgtacatcggttgtcctcccgtgggtctggctggtaggcattggtttctgaggggctggctgtg

SEQ ID NO: 398588 - DNA, 262 bp, Homo sapiens
ggcaacagctactcagcttgctaatcctatctcctgctgggcccacacaaattcctagcggtccacagggacatagtagttgagggctctgatagttgagaagttacattcctctaatttaaaactgaaaataacgtcagactaaaactgcccactcatcactccggcacagtaagctgctggtttacactctccctacagcagagcaagtgaattgacccagacatcattttaattcatgggggttagtggaccctacacc

SEQ ID NO: 398589 - DNA, 547 bp, Homo sapiens
  misc_feature (180)..(180): n is a, c, g, or t
cggtaccgactgcaatctgtgcctcattagttactggcattctgagattaatcccaaatgatcatggagtgcctacagtgtgcctagctctaagctaggtattggcaggaagtagcagggatcgagccagggggcctctagctaatctagctggaagggtggacagtagacaggtagttnatacttacatggttcgtgctttcacgcttttctgctgcagaatacccattccacacacacacacatccttgagatgcctagtaagtagagcctttgtagcctgaagataacactgtgagtgtatctgcacaggctgggctacctgagaagctgttggatttggtgccttgttaggctgacttttcctactgctgggccatttatggttttggactaattttggttgcacctgctttgatgatatgtcaatttggggttaaagatagcatcccttcttgagggttttatctaggcacaacctaactggtagtttgttcagtagaaatgtcattatctaccattgtgtttcccagagggacatctttgt

SEQ ID NO: 398590 - DNA, 763 bp, Homo sapiens
aaaatcagctgggtgtggtggcgtgtgcttgtaatcccatctactcgggaggctgaggcaggagattcgcttgaactcaggagggggacgttgcagtgagccaagatggtgccactggattccagtctgggcgcacagcgagactctgtctcaaaaaaaaaaacaaaacttcccttttctgctggtgttccaggtaggtgaggctatgtgataaatagaacctggatgtttaattataaattcaagtagcagaaaaaaattccaatttttacacctacagtgcaaaatatcaaatgacattataggccattttaaaattctttccatagcctcctaaacagatttgttaaaataaaaaactaattcaaaagactagaaagctactaaaatagaggaatatacaattttatttcaagtacagttaattaatttttttttagagatgtggtcttgttatgttgcccaggctggtctcaaattcctgggctcaagtgatcctccagcctctgcctcccaaagtgttgggattacaggcatcagtcactgtgcacatcaacaattaatagtttgagagtcactggcaatgacttgtaaaaattttaaagcaacgaggccaagacaaagtttaatatattgggactatattttgtctaaaaaaattagagaataaaaatgttatataactcaaactaataaaacacaatgggaattctattaccaagatcaatgctgacaggcaacactgaaatgaagttagaaaaag

SEQ ID NO: 398591 - DNA, 492 bp, Homo sapiens
ctccacacattccctctggctgcaggcccctgggatttttctgtgtgaccccgtcacattgcatctgtatagattgtcaaagcacctcatgactgtggaggaagaagtcggggacagaacatggatctggaaggctcacagcatggatttggtagggtgacacaatgtcccatgttcttcaagaaatgtctagactaggtgattgattctatcgtagatctggcacaatgctcctgccacacagggggcaaattgagatccagagagaagtgactggcccaggtcactcagccagctggtaacttagctggaattcgttcccaggtctcctgacatccagttcattcattttttgcacgtttcctgaggacttactgtatgctaggcactgttgtaggtgctaggcatatacaaagtgcccgtatagagcttgtgtcttgtagtgtgtgtgtggggagattgtggataaacaaataaacagatttatccaga

SEQ ID NO: 398592 - DNA, 265 bp, Homo sapiens
taaatattacctgttagaagtctttttaggggtctctgagcagacactctgatgtttccttggtcaggattgcaccattggcccactgtctacccaatctttgcggatggttgtgatactgcaatagtgtttcaatcctaggggttggggaagggctcggacccctctatagcacagagccatgggccatatgataaacgtcaggtctctagaaagagaaaagggaggaaaagctagtaagtggggaaagctagtatgtgtttgc

SEQ ID NO: 398593 - DNA, 233 bp, Homo sapiens
caataattacagtaaaatgttatattacatgtattaaaatatttttgtcatagggcccaagaaattagacaacatcagaatgcgacacctggatctaagtttcacaattttaattcacgtttttgttttttataacttcaactttttttttttttttttttttttttctccaatttttttacacctttggggagagaggggagtttacaatctctggggtggcccagaggggg

SEQ ID NO: 398594 - DNA, 248 bp, Homo sapiens
tccgtgtcgacctgcggcaaaactgtgaatggtctgacttcaacatgcctgaaagtgcacagagaaacccaggcaggaggcaccaagtcgtggctgatactctgggaccgcaggggccggggttgggtggtggcgccgcgtccagggcagcaaagcttcccgcacacgctgtcccttctgagcaccagagccgagacctgcttctaacgctggacccaagcgatgaattattgctacagagcggccgc

SEQ ID NO: 398595 - DNA, 251 bp, Homo sapiens
gagttctgataaaaggcagctgagtttggaaggattgtagcctcaggatggctcctctgccttttgacccatggttgaggaaattctgcctcagcagccctgtctccctttctgcatccatctcatagtccccactggtgatcccccatctcaagtagcaaattccaaagacgttggagaatgttggccttgttggttgtctcatatcagaaataatctgagagttgcttgtgaattgcaggactatttag

SEQ ID NO: 398596 - DNA, 1690 bp, Homo sapiens
ccggcttttgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtcttggccatggcctcggtcctggggagcggcagagggtctggagggctgagcagtcaactcaaatgcaagtccaagaggaggaggaggcggaggtccaagcggaaagataaagtaagcatattgtcaaccttcctcgctcctttcaagcacctgagtcctggcatcacaaacacggaggatgacgacaccctcagtaccagcagcgcggaggtgaaggagaaccgcaacgtgggcaacctggccgcgcggccaccgccctccggggaccgggcccggggcggcgcgcccggcgcgaagaggaagcggccgctggaggaggggaatgggggccacttgtgcaaactgcagctggtctggaagaagctgtcgtggtcggtggcgcccaagaacgcgctggtgcagctgcacgagctgaggccgggcctgcagtaccggacagtgtcgcagacgggcccggtgcatgccccggtcttcgcggtagcggtggaggtgaacgggctcacgttcgagggcacaggccccaccaagaagaaggccaagatgcgcgcggcggagctggcactcaggtccttcgtgcagttccccaacgcctgccaggcgcacctggccatgggcgggggcccgggccccggcacggacttcacctccgaccaggccgatttccccgacacgctcttccaggagttcgagcccccggcgccgcgccccggactcgcgggaggccgccccggggacgccgcgcttctgtccgcggcctacgggcgacggcggctgctgtgccgcgcgctggacctggtgggcccgacccccgccacccccgcggccccgggcgagcgcaaccccgtggtgctgctgaaccgcctgcgcgccgggctgcgctacgtgtgtctggcagaaccggccgagcggcgcgcgcggagcttcgtgatggccgtgagcgtggacggcaggacgttcgagggctcggggcgcagcaagaagctggcccggggtcaggccgcgcaggccgcactgcaggagctgttcgacatccagatgcccggccacgcgcccggcagggccaggaggacgccaatgccgcaggaattcgcagactccatatcccagctggtcacacagaagttccgcgaggtgacgacggacctcacgcccatgcacgcccgccataaagcgctggcaggaatcgtcatgaccaaagggagggaattccactctgagaaacaagggtgacccagccgcgaggggcatgctgagagccaagaaggcgtcctctccagtcagccaggatgggggaagatgaatgagggctaaatttgatcaatcggccctgtggaaacaacgagccaccaacccattaataac

SEQ ID NO: 398597 - DNA, 3655 bp, Homo sapiens
ccggcttttgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtcttggccatggcctcggtcctggggagcggcagagggtctggagggctgagcagtcaactcaaatgcaagtccaagaggaggaggaggcggaggtccaagcggaaagataaagtaagcatattgtcaaccttcctcgctcctttcaagcacctgagtcctggcatcacaaacacggaggatgacgacaccctcagtaccagcagcgcggaggtgaaggagaaccgcaacgtgggcaacctggccgcgcggccaccgccctccggggaccgggcccggggcggcgcgcccggcgcgaagaggaagcggccgctggaggaggggaatgggggccacttgtgcaaactgcagctggtctggaagaagctgtcgtggtcggtggcgcccaagaacgcgctggtgcagctgcacgagctgaggccgggcctgcagtaccggacagtgtcgcagacgggcccggtgcatgccccggtcttcgcggtagcggtggaggtgaacgggctcacgttcgagggcacaggccccaccaagaagaaggccaagatgcgcgcggcggagctggcactcaggtccttcgtgcagttccccaacgcctgccaggcgcacctggccatgggcgggggcccgggccccggcacggacttcacctccgaccaggccgatttccccgacacgctcttccaggagttcgagcccccggcgccgcgccccggactcgcgggaggccgccccggggacgccgcgcttctgtccgcggcctacgggcgacggcggctgctgtgccgcgcgctggacctggtgggcccgacccccgccacccccgcggccccgggcgagcgcaaccccgtggtgctgctgaaccgcctgcgcgccgggctgcgctacgtgtgtctggcagaaccggccgagcggcgcgcgcggagcttcgtgatggccgtgagcgtggacggcaggacgttcgagggctcggggcgcagcaagaagctggcccggggtcaggccgcgcaggccgcactgcaggagctgttcgacatccagatgcccggccacgcgcccggcagggccaggaggacgccaatgccgcaggaattcgcagactccatatcccagctggtcacacagaagttccgcgaggtgacgacggacctcacgcccatgcacgcccgccataaagcgctggcaggaatcgtcatgaccaaaggcctggatgctcggcaggcgcaggtcgtggccctgtcctcggggaccaagtgcatcagcggcgagcacctcagtgaccaggggctggtggtgaatgactgccacgcggaggtcgtggcccggcgggcgttcctgcacttcctctacacgcagctggagctgcacctgagcaagcggcgcgaggactcagagcgatcgatattcgtgcggttaaaagaaggtggctaccggctgcgagagaacatcctcttccatctctacgtgagcacctccccctgtggagacgcaagactccactctccctacgagatcaccacagacctgcacagcagcaaacacctcgtcaggaagttccgcgggcacctgcgcaccaagatcgagtccggggaagggacggtccccgtgcgtggccccagcgcagtgcagacctgggacggcgtcctgctgggggagcagctgatcaccatgtcctgcacggacaagatcgccaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacacgcaccgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcgtttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacctggcccacgcgtgctgcagatgtggggagcctggaaacacccggcccacgcgtgctgcagatgtggggagcctggaaacacccggcccacgcgtgctgcagatgtggggagcctggaaacacccggcccacgcgtgctgtagatgtggggagcctggaaaaacctggcccacgcgtgctgcagatgtggggagcccggaaacacctggcccatgcctgttcagtccgtcatggcgtttggtttatggtggccgatactaagagccactgaggtctgggttgtgtgagggttagctaccaccctataacctccctaccaggtaataaggagaccaagtctttgatcaaattctgattttttaactaaattttcattagaaagcaagcacaaaataaaatcaaaacaacctttaccttca

SEQ ID NO: 398598 - DNA, 294 bp, Homo sapiens
aattttgaatttatttatagtaacaactgtcattcattgagtgccagctgtgcactcagagctgtgcaaagaccttaacctgcattatctcattaataagcccccaaggccccctgaagaaggcagttatattcttacttggcagatgaggaaacagaccagagcagggatgtgacttgcccaaggtcacacagcaagcaagtgtcagatgtggaatttaaagtccagaatccttatctcaacttctcccatgggccacctctctatgaaaagaaaggcagtggggtagtttat

SEQ ID NO: 398599 - DNA, 328 bp, Homo sapiens
tgtcacagagtcgattcagtgccggctcatccctcacaccagcccccacaaccaccgatcctccgtgtctccacagctctgcctcttccagaacgccacggagctagaaccatctggcatgcagccttttcagatgcgcctctttcccttagtgaatacgcagttacctctcctccatgtcttgctttgctttttaagggtgggatgtaattttccacaaagtggagttcgatactgtgaaacttatggaaaatttgctcttttaaaaaacagcttgcacatcatgtcatcttaaaaaaaaaaagtctaataaagatatgagtaggga

SEQ ID NO: 398600 - DNA, 1537 bp, Homo sapiens
aaccaaaaaatagcgtctgtagcccctgtgtgcttactttaagtatatgttactgaaaaatgcggagtgagcacttaacaactcattctcctgggaagcacagtgctactataccccaaatgcttttctttatcattttaatttttatcttctttacttacatttccaacatcagttaagagggtcttgtagttttctaactgaaaggagactgtaaaatctccttgctcaaaactcagatgcagaatattatttttactacaataaatacatctacaacaatggtattatatctggtttatttcaaagtcaagttctaatacaggtaaacaaatatactaataaagagataatgcttttctcatgaaatgtataatctagtaggaataaagataaacaatttttttaaaaattctatttcattaagcaaaaatgcaactcagaagaataatgtatattagcagtcatttactatttttcaattaaattccgatatatatgtaaagtaaattattactaatatcaaacatagtttaaagaattagtgactatgtgcacttggatctccatatgtaatgtactatcagcatcttcacaaacacagtaaattttaatacgcaagtaaaacttattttactaaacgatgattactccttctatattcatattcctaaacacatacagtttcttaatgtaattaagtttttaactaaaaaaagggaaatgcattattgaggcgataggattactgggtggctataaacacatctgctgcacagctgacatttatcttctacaatgagcagtgacaattttattttttaataatcagtatggactaatcctgatgattttttttaacattttcaaatagggctgcatatggcttaaaattaatatatacatgtgtacctatataatattcttatttattaatggacttcctacatagctcatattgacgttagatttaaatgaaattccagaagggttttctataggtaagtcatacattggatttccatattacctatgattattgaagtatttatttctgtttttaagacttcagagcaattttgctggtcatttgttttctgtgtttttattttgaaattgttctttgaggcattgtcctattacatttttaaggtatgttaataaaataatatttttaatgaaaaaaaaaaaaaaaaaaaaaaaaaaaaaatttttggggggctggcgccggaaaggtttttaaacccatggtggggggggggcaccccagaagtgtaatagaaccagcgggccacacgggtcgtccaaagaaaatccggggtcacacagcaaggtgtggtggtctcccaccatataaaaaacggccggcggcaccggactgtgtttggaaccatcccaagagggtgtcagggacaaggggtctcacacagcggtccaggagtcagataataccccggcggggaaaaacacgaacgagagacgacaaactcacgacgggcagagacgcagcacagcagagcagaaacagaagacacaa

SEQ ID NO: 398601 - DNA, 410 bp, Homo sapiens
ggaaacccagcaagaaagaattaacaatgaaaggcaggggttcccacactacgatgtttattacaaaacactctagaagaacctggtagggctgaggtggccctcggggatctccatcttaaacaaattggcccagaaatcacattttgggaaatacggttttttttttgatggatgaatgccactttttttttttccagttgtatttcttttcttttctttttttaaatttcaatagttttggagggatcaggtgatgtttgatgacatgggtaagttctgtagtggtgctttctgagattttggtgcacccatcaccctagcagtgtacactgcacctaatgtttagtcttttatcccttaccctcattttgagaaacattgatagaacatcttacattgtatatctg

SEQ ID NO: 398602 - DNA, 526 bp, Homo sapiens
atggacgttcttttgaatgaagagatcagatgaagtcacttgtttgggtaaaaggacttaacgttacatataagaaactacatcctaatgtttggatggctcagcatgagtagttgaatttgtataagataatgtttgtgtgatgctgctctgtcattcagtagcacagtggaatgctctccaaccaccaaaaaataatcaaatttctaaaatgaattctgatcagcaaagacagatcggttttattatgtcattgaaaatgtcaaacacaaaatactgcatacaacaattccatttgtttttttaaatagggtgtacacaaacacacacacacacatgcatccgttttaacaatttttcaaggatatgcaaggaactattaacaggattttcctgcgggaaattaatagaaatatgggtgaagggaacgtatttttttcattcatactcttttctattactgtttgtgctttttaccatgggtgaatttttttattgtggtaaaatacacgtaagattaaccatt

SEQ ID NO: 398603 - DNA, 164 bp, Homo sapiens
ctaaataacagctgccattgctggagcccgctgggtgcgaaacactcatgggcatcttcccactgaatccacacaacagccctatgagatagagtttcttttcacctcccttttagagagggaaactaaagctccaaggggctaatttgcctgagggcacacag

SEQ ID NO: 398604 - DNA, 138 bp, Homo sapiens
tttaatcatgtctgtgaacttgatatctgaattttgaaagactgggattttctctattacttaaaacatattctacatcatcctagccctaagtttggcctatgagtgactacaaaaaggattagactgaaccgaata

SEQ ID NO: 398605 - DNA, 429 bp, Homo sapiens
tggaccggcactccaacagccagtgccctggggggcagccatcaggtggggcatttgcaggcctcttcttattcagacagctccaggtgctgagcggaatcattgtccacattcactctgtcattctgaagcggtgtgtagaacattctagaacactcaccacgtggcatgcccctgctgggtcccggtgatgcagctgtgaatgaagcaggcttggggttgctgccacctggggaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggtggtggagc

SEQ ID NO: 398606 - DNA, 312 bp, Homo sapiens
ccagcacagagctggctcagcccctgaacagggaacagggtctcagccagggctttcttgcagcctggatctctgccaaccccaggatacaggatattctcctgcttccttccagaagcttgccttaaaggcgccacagcccctacaactgacttgtgtgtgacactgttgagccaacagtgtccccctgccctgcagccttgtccattcctgctgagggcctgttgaccggtggctctgcctctgggctccctcctgggccggggcccaacactgcagcttgggggccggggcgtcctgccatgtgagcag

SEQ ID NO: 398607 - DNA, 328 bp, Homo sapiens
aggagctgggactacaggcatgtgccactgtgcccagcataggtcaggcagtcctcctgcttcagcctcctgaggagctgggactacaggcatgtgccactgtgcccagcataggtcaggcagtcctcctgcttcagcctcctgaggagctgggactacaggcatgtaccgctgtgcccagcgtgccttttacctttaaatcatctacctgaaactgaaaagactgaaacactttgtctttcctcccgtgccattgctattaaagtggtgttgtgtgcctgctttaccttgtttgtaaagcattctgctacctagacagtataacatg

SEQ ID NO: 398608 - DNA, 334 bp, Homo sapiens
ttctttcaccgccagccagcttttccaccctaaatattgaagtcctcaaaattatctttggaaaaaggcacagaccacagactgtttctatgattgcatggttttttctatgtccttaaccttggcaaaataagcttctaagttgatggagacctgtctcagataccttttggtttacatctcatctctggactcccctttaatctaggagtgctccccacctgcctttcattttctttaatgtcattgaaagcaatggttcacttcttttttttttgtaaagtcttccaccacctggatgtgtctgactcagactatgattagagtagtttta

SEQ ID NO: 398609 - DNA, 505 bp, Homo sapiens
aagagctgggacttggactcaattctgattcagaaggaaatgctgatccactctcattgctctgagctcctcaggtccctcaaggatgccctatctgtccatttccactggagagcctgaagtgaaccaaggtgacccagaggattgatgcaacctctgtcaatgcctccatctctcccctggggtaacgtataccctgggagaaagttactcaatatgtgttggccatgagcaggtgtatttctcaaggttctaagttgagaaaagtcacatctcattacaaccaagataaagaagcctttcctcctttggacaggcttttgaagcctaatgaatagactggagtagggagcaagtatgtaacatttgctaaatagtctggccaggttgggcatccatctgtgaaagaagagtctatgaactgccttctgtatccaggctgagtctcagccaaagtgaagacagaattgaaacagatagatcttttcctatagcccatttgatg

SEQ ID NO: 398610 - DNA, 2292 bp, Homo sapiens
  misc_feature (263)..(263): n is a, c, g, or t
tactcatgaccagccagatgtcttaaggaatgcttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgngtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttccgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagaccgatttcacgggcacgcactctctctataccacatacagagatctacgact

SEQ ID NO: 398611 - DNA, 645 bp, Homo sapiens
gagtattgtattggggttctctggatttcctgaatttgaatgttggcctgtcttgctaggttggggaagttttcctggatgatatccagaagtgtgttttccaacttggttccattcttctgtctctttcaggtatatctaccagtcgtaggttcagtcttttaacataatcccatagttctcagaggtttcattcattccttttcattcttttttctctaatcttgtctgcctgccttatttcagcaagatagtcttcaaactctgatatcctttcttccacttagtctatttggctatggatacttgtgtttccattataaagttctcatgtttttcagctccatcagatcatttacgttcctctccaaactggttattctgtttaacagctcctataatgttttattatggttcttagcttctttgcagtgagttagaacatattcccttagcttggtgaagttcgttatttcccatcttggatggatgattgacattcatccatctcagcctcagcccagttctgtgcccttgctagagacatgttgcaatcttttggaggagaagaggcactctggctttctgagttttccgtatccttgcattctttctcatcttcatgggtttatctacctttgatct

SEQ ID NO: 398612 - DNA, 557 bp, Homo sapiens
agtggcagctgggttctgttgttggcaaccaacagagttgttgtcttttctcgcattcattaaaatgcacaagaagaaatttctaatggtgaggggctagagtgcaatggcaggatctcggctcaccgcaacttccacctcctgggttcaggcgattctcctgcctcagcctcctgagtagctgggattacagtgaaagcaaagtcatcatacactgtttgcttcattgtatgagaatcaatgtttgcatgataaactgccctaatggaagaggactctgagttacctttttcgagcaaagccacctaggttactctgttttccccagagtgacccttctgttctgcaaattttcagattgaagggagtagcagtagagtatcagaagtatcagaagcaaaaaagtaaatgtatgatttgaaatctacttaaatgtaccaatcacagcagagtcttttggaacttaaacatcttgactcttctgtttaaagcctaaatcaacctgagagaagagatgaaacaactgagggccaaaaagtttacaaaattttccaaga

SEQ ID NO: 398613 - DNA, 328 bp, Homo sapiens
gtgaaataaacaacaccatacataggaatgcagagtcttttggaacttaaacatcttgactcttctgtttaaagcctaaatcaacctgagagaagccaatccgtgtcttctgaaagaagagattaatccgttaactttcaatgttgttattggaccactatatttgtgaaatttcctaaaaatggagtctgcaagaaaatattcaacacaacaaaatgcattggttactcaagatttcaagcagctatagctactaaaagaatgatccctcagctgtgacaatgcttacaattttttcatctcaattaaattataaataatttgtggg

SEQ ID NO: 398614 - DNA, 118 bp, Homo sapiens
gggagtaggatgagaagtgctttaaaacgtgcttaatttggaagtcgcaaattcaggcctagagcatgtgaggaaatgaggaaactaggactgtaatagagccactttttccctttta

SEQ ID NO: 398615 - DNA, 340 bp, Homo sapiens
cgtccttcatcatacctaccagaaatgaaaaaaaaagagaatatctacttctggggaactgatgaagcttgatcttttggagttagatcttccctcctctgtggctcagacccgatccaaactggaggctgcagtggggaaggaaagcactgttctttttactcttttctgctcaccttcttttccccctctcccatacagctgctgtttcactctttgccagagtctaaggtaggtgaggtgcaaatgatggggtagttcatacttggctgagtggctttgtattatctgggcctggcaaatatttaaagtggagaccctagttaggcctagccaatgc

SEQ ID NO: 398616 - DNA, 174 bp, Homo sapiens
gagccggccccagttgactaacctctcccatacagctgctgtttcactctttgccagagtctaaggtaggtgaggtgcaaatgatggggtagttcatacttggctgagtggctttgtattatctgggcctggcaaatatttaaagtggagaccctagttaggcctagccaatgc

SEQ ID NO: 398617 - DNA, 640 bp, Homo sapiens
ggcatcgcacacttcctaacagcaacacggtccttactgctgtccgactgatgagtgtgttagttgtagaatcccatcttaatagtaagctgtctacagtctcttctgttactagacaggtaagactagttccctcccaaatcaggtgtgaaataatggcttactaaagatagtttgtttttgggagtgatccaagagataaaagtgagggtggaaggatttttaaaaagcaagaaagcaagccaatctaagagcaaattatcatgataatcatcacagcggacaaccagtgatacattgtgctaggtgccttggcggaaccatgcagaaagtgtattattgcccttgaattttagataaaggaagagtttatccactggttcccatctctcattgattcacagtagccatatggggcttaacagatttcccccatgtctgaataggtaacaggcttctggccattgtctcacagagcagtggaagagaagcacaggaagggaagtaaagttactccgtaacgggtgacataagatgccatggattacacctgcaacaggaggttgacatagcacaaactggagtacaaaggtaggctgaaataatgtacagtgagatacaagttgaatcacttatactt

SEQ ID NO: 398618 - DNA, 487 bp, Homo sapiens
gtgggctttgtcttacaccttagataccagctcaaccacaggacagtaaagcaccaaatggttcttgggaatgccaattccaggacttgtctcttagatggcatttatggacctaccctgggccagaggggcgcccactgccctggaggggggggtcccatgccaggcagcattcaccaccagctggttgaagactccctgggccttaagagaacatcagcagtagtctggcagtactccctgtgggcctgtggtggcggtggccatggagtgaggcacctctgccttgggaaagcggaagcaagagagggaaggactgcatcttgtggattcagtgccagctcacctgcagtataacagaacaccaggtagacttctaagattttttaccctagttgctggctcccagatggcacctttgggcccagctggggcctggaggaccttgctgttctgaagggaaggacacaagcctggctggctctgc

SEQ ID NO: 398619 - DNA, 462 bp, Homo sapiens
tgagcgcatctgaagctgctcccacagaaaccacagtgctgcttctctgggctatgttcaggtatactttatttcacacatgtgctgagtcttcagcagcagccgctgcatgacatatgggtcattcccaaacttcaatctcattgtttttgctgagaaggtactggccaccttctccatttttatgttttccatatatattactttctttacaatggacttttcagttatttaaatattttttctttcagctttagatttttagttcatcaaaatgtttcttctgtcaaaaattctatctgtacaaaaaaatagctgggcatggtggcgtgtgtctgtagtcccagctatttgggaggctgaactgggagggtcgcttgagcccaggagttcgaggccgcagtgagctgtgatcgtgccattgcactccagcctgggcaactggagtgagaccctgactca

SEQ ID NO: 398620 - DNA, 328 bp, Homo sapiens
gcagaaaagagacagagagccaagagaggaagagggcataaattaccgatatcagaaatgaaagggacattcctacagatcctacagatattaagcgggtaacaaagcactataaggaactgaatgccaagagaaaatgtagatgaaacagacaaatttttcacaaacacaagctaccaaaactgacatacaaagaagtagaaaatctgaatttataattaaaaatctttctacaaggaaatggtgggtgcaggtggcttacggatgaactctacacacgatataagtaagaaataatacaaaccatacacatactctttcagaaaac

SEQ ID NO: 398621 - DNA, 635 bp, Homo sapiens
cccaagtagctggtattacatgcacctgccaccatccccggctaatttttgtatttttgtagagacggggtttcaccatgttggccaggctggtcttgaattcctgacctcaggtgatccaactgccttggcctcccaaagtgctgggattacaggtgtgagccactgcgccccgccaggaggtaataactcttaactggaataagagtgagttagtctgtaaagagacaggttctaggaaaaaagaacatcaactggatgttcctaataatttcagtgatgtgcaactggaataaccacagatgtctgaaagcatcccatctccttttaatgaactccagtgttttaaaactgaagtatgagagctgaacatccagttacatgctttattgtttaagttttctaaaattgtgaaatacaatgtatccagaaaattgtataaagcacatatatacagtttaacaagtagtttgaaagccaacagtcatgtaatcaccaatagaacaatatcagcatcctggaaggcttctcttatgcctgcccctaatcacatgctgcccacttccctgtagttttgacatgtatgtatatccctaaacaatatattttagttttgcctgtttttaaactctatt

SEQ ID NO: 398622 - DNA, 446 bp, Homo sapiens
tctgttgagtgatggatacagctaaatatggatcatcaaagggctttctaggtcacatggagggcagctacatgattcagaaaatatgaaattcaacttggacagaaagacagaaatatttgcaattcacttcttagagataaggtcagaattgacaaagaataaaagggcagcacagaagtagagttacaacacagtaagagatcagcataataagatacagattcacaagatgaaaagagatagagaactggattttttggcagattgatttgggcaagggaggtgggcatgaacactacagtccaaaaatagaaggaagaactgagaaatcctcaaaaaaatattttttaagcctaaagtcgagtaaatgataaaatagaaatccccaggtattaatgacgttgttattaaataaaagctatcatttattatctagtccaaag

SEQ ID NO: 398623 - DNA, 453 bp, Homo sapiens
tcaggagatcgagaccatcctggccaacatggtgaaaccccgtctctaccaaaaatacaaaaaaattagctggccgtggtgatgtgtgcctgtagtcccagctacttaggaggctgaggcaggagaattgcttgaacccaggaggcggaggttgcagtaagccgagatcgtgccactgcactccagcccgggtgacagagcaagactccgtctcaaaaaaaaaaaaaaaaaactattgtctccaaatgattacatgccccaacagtaaaaaaatttaaagcgtaatactaccaatatatgtatatgtgtttatacactgaataaatttactactgtaccaaaatattatctttgttgtaaatgcatataaataaaaaatgtaagtataagttaaaatttaagcataagttaaaaatatagctaaaagttgtaatgttttccttctgaacccca

SEQ ID NO: 398624 - DNA, 578 bp, Homo sapiens
agaggtgtatctcaggaaaatcctggttcccaaagttgcacattatgtcagatgtacctgtctttgacggctgggagagcggacaagaccctgccccagccctggccaggaatggtggctggtgagcccctagttgcaggcaacctggacctgtcctcgcggcacctgaagaggggaaaggagacttgaggagaatgactgtccccaggcgaccgcccatgaacacctgagcacccatctgataaacagcctggagtcactggagagtgacagcttccatgtatattcatatatgctcaccattatttttcataaccacatcacattgcatcattttaatgtatcataattttctcaaccagccccatccagaagcttcttaacccaatctctttctaaggccctccaaagggctggaagagggagcatctttattttgctgctgccatcaggggtcttgggagagtccccttggatcctgatttttcagggcttgatacctgagaataactgacagaaattttgagaactgtgcccccagtaataacaataattaacattgttttcagtactctggg

SEQ ID NO: 398625 - DNA, 521 bp, Homo sapiens
ttaggcggggctggcaaatatctcccctactgggcgcagggcagacttcacctcaaggtcttcctccacacacattccacagcccagccagtcctccagggcggaactcaagataaatctattcaccatctctgttctcttgggagtgggggaggatacgaagctgaggtctagcatccgggccagggctttctcggccacggctcctggcctgggtgatggtgggagggaggaatgtgatgatcaacactccagtttcttgtccaaggctgcctgtggccgatgtgctgcctatttggggagaaaagagaaacacgtaggcttgtctcgggtgttcctagaggatgtgggatggccacccatggcagaaaactaacttggttcactagagtgtgtgacatcgggacctgagatccaacttaccaagtgctatctacgtgacttcacccctcagtgtattcatctatgaaatggggataatactagcactggaggataaataaatcgatcaacatgtgtaa

SEQ ID NO: 398626 - DNA, 495 bp, Homo sapiens
tctaattaccacctacctccacctcaagggtaaccactatcctgacttctaaagtgcaaattatattagttttgcttatttttgtgctttttatataagtggaatcatacagtatacttttgtgtctggattcttttgcttaacatctttgtgagatttactgatgttgcatgtacagtgcttcattctttttcattgttgtacaaagttccattgtatgaatatattacaatttattctactcttgctgaacatgtgggtaatttctggtttgaggctattttgaaaaatgctactgcactcccgcctgggtaacacagtgagaccctgtctcaaaaataatatattatttaaaaatttgttttcttgtcagtgggccatctgggtggtttctggtattttgccattgcatgcaacgctactgtgaacatatttctacatgtcttatctttatatttctataagtgtaatgaaatccccccaaaatagctcatt

SEQ ID NO: 398627 - DNA, 652 bp, Homo sapiens
ccagctactctgaaggctgaggttagaggatcgcttcagcccaggagtttgaagctgcagtgagttatgattacgccactggactccagcctgggtgacagagtgagaacttgtctctgaaaaaaaaaaatttgcaagaactaatgttttttgtagcatttagcttgtgtcacaccattaagtcattttaacctttaataacctcacgatggaacatgtgaggacatctggaaattattgaggccggggttcaggactaagaccccagcaatccaaagtcagagcctgcataggccactgttaagacatgtgcaggcttgacccttgtgtgcatctgccagcaactcagctgtccgctggggcatggcattactgtggtgagtggagacacggagaggactgaactaggaaacggaattgtaagtgtgaatagaggcttcacttgttcgtgtggagcagaggatggggaagcaggagacagcatgagatgaatgaaatccaagattccattcatcagactggtctccatcttgtctatgttaccgaaggggaaaattccagaggcggcacagctatactggccaggcttggggggtcttggtggaggcccccagctgaaacacaatttggttgtttttacccaggacatact

SEQ ID NO: 398628 - DNA, 841 bp, Homo sapiens
atttcacttgtggcttgctttatgttcttaatttctcctaagagattgtaaactcatgagagatctggcctagtgttcttaacttttaatccccaaagtgctttgtacacagtatggctcaatacatgcatttatatggcacaggaaaaatgtacttaagatgttgggtggcttttaccaacatagcatgtcattactgactcatcgatgctcactggaaaagcttgctcccagagccatgtccccaggactctctactaggtagccaccaaactgccaaagaccctatcctatgcaagtcacataaattgtctgtttgtagaaattctttctttttttctttttttgagatcgagtctcactctgttgcccaggctggagtgcagtggtgtgaacttggctcactgcactacctccgcctcctgggtttaggcaattttcctgcctcagcctcccaagtagctgggattacaggtgcgtgccaccatgcctggctaatttttgtatttgtagtagagacggggtttcaccatgctggccaggctggtcttgaactcctgacctcgtgatccgtcctcctcggcctcccaaagtgctgggattacaggggtgagccaccatgcctggcagaaattctttcctttattgactgtagaggctactgcaactaggtgacagaggtgatttggccctgttagtttcaaatcccaatttaaagaatgatagtacagagatgcctgaactccctgccaggtaattttatgtagcttattccccattccatttctttgatcatgacacaggccattcaggaagtcctatggagagtaaatagatggac

SEQ ID NO: 398629 - DNA, 404 bp, Homo sapiens
ggtgaggttggcaaccagtagggtctgccacggtggcccacgcagtgaggatctacagctctgctggaggcgtaacatgccagccgggaactggagcctctcagggcctagcctcgcatctgtacggaatcagatacacaggtagcaaagacaaaacggtgcctccagctcctgagtctgaaagaaatatgaggctctgccagaaggccagactctggagcacatcaagacatttgtccagatgacaacctgccaggctgcagtggattcgctaaactcgggatgtggcgcagctgtgtgcccttaatgttttgctgatttaaatggaaaggccacagatttgtgtctttgctttgtcctttctctcatggccagttgatacattaaataattgtttgtaatga

SEQ ID NO: 398630 - DNA, 1484 bp, Homo sapiens
gtgacaggaagatgggtttgattgaggtcctggtttccctatgacatggaagcaagatgccaggctgaggctgacaacaatagggtggggagctaaggggcaacaggaccctcgtgaaggatgcaagcagctgcccagacatgtggagctgaggccagggagcatgcgcattggaggcagtgtgaatgtcccctgaaaggcttcgctgcccaagggacagatgggctgtccaggacccaggtggggcaagccagggttggaagaaccaaaggcagagaaactaaaggccccagcagctgcagcagtcaatcttggggtccaggctataataatctggatttaagatctcaggaagattctgagttaggtcaagggaccatggaggtgaaggccattgactcagaggtgtaaggaatggagtgatttggacttgagtcgggtggggacgaagaggggccatcctcagggtgaggacgggatctgtggaggtgaagtctgtgcatcagatgccagagtcctcagggaatgagagaaagtgatggcaatcatgctgatgatgatgaagataaagatgagagcagacatcagagagtatcaactgttctgtgcgtgtaccaggcatgtgaagtgcagcgagggcttaaccctcctcacaaccaccctgggagatcggtaccatctcttcttctttttacagatagggaaatagcacagaaaggttaagaaacttgcccaaggtcacacctaactgggaaatgggacccggtccagggatttggactcaagggtccatgctcccaacccttagcaagaggagctggatttccatcaggagggggaagtgaaagaaacattcggtaaagaggggaagatgtaagggagcttgttaacaaggaacttccacaaggcccactggaaaaatgagagaagtgggaaagaagcaatggaaagctgggtcaggaaagagaaagcaggaagaaaatcaggatccccatttgacaagtaaggacatgaagaagctaagtgtcctgcccaaccagtaagtcaaagactggaatttgaaccccaagatagttctctaagggtgggaaatccatctcagtaggaacttgagggaaggttgagggaactttagggaaggtttccagttcaacaaaaaaaaaagcggctgggcatggtggttcatgcctgtaatcccagcactttggaaggccaaggtgggaggatcgcttgagcccaggagttcaagaccagtctgggcaacaaattgaggcccccatctctacaaaaaaatacaaaaaaattagccaggcatggtggcatgtgcctgtagtcccagctactcaggagtctgagctgggaggatcactcaagccctgggaggtcaaggctgcagtgagctgcaatcacaccactactctccaacctgggtgacagaccgagaccctgtctcaaaaaaacaaaaaaaagagagagagagggag

SEQ ID NO: 398631 - DNA, 495 bp, Homo sapiens
cagctcttgtccagagttgctgatcagattggcccaggctttgtcaggtctgcagcgcggtctgagactctccctgcccaaacccacttccccgctttcctttaataggtgtcagatctgcagcacggtctgaagaatttccctgcccagccttgctttttctgacttttatctttcaccagtgctgtcccacggttaacctcttgtactcctagctccatctgctttcagaggacccaactgacacacttaggtgtgtcataagccacaagtgtgacagcacatgaaaatgctggacggtgcctggcacacagtaaggcttcagtgactgctatcactggcattatgtgactgatcggctttttattataaaatgaggttttgtttttggtcactgctattttctcatttattcctgatttggcttccaccatccttttctactggcatataaatgtaagactgtgtatatactgattaaaaattttaaataaa

SEQ ID NO: 398632 - DNA, 537 bp, Homo sapiens
ttgttctatttttttatgtaattaaaaaaaaaaagacatttgtaacagatggaaaatttaaaaggggaaaaacaaccaagcagaaaactgctcctcatctgtgatagatgaagctctgtgattgtcggaatatccccgtcaccctaactgccccccacttcattgtcccatgtgaagatcctgcctctgggcttctggtctgtcatgacttatatagaggcaggcagttggttgcaaaaaagctctctttgttccccatgacatagagatagtggcattgcctgatcccaccctcccccttattttttaaaaaataacactagggaatttctgttaaacttgattcacttcctgctgttgccttgttaatgtgactgtttcatatcagttattcctgggttctaaagtgctttttgggacaggcatcatggctcatgcatgtaatcccaacactttgggaggccaaggcaggagataggcttgaggccaggagttcaagaccagcctgggcaacatggggagaccctgtctttatca

SEQ ID NO: 398633 - DNA, 560 bp, Homo sapiens
ttgttctatttttttatgtaattaaaaaaaaaaagacatttgtaacagatggaaaatttaaaaggggaaaaacaaccaagcagaaaactgctcctcatctgtgatagatgaagctctgtgattgtcggaatatccccgtcaccctaactgccccccacttcattgtcccatgtgaagatcctgcctctgggcttctggtctgtcatgacttatatagaggcaggcagttggttgcaaaaaagctctctttgttccccatgacatagagatagtggcattgcctgatcccaccctcccccttattttttaaaaaataacactagggaatttctgttaaacttgattcacttcctgctgttgccttgttaatgtgactgtttcatatcagttattcctgggttctaaagtgctttttgggacaggcatcatggctcatgcatgtaatcccaacactttgggaggcctcaggcaatctgcccactgcctcggcctcccatagtgctgggattacaggcatgagtcactgtgtccagcttcaatatttctaaacaaaaaaaaaa

SEQ ID NO: 398634 - DNA, 579 bp, Homo sapiens
gaacacccagattcataaagtaagttcttagagtacaaagaggctcccacacaataatagtaggagactttaacacaccactgatagtcatagacagatcatcaaggtagaaaattaacaatgatattcaggatctgaacccaacattccaccgaatgagtctgatagacatctacagaactctccatccaaaaacaacagaatatacattcttctcatctccacatggcacatgctctaaaattgaccacataatgcctttcttttcagtggtccatatgtaagtcttttgaaagtggcagcatctctactgctcatgcttgttgcaaggaactctactgaatacaaggaactttactaatctctaatgcttgtgagtagattctgaactcatcatttagaaagctaaactgggggctttcttcccagagcaaagacataaaacaaacctcaattgagcgtgggacagggagtcatgtgctataaacttcttggacagttcttattctatggaccaattaccattcccttgtatctctaattttgggattatttctggattaaaacacaaaaaaaatc

SEQ ID NO: 398635 - DNA, 336 bp, Homo sapiens
ccagcaatgtatctgtctagtgccctctatgtgccaggcctgcttcttgggctgccagtaaaggaaggagccctggttttttggtttgtttttggtttttgttgttttttttgagatatagtcttactctgtcacctaggctggagtggtacagtggcaccatcacgactcactgcagcctcaatgttctgcactcaagcaatccttctccacctcagcctccagagtagctgggactacaggcgtgcatcaccacacttggctaatttttttttttttttttgagacagagtctcactctgtcgcccaggctggagtgcagtggcgtgatctcgg

SEQ ID NO: 398636 - DNA, 359 bp, Homo sapiens
aatgacactagaattttgataggaatctcattgaatctgtaggtcattttagctaatatagacgttttaacaataataatctttcaattatttaacacaggatatttttccatttgcttgtgtctacttcaatttctttcatcaatgttttacagttttcagtgtatagatcttttgcctcctaggttaaatttattcctaagtattttattatttttgatgctattgtaaatgggattaagttatatacatggtcaacaggcatatgaaaaggtgctcatcatcactattcttcagggaaatgcaaatcaaaaccacagtgagatatcacatcacacctcttacgatggctaattatt

SEQ ID NO: 398637 - DNA, 336 bp, Homo sapiens
gggatgatgggtgagctaccaaggctaacattttcccgaggacattgagttagggaagtggcctctccttgagggaaggagccagatgacttctcagagaacaacaaccatattcaaaatattctcaagtttcttttgtttcttcttgtctgcatctgatatccaggacattattccacaggaaaaggttaacaggaaatcaagatcggcccgctcctacagcaaaagaagtactaagaggaaagtttatagtgataagcacctacataacaaaaaacttcaaataaacaacctaatgaggcatcttaaggaatgagaaaagagcaaactgaatac

SEQ ID NO: 398638 - DNA, 705 bp, Homo sapiens
gctttgattacttgataagggataagaatttaaatgttttaatggaagatgactttttatcaacttcgttggatatgaaggctaaaggatagtaatcatgtaaaaaatatatctataaacatatgtaatttagtcagattctttatgaaaagatttggctttttgtatcacattttctttatttttaattgataactttgattctttgcttattttttattttctgtttagtcatagaaagaaaatgataccaagaaagttacatttgacttttacatgcacttcactaatgtaagacttaccctttttctacttcctgagttgtaaataattttctgttgttgaggacatagactggggttataaaagaggaaagaaagatgctcatctatttgagaatctgtttgtctctgatggttttctttttaccctgattagtgccttttggacaaaaagggtttagatgccttgaagagggattgatgagtctctttttcctgaaagcatggtagtttgacagaaaaaagcatttcctaagatgacactttaagaaggtgtgggaagaataaaacaaaataggcttttactaagctgtattctggaccttagagtgagagagcagtgaagttatgcaattgaaaatagcattgcttggtgattttctaaagccatattaactcttttgagccatgatggtagcatagc

SEQ ID NO: 398639 - DNA, 168 bp, Homo sapiens
tactgatacaatcagctcggtacccaggtctttcccctcaaagtcccaactatatgctgcatgtaaaaaattaacttacatatacacattgactaaaagtgaagggatgcaaaaagttttcaaatggaaaccaataaatagcagctgctatttgtatcagataacaga

SEQ ID NO: 398640 - DNA, 405 bp, Homo sapiens
tctcataggggtaaggaggaaatgagtaaatatgtatgagtgaagcactaggaacagcgcgtggccctgcggataacagaatattgaagaactgataccacacctggccaagaaggctcttacatgaccgaaaagcttaggacagattttatcaaaatgtttgtattataggaatgcctctagatcgaggtcttaaccagaagtgatctctcccatggccctcagggtagtttaccttatctctcgaagacacacctgtaggctgtgttgtattaattatatgtctgatctccttgagaaagctgtaaagatccctgtggtcaggaaatacactcatttttgtgtccctggtaccgtatcctatgtgctaatgaacactcattaaatgtctgctgacttgagtta

SEQ ID NO: 398641 - DNA, 410 bp, Homo sapiens
ttaacacgcagtaaaacagctcaatagcacttttcaaggaactaaatgttttaaatgttatgcagtatgcagggaaaaattattctctagacctttggccagaactttaaaagtgagcattaagtgtaggtacagtctaaattaggggaaggaggcatcacaaagcaattccagggcatattgtcgatccacactattgccagaccaggaacaactggctggacatattttatcagaagactaatgtattttctatagcataagcagttaggctcaattagtgtatgacttaccttgtttcatttcactataccctgacctccttaactgtggctatttttccagtgattctttggagttccgagtagtttcacagacaggaatactatctaaaattcttatcttcagag

SEQ ID NO: 398642 - DNA, 1426 bp, Homo sapiens
ggaaaaaaataaccttgatccctacctcatgccatatacgaataatttgagatggatcttaggccaaaatgtgaaagctaaaaccttaatgcatttagaagagaataagggagaatgttttcaggactttggggtaggcataggtttcttgtaacccagaaaacactagccataaaaggaaacattgataaatagactttatcaaaacttaaaacttctcagaaaagacaccattgacacatatctgacagagggtatattactcctttaaactataagaaaaaaacccaaaaaactgactaaaaatgggcaaaagacttgaatagatacttcacacaaaaaaaataattcagatggccaaaagaatatgaaaaggaactcaacagtattccttattcaggaaagacaagtttaagccacaataaatgccagtacatacccaccagagaggttaatattataaggactaaaaacaccttttaggaaaaaaaggaaaacagtttggcagtttctaataaagataagtatatctctaccttaagacccagccactctatctgtagccatatactcaagagaaaagagctcatgtatttacattaaaagacttgtaaaagaatgttcataaaaacttaatagccaaaaactagaaacaaccccaattttcatcagtaagagaatttataaataatggtagactcatacaatgaaattactacacagcactaaaacagtttgaactgatgtaacaataaaggttattaacaacatcatgcaaaaaaaaaggcacaaatgaatacatattctctggatccatttatatgaagttaaataatagtcaaaactaatacatggtgctagaagtcagaatagtagtaacctatacggttctgtcgggttttgtctgggatggagcatgttggaacttttttgggtgttgaaaatgttctctatcttgttccgggaaatggttattttgatgtgtacataggcaaggcaaaaaacttattgagtttgtccccattttaaattatttctgtgccattttttacctggtcattgttcccactttattattatttcccattctcttccaaataattattttcttaaaaggggcctttggatggttcccaggaaaaatggccactaggaaatacgttttctcaacagaaaaaaagaaacacaacataacaactacataaaaaaaacaacactttgtttttgggggcgcgcctactggccccttgagaaaagacgctttcttttaacacacacacctctttttttggcggggcgccggggcgcgcccccatcgagtgtgaatgctgtgaaccacactgggctcaataagtggtgcttcccaagagaaaaaaaccggggggtccaaacaactagggggagcgtgtgattcttccccaatata

SEQ ID NO: 398643 - DNA, 495 bp, Homo sapiens
aacttgattacctctataaagaccctatctccaaataaggtcacattctgagggactgagggttagcacttcaacatatgaatacttgggggacacaattcaacccataacaaaaagtaagtattaaatataggtaaggaataaagaataatgccttggtagcctttaaggctggtaactgacagggacatggtcagccagcaagtaagcatagattgtcaaatttatgttgtaactctaatggcttaaacctacattaacactaattttatctccacatatggatattgtgtaagagtcagctctgaattctcttctacctgaaatttttcagcctcgccctgctttccagtgttatttcatctgtttttataattggatgtgaaacttcttgagaaagggtcctatgactctttaaccaattattgttcaaaggagtccccaaagtgttaagcaggtaggtcattgtttaattaaatgactctgttgaggttt

SEQ ID NO: 398644 - DNA, 429 bp, Homo sapiens
caatataagcttcttgaaagcaggtctttctttcaggaggggctgaggaaggcacggctccctttacaactccaaacagaaagcccattttatttagtcagaccagcatctcctttccagagcattttgccattgaggaaaggtgggacaatgtgcatttcaggctcaaatacacattagcaggaaatgggttccaccattcactggatgtgactgtcaaccaagcaggtgataatcctttaaaagcctctttttgttcaccaatgtctccccagtacctgaaaacctggcacaaagtaggtgctctatttgttgaatgaatgaactttatgcagggtggttgtacaggtgtacctaacatcaataacttaagaagaatgcgtgtgtggagttccgagctaaggaatcctagtggccaaccctgaaatc

SEQ ID NO: 398645 - DNA, 357 bp, Homo sapiens
gagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccc

SEQ ID NO: 398646 - DNA, 316 bp, Homo sapiens
taattttgtatccttctaccttactaaattattttattatcactgagtctttaggattttccagatgtgctattatataatttgcaaatagatacagtgttacttctttaaaaatgtttaagcctttagtgatgtcttttgttttcctgcacaggctaatactttcagtacaatattaaatattattggaggtaacacttaccttttttcttcctgatgttagtgaaatacccctagcacttcctgattgagtgaaatcagtaactttgtaactaagcatatatatttttatcaataaagtattttattattctca

SEQ ID NO: 398647 - DNA, 483 bp, Homo sapiens
tatgtgtcccccatgtccttccatggaataactcttccatatcctcctcctaattctctaacaccaaattttctgtagttttcaaagtctagtacaaaccacagctcctccctggggccacctttcagttcttttcccacattacctttctttgaatgcagactgtacatactgcttttgattttgtaattcaattctgcctcacagattgttttaaattataaacacaataaaagcactgcaaaaaatttggagtgttacttaatgcttaaatggtttcatgtgttgtagagcgctttttggccctcagacctgggcagaagaggctcctgtcaaggccctcctctctggtgggccccacccatatcccatacggcccttttaaactatgctccaggtactgagttctctaggatttccagttcaagcctccctagcccacttccaggatctgcatgggcattttacctgggtttattctcc

SEQ ID NO: 398648 - DNA, 541 bp, Homo sapiens
aaatagtgctgtggataattcaagttgcttttatttagtctgggaatgaaccaagcagttctttaaaattaatttgctttgtcacttatagtaagcatgtgcttgtgttgaaattactgtaggttttctttacgtcatttgggtagtaggaggaatctgccattgaaagtgctgtatctttggacttaaaagagaacttcccgtgaataatccacaaaatttgtttgagtcttaaatatgagtttctgtaactttttaaagttggcctatatcatagaacttcaactgatataatggaacacaatgggttttgtgtgaatatagaaaaagtattttatttgatttttcagtccttaaaaccttaaacgttttctatatcagtgctgtgaaataggaattgtgtgatctatatggaacagaggaagcatttttattgaagtttttaggctcctttacatttcttaatctttttatcagaaaataaaacaaagttagctttagtcattgctgaagcttccagtaagaatctcaataagtggtt

SEQ ID NO: 398649 - DNA, 265 bp, Homo sapiens
catagactctccttgtacagaggcagtgacagtttcacttctctctggaaaattactccagtggcccaagaacagccttccaattcccactggagccactgcttgtcccacacatagacagccagagcatcaccttacctgacctagttcccacctggctttgctcaaccacctaccctggtagattaacacaaataactgaagaaacttttagaagctctttggctccacttatttcctgagacaccagagtgcctccaatggg

SEQ ID NO: 398650 - DNA, 480 bp, Homo sapiens
ctcgtttgagccatacaaatgtactcttgaggtcagtgatggtattgccttcattttacagtgataaaactaaggtttttaatggacaagttatttgcccaaggttgcacacaaatacgtggagaagtctgcattcctctaagaaacagcgtctcttattgtctaccacaatattgttaatttcgttgtataccagaggaattactggaaaggttcggtctctgaaactatttttgatttttaaagaagcagtggtgtataatttaacccaggatgaagttttatgttgtcttcgtaatctgtgatttttcaaaagaccagtattttgtgtatgatctaataagagattagagattatctgaatacaatctttatagttaatggagttaaatttttttatgacatctaattatattgagtatgcatgcatgttttgttcaacatagtcacaacaaataaaaataaccattttgggttgtt

SEQ ID NO: 398651 - DNA, 363 bp, Homo sapiens
taattaagaatgtccaggagtgctttgtaataagtgccctttcctattcatcacatgccatatagaccccagggtgcctcctgctgacctgggaggctcagatgcagccagggggcagtgtcctgctcggcagacagtgcacaacacagggccaagaagagccgtcctccagggccatgcatgctggcatgacagagttctcagacataatagtagacagatgcttctgggtatcagggcacggggcagacagatcttgatttatgttaagttaaaatggcttaacctttgttggggcactcattaggaacctttctttgtgagcaaaacagtccatcaaaattattgaaaataaagtgctct

SEQ ID NO: 398652 - DNA, 380 bp, Homo sapiens
acgttgacacttcagaagctatagtctccaaacttcagtttctcctctgtcaaataggatcttcagctatgattcttacttcaaagggtacacaggtacaagagatccccagcccacgagtctggcaacatgttttggtcagccttaacattatctttttctaaaatccttaaattagtaaatattgcttcccatctaacatagctctaagtgaaaaaagttgcagtttaaggagagtcctaattttctgaccaaagagactaaaacttaaaagggaaaacaagacaaactatttgcttggcccactacaagtcccaggcattatgcaaggttttcaaggagacacagagacaagtgacacctgactgaagtgtcaacgt

SEQ ID NO: 398653 - DNA, 330 bp, Homo sapiens
ggagaaagtataggcactgtgattcacatagttaaatgttcatttagtagagctggggtgaaaaaatactgtttcaacttgaaatgttagaagattgttgttcttgtgttactcattcatgcaaattggagaaggtataattgaaacaaggttggctgtgtttgagtcagtgtgctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttactta

SEQ ID NO: 398654 - DNA, 647 bp, Homo sapiens
agatgctaagatggtagcagtgctgccaacctcaggatgcagagggccttacctctccccacccacctgctgctcctgcaccctgggaaacaaaagaggggctgacttcaggccacagtggcctagtggcctctaggccttgtgtccacaaatactgtgtcacacggcttggggtcttttccttcacaatgaattcatcttcatccatcattccattaattattctccccagtattcttttattcatgtacatattcatttcctccctcattctatttgtttactcctttcttcactcatacacatattcattttcctccctcctcaaacttatcacaagagtaactaaatacatcatagattgtgcaactcccagtgtctgcctgacttctcagctacaatgtgaaagatgagggcaggaagcatgtcttcttcacagctgtgataccagcatctggccccatgcagagcccatagcatgtgctctataaatggatttctacagccatccattcactgcacgtgcattcattctttaggcattcctcaaacctccgtgtgtaccaaaacctgggccagacacatttcagaagagggagaagcaagaagaaaatataggataaattatcccagcccctgtcatccac

SEQ ID NO: 398655 - DNA, 908 bp, Homo sapiens
gccaccatccatgtaagatgtgacttgctcctccttgccttctgccatgattgtgaggcctccccagccacttggaactgaagcaaacactgctattgccacctttttgcagaggaaggtactgaggtgaagcgacttgcccaaaccctacaaaaataactggccattgcatcaacagcagtgtcaagagcatcatagcatcggatgatgatggacagatgcctctgctgcagagttatgcccccgccccaacactcaattggcaatcatctggggaagtctgtcacaatggtccctgtccacctttcttttagtggtttcagcatctgtcaaaggttcttatttgaatttccatcctatcaagggctgcaaaatggtgactttctgaccgtattattgcatctacattcacagctgacattcttcaataaagaaaagttttccttcatcaagtagaactatttagttatgctgaaattcagtatcttctagaaagacattaaatctttaattatttttaattctcaattctcagaataaccaattcatgtaataatcacctccagtgatggcaaatgagttttgttttggaagacattctcttttctagttatgtacttgcggagttttatatattcatagtcatttttaaatgctcaggttgtctcacacttgccactgtatactcttcaactagaatgctacttaacccagattaaaatccacgtttcccgtgtaaaacaccaacctgacatcacacaaaaatctcgggggcttttttccgggggggggaaaagcgtgtttagacatggggcctgggcctagtggttccccgggcccttttttggcccaaggggagaacgcggggcccccaagggggcgaaattgaaagcccgtacttattccaa

SEQ ID NO: 398656 - DNA, 471 bp, Homo sapiens
gccaccatccatgtaagatgtgacttgctcctccttgccttctgccatgattgtgaggcctccccagccacttggaactgaagcaaacactgctattgccacctttttgcagaggaaggtactgaggtgaagcgacttgcccaaaccctacaaaaaacagagtcttactctattgcccatgctggagtgcaatggcgctatctccgctcactgcaacctccgcctcccgggttcaagcgattctcctgcctcagcctcccaagtagctgggattacaggcacccaccaccatgcccggctaatttttgtatttttagtagagacggggtttcaccatgttagccaggctggtctcaaactcctgacctcgctatctgcccgcctcagcctctcaaagtgctgggattacaggtgtgagccactgggcctggcctatctttttattccttaataaaaaatgtttgtttcctc

SEQ ID NO: 398657 - DNA, 644 bp, Homo sapiens
gccaccatccatgtaagatgtgacttgctcctccttgccttctgccatgattgtgaggcctccccagccacttggaactgaagcaaacactgctattgccacctttttgcagaggaaggtactgaggtgaagcgacttgcccaaaccctacaaaaagcactgtgccaggtgctggatttataaccacaaaaacagaggggcagaatgtctgcatttccagtgggcaagacagacaatgtgcctatctgtgcatttccttgtaaaatccagctttcgcaagagcatgaacaaatcagtttggcaagacctccccaccctcaacatctgatcacgtgtctcatcctccatgatgccacaggtggtcttcagggctgtctccatgaagtcatcaccagccttcccaggccaggactctccatgccatccttagcaaggagaagaaaacaaatacccggcatccatttccaggtcctgcatgatgtgatgtcagaagagaagacaggaatatatgaaacaggagcaatcacaagaacgtaacagaggacacaggtgtcatgttcatggcacagaacagaagccccatagagttcaaaagacgggatgactggagatatccttgacacattgagctaaaaaaaaaaact

SEQ ID NO: 398658 - DNA, 395 bp, Homo sapiens
gcattgcccccatctgtcctccactctccagctagagtgattgatgtgacatgaaaatcataagttgtcctctgcttaaacccttcaatgcaccctgcttttcttaggagaagaaaacaaatacccggcatccatttccaggtcctgcatgatgtgatggtgagtctcgcaaacattagccatcctaatcacatgcctttgctccctccactccactcacacaagtatttggtaattacatccttcctctccctatgctcatccagtctgcattgcccccatctgtcctccactctccagctagagtgattgatgtgacatgaaaatcataagttgtcctctgcttaaacccttcaatgtaccctgcttttcttaggagaagaaaacaaataccc

SEQ ID NO: 398659 - DNA, 498 bp, Homo sapiens
aattagccaggtgtagtggtggtgagggcctgtagtcccagctactcgggaggctgcagcagcagaattgctagaacctgggaagcagaggatgcaatgagccaagatggtgcctctacacacagcctgggcaacaaagcgacactctgtctcaaaaacaaaacaaaaaactgtttctcaaggtatgggactgattttaggatgtaaaagatgatttaaaatcatccataaaaacggcagtaaatagcactgaattacatagcgcagtgggcattactagtgcccaccaatatcctggtctccattcccttctaggcagaggggtgactacaattaccagctgttgtgcagtttagaagactagtttgagccaatgaaataaaagcagaagtgacatagtccctgcatgattctacagtgtatctcttcctctgacagaaaaatcatgatgaaagtctcacgttgagatagtgaaactacaagattgaagcagcaata

SEQ ID NO: 398660 - DNA, 767 bp, Homo sapiens
ctataatgttaaattaaaatctaagccttacatagaaattaaaattcgctaaactactgatgctatgttgtacaaaactgtactccttttagttcataattggtcacctccatattcagttggaatattaggttggtcagcttaaatactgtggctttgttttggttatccacagaatctttacacccaaatgttaatgcataaaaagcagcaagacattgttaaatgaaacagcaatagtgcagtttagacctgtgaccaactatatatgattaaacttacttcccacattcacatcacaataatcatccatcatttaatagctcaaccaaaatgttatacagtcatcaacaggcaaggcacatgaaaaccccgcacaaccaagaatgatttgggcccaaatgtcagtagatttgagtttggaaaaaccttcttgtagttgttaaggctcaatggctctggttaatttaatataataaacaacaacttcataatggaaaaaaattaaatcctctattgaggtataaaacctaattaatttataaggataaagtaagtgactaccttgaagtcaaaacacattatggacaatgaaagagtattacgattgttccaaattgacaagggtatttaaacctaggtacacaatctttcttaaaattaatttatagaaagtcataacctgtgggtacatgaatatgaatatacatcttctccaacttgacaagtacattattgctgggacaggtaccttttaataacaagta

SEQ ID NO: 398661 - DNA, 667 bp, Homo sapiens
tagagtggctgtgttggtacacatgcttggtattgccatcccttgccgcttcactgctgggttattctatgggtgtgtgggagagaactcagtcagacaccaccacaaaccctggcactacctgcatgctaattgtggtttataagaaagttaggcaagtcatagctgcaggagatccttggtgacgtgatttatggccaattgacatgaatgttgttgttactaagaaacatttagtgagccagccattgtgctcggcgctttacatgaattatctcatttaatcacgatttctcagataaggatactgaggctggagaagtggtgtttctagcttcaaatcttctagctaagcaagtggcagaatgaagatcccaaaagatttttttctgatactcaattctacattcttgagcacttttcaaagagccccgaaacagggacatctatgaaaccataactatctttgaaaaacctaagagaaatggttaaaagagtgaaatgtactgcgttatctgtattcctttgggatttatagcagctgcagtatgaaataaaagctcatctcagaatcagaatatacaccagaaacttgacactgttttctgaatgttaaaatttttggctacaggaaaataggaaatacttttctaaagcatagcacttt

SEQ ID NO: 398662 - DNA, 871 bp, Homo sapiens
gtgtgtaaattacttaagaaaggaggagggaatgcttatccctttcttttcttttttttaggcagggtctcaactatcacccaggctggagtgcagtggcatgatcactggcctggaccttccgggctcaggtgaccttaccaccacagcttcccaagtagctgggactgcacatgtgtgctgccatgtctggctaattttttgtaatttttagaagagatggggttttgccacgttgaccaggctggtctcgaactcctggtctcacgttatccacctgccttagcctcccaaagtgctgggattacaggcatgagccaccatgcctagcattatctattcatatattgtggagggtacataagatgagagagaacgggatattggatttagtaagataatgattgttggtgacttttaacaagtggtttcattaagagtgctggggaggaaagcatgagtagaatgatttaaaaggtgaagaggatttagtgagagtaattacagactttttttttttttttttttttactcgtgttgtgagcaacattgaaataggtggtagctggaggtggacctggttgaggaggttggttttctaagaatctcgccacaaattaatgatagaggagagaaagtatgaaagaggatgagagagggatgttttaagaaaacaagcaaggtgaaacacaggacacaggtttaagggttggacacaggagtaggggtcattataacagggaaagggcattggatagacattcagagatacagatatgttgattggaagataagataattcttgtcagattattccttatttccttttgtgataagaaacaagctaagatgggtgagagggccaggtgtt

SEQ ID NO: 398663 - DNA, 422 bp, Homo sapiens
ttaaattaggtctggtacacacatacactgataaaattgggtttcaggacctgctgatctaaagctgagacctgaactgtgctgtccacatactagaattgctactgtttaaggccccgcctgaggagctggctaaattcttaatttaaattatcttttgaaatgacacacacaatgatttgcatgacagattgatttaaatgtatttacagaatcttaatgatttctagactctgtcaataagtctgtattttccttacactctaaataataatcttgtagatttgtcagtataatcataaaatctgatacagaaaaatccttgttagataatgctggccttgctgtgtttttaaattacatatttggtatttctaatcaactctataggattagacattatacaaattctaagttggaaa

SEQ ID NO: 398664 - DNA, 538 bp, Homo sapiens
tcagaatcctctttgaaaatatacaatatttgaaaatatacaataatatacaataagtagacaataaataatcattaactgtagtcacctaccctgctttagaacactggaattcactcttcccatctttctagctgtaatttgtatccgttaactctcttttccctatgacccttgcccctctacccttcccagcctctagtagcctctattttactctctacttctatgagagtaactttttaaattttcccatatatgaaagaggacatgtggcatttgtgtttccgttcctgacttttttcacttaacgtaatgtcctccaggctcatccatgctgccatgaatgacaagatttcattcttttttttttttatggctgtatagtattgtgttgcgtctatataccacattttctttatccattcatctgctaatgaacatttaggttgattccagattataatgtttatactgtgaatcatacatactttatgtacaatgtgtagcatagacaattcctcataatagaagctca

SEQ ID NO: 398665 - DNA, 318 bp, Homo sapiens
ttccctaatacaacaagctgaggatgaggccccttctaactaggccaccgtcagagtcccaatcctttctgacagaccagcccccgacatgtgtctgtctccatccttgcagcctggccagccctgtcccacgcctgctaattggtggggggggacctggccccccaagcctgccggccattagcagtgcctcacggggaagggctttcttccttggtttcaactccctccctccagcgcgcagtcccttgccgggcttgcctggtgacagactcgtgttgatgaagacctttagggaatttccttccccctccgctc

SEQ ID NO: 398666 - DNA, 397 bp, Homo sapiens
ttattattaatgttatttggaaaaatcgtgtaacgcatgtgtgttggaagccctttaagttgcgatcgagggtccgattatggcgatcttctctttgcactggcacatcaaatttaatgtctgtggtcgttttggcttatctggtttgcaacataaaccagttgggaatcatgttacagcgaatgcatttgttgggattgactttaataatgaggctggttttgtttaaaaaattcatggtttccagttgtaggggaaaaggacacacactatggctaatgtttttaagtgtgtacgtgaatgcatatgtaagtaactacaaataatttctccctgttaactgggcttctgaaattgggtgattattcctagatttaaatggcttggaatagttaaa

SEQ ID NO: 398667 - DNA, 777 bp, Homo sapiens
gctgaataccaatctgtgcatgcaatgggtaagctccaaaaggctagtcaaagaacaattgtaagaatgctgttagccaaataattactagagctctcatggggccaggaattgttgtttaatcccatttagccttctaacaaatcttaaaaactgatctgtaagcaagtgaactgtcagaacaaaattcaaccttcttcaaaagactacaacaaaatccagcactcaatatgaaattactagacatgcaaagaaacaggaaagtgattcagtcagtagaaacagacacaagtgtgacaaagatgatggaattagcagattaagacataagacaatcgttatgaatgtgctcagggatttaaaggaaaacacaaacatgaggaaagaaatggaagatataacacagaatcaaatgaaacttctagaaatgaaaaatacagtatttgaaatgaaaatttcttttttttctttctttcttttttttaatagagacagggtctccctgggttgcccaggctggtctcgaactcctgggctcaagtgattctcccaccttggcctcccaaagtctgggcttacaggtgtgagctaccatgcccagcctgaaatggaaatttcactggataggattaatagtaaattagatagtgccagtactgcagaaagaaagaccactaaacttaactcaatgcaacagaaactccagaatgaagcacagagagaaaagtgactgaaagcaaaataaacagagcctcaatgactggtgagacaacatca

SEQ ID NO: 398668 - DNA, 454 bp, Homo sapiens
gcacgaggaactttcagaaaaactgctgtaggttgaaataatgggcccaagctgtaacatattagggatgaatagaaggtcctatatcaaagttcatggggaaaaaaacagtcacagagtgcagactttagggagagtaactgaaaaactattgatctttttttttaaaaggcctgttgggttggctcacatctgtaatcccagcactttgggtggcagaggtgggcagattgcttgagcccaggattttgagaccagcctgggcaatatggcaagaccgtgtctctaccaaattaaaaaaattaacgtggcatggtggcatgtgcctgtggtcccagctacctgggaggctgaggtggaaggattgattgaccgtaggaagtggaggctgcagtgagccatgatggtgccactgcattccagcctgggtgacaacagggcgagaccctgtctc

SEQ ID NO: 398669 - DNA, 425 bp, Homo sapiens
ctcttttctcttcattcaggtggtacttaccttacattgcagtataaataactcacgcctcttgcttttctcccagatgctccaaagataaaggccatgaccttcactttccctctcttctgcacatctaccatagtactgagaacctaatgtaatcacgggtctcactctgtgagtgagctactatttggtggaaaaagcactaagaaagtataaagccttatatatggaatgattgcaaaaaactgagatgttaatttgtcaacaattagtaccagaatctggccaataacttggtattttgaaaaatgtactattttaaataatttatgttcttcaaaataaatgtaatatttgttcattatagactttctggaaaatacaaaaagaaaataaaaatgatttctaattcctgcactcagaga

SEQ ID NO: 398670 - DNA, 334 bp, Homo sapiens
cagaagaggaggtacagaacaataacacctgattgttatcccaggaattatttacatccaccgagcaaagcccactcagctagcttgggcacgaagagaggggtggggttggatatattgttccctgaaacccagagcagaaaatgcagccagcctcgcaggggccaggaaccagctggcagctcccgggccatctgtccttgtagcctcaggatctcccatggagcctgttctggaccacttcctgcagttgcccactggcccacatcccccaagagcaacccccagtgagcaccttccacctggagctgcagtgtccttccctgttgtcaaa

SEQ ID NO: 398671 - DNA, 134 bp, Homo sapiens
agaagcatgacaaacaccaaacataagaaacacgaatgaagccacatcaactcataataaaattgctgaaaagtggtagtgatgagaaaaatcttaaaagcagccaggaaaaaaaaaagaaaagacacattaga

SEQ ID NO: 398672 - DNA, 163 bp, Homo sapiens
ttcctaccttaatcttaaaagatctctatatccttcattggttccttatctgtgagctggcaatatttttttctggatatctgattgcattcctttttgctacagtttggttcatttccctttgttcagtccttggtagggaagaacagctggtccccgcatt

SEQ ID NO: 398673 - DNA, 637 bp, Homo sapiens
tcctacttatgcttaatctcactctgtcacttcagtgaaactggtctgtcagtcaccagtgatcttcatttttctgaatcccatggagtgctaaatgttggattgctttagagcttgttcctaatgtatcttattctatctatttcattcttctagacctatttttaaaatacaacatatatactaatgattctcaaatgtatttatgtaaatctgacctcttctctgagtatctcatatagacaaatatttaattgatgccttcatttagaagtctaataagcttttcaaactctgcacattcaaaatggaactctagatttccttcccgaacctattcctttcttaggctgtctcggattaatcatcttcctagtggctcaaataaaaaattaaggagttgttattatttccctttttcttttgttacgcatttgcaaatcacaaggaaccagtctccattcctgtaaaacatatttcaaatccatatacctctattcttttcactgccaccatgttcttcacagcctctactatttcttacctggagtgctgcaatagtatcctaataggtccctctgtaattccttctttacaaaccagtctttacagaacctattaatcataccattcatgc

SEQ ID NO: 398674 - DNA, 606 bp, Homo sapiens
gaaaaaaggggaaaatcttgccttaaaacatccaggatggagttataaatagttctcaactaataacaaattgaaattgagttatataacccttcatcctgtcccgcggggggttctcagcacctattctcactaacccagtctcatgggagaggctccgtagcagctgtgcctagggttaaaccaaagagatgactggcaaccttccaatccagaatagcgatataatgccaacagaaaaagtaagagaagctggcaatctgtgtagccccaagggtagagatgtagataaaaattcctgcacatttaacctgctgtcaccagattctgagaagcagaatataacaagtgtagttattgttattccattcataagtgaatttgaaaaactcaatttaaattaatatatgtgtttccaaaacatgcccacagggaaggagcagtcttcatgttccattgactccagagacgttcccattaaatgcatcaccaaccctagagtttaggtcctgcacattgttagctctgctgtgcgaaaacatgaattaaagcttaaaagatcatagaagtgaaaccatgtactagaaactaccacaggtgcgttgg

SEQ ID NO: 398675 - DNA, 420 bp, Homo sapiens
aaagcccaaatcccataaaaccctcttggctggactgattacagtttactacagcaaaaagcggggaaaaagagaggatacaagaacttttttcggctcttccatagttcatggataatctcctcgaaatgtttcatgcagacggctctgcccagtatttgggctgtaaaaacatcgtgtcagacagtttggaagacgttgtaaacaacctaaatgtccgtcaaaagaaaatgagtagataagaaagctgaggtcacaaaaaggaaagtgactggtccaagttgaaattgatcgtaattagcagagccagaagttgaaaccagttctgttttattataaatccacaccacactttggatcacacatcatcagtggcccaaactctcagctcttgcaaataaaaataaatcaacagttaaa

SEQ ID NO: 398676 - DNA, 476 bp, Homo sapiens
atcatgctagatagccagtctctcatttctccaacttaaaaaatccatctctgaaattcatgacagtgatggcagacggcaaagcatggtggtgtccacctctggggtgtgggcttcccggaaagaatcccagctgaccaccccagaaagtgcaagaataacattgtgctgtacatagtcaagtgctataaattacagttatcataatgagaaggcagaaatgaaactgagttgtagctatttgttacaagataataagaagtagagatattagtatggaaaaagaaacttttcctgggatttaaaatcaggccaaatttatcactcgagttcttttagaaaagaaaacaggtactggagtagacaacttcttccagataaagtttcaaaagatacgagaacattttttcaaataaaggactcacattaatcttttataaaaatcacaaaaataaatgaaatcttaattcagtgca

SEQ ID NO: 398677 - DNA, 493 bp, Homo sapiens
ctggcattccttctcccctgtgcccttggagggtatttagtgctacctagaatgtgagtcagagaaggtacagataggaagaactgttctcacaccacaggagaagtaacagctcaagggcctagctagtcagagcagtgtggcactgctgctccagaagtctggcttcatcagcagtgatgcatggctctgagctctgaacaggaagcatggttgatctgtgctgaaggcttggttgatctcttgaataaactgagagatgatggaatggtgcacagtgaatctcctctgaagactgaacatcttccttggaccatgatcagtgaacatactggaacatactggaacattctgacaccattttccatcccaacccctgttctcccttagttttctggtcttagggttacaacttgaagtgagtaccttccattgtagcactcatttctaaaagcattaaagccaattttctgactcatctgtatttcaagtc

SEQ ID NO: 398678 - DNA, 563 bp, Homo sapiens
ggcgggctctcaggccaggggcactcgcgatccagaggccgcccaggccatgctccaccacctgggcgcccagctacaggcgccaggcaactcccaagctggctggcgcgcccagcctcgcagacctgggcgtggatgtcgccgtggctgcggccaagccaggcggtctgcccggcggcggctgcaccggggcaggaaccgaccctcagccccatccccggtggctgcggacggcccctggagaggccccgacctctcttcggaggagaagaggggcgggagtcaaggacaggcaggccctcaggcgggaagggatgcgtgcctgcgattccgggacataccgcgccagcccaggagaacccggaagcccgcagcgcctgtttctctgtgtgattctgtgaggaaccaccaaattgttttccacggcaagtgcatcattttctattcctagcagccagttcataagggctccaatttctccacctccttagcaacactgattttctgtgtcgttgttatgaaagccttactagtggatgcaaagtggcatctcatttgggttt

SEQ ID NO: 398679 - DNA, 985 bp, Homo sapiens
cagatttggctgtaaaagtgaaactggggatgaggtggaatggagagagagtggtagagacagcttgtgaccagtttactcccctgcaatggtatagatttgtggctgcaaagcagctgcttgtaaagatgagctgtaagtttgtttccttctgtttggatcatttaattttgttaattttaagaatgaagacacaagagcatgcctgaatgcaatgggaagtagatcagttgacctttgctgaataacaaggtggacctaaaactgggtgacttgaaacagtaagtatttttagttcttgattctgcacatcagcagtctgggctgggttcagccagaggattctgctagtctgagctgttcttacttacattatcattgcagtccatagtcagtcagtgggtggttttctggggctggatagtgtatgatggttgaccttcatgggtggcagttagcttgctgctatctagggtcaataggcaactagacaacatatcttttgtcatctcataagctcgtccaggatttctcctttttgatcaaagcaaaccacatgcccaaacctggagtcagagtcagtgttgaagggcattagcaaagggtgtcactcagggaggcatgaacaaatcaaggccattatggaattcaatttgcccaaaaggcatagagaatgaatatagaagtatgagatagggtaactgtttgagatggtcatatacagtcctcagatccattttagccttaaaatagaaggcagttttgctaggagttcaacaattaaaacgcatcattttggtggcatttcaaaaaaaatgttggtggcagatgcagtgttttgttttcttgaactcttatcatttatttctcatagaagctgcaaaagcaggccttccattttagaaaccgggacagcccgctgccagtaatgtgctcagctcaactctctaattactgtcatgctgatggaggttaaatatttatg

SEQ ID NO: 398680 - DNA, 394 bp, Homo sapiens
taagacaagagaatcaggacacttgaacttgggaggcggaggttgcagtgagtcaagatcgcaccgccattgcactccagtctagacaacagagcaagactctatctcaaaaaaaaaaaaaaaaaaattagctgggcagggtggcatgttcccaaggctgaggcaggaggatagcttgtagccgagaggtggcggttgcagtgagcagaaattgtgccactgcactacagcttagcaacagagcgggagtctgtctcaaaaaaaaaaaaaaaaaaaaaaaaaaaaagttaagcaaaaggggatatgtcaaaagatcgcagggatctccagatgctaatgctttcagccatgttcttcaaggcaggagccaggtgactccagatcccaacaggag

SEQ ID NO: 398681 - DNA, 378 bp, Homo sapiens
agttgtaatagatattgctaaattgctctcaaatgttgtgccaatttatgcacccaccaacagcgcacgaaagtgcctcttagaaaatgtcttttagaagataaaatacctattgttaagccatgaaacacatttcaaataattgctaaaatttttctagctgtggcataagagacaagagtcctgaggaggactgaaaggtcttgggatgcaggggagcttaatgtattaaaaggtgacattttggatcagtaggaaaaaaaatggcttatttaatacatggtgctggcataattgggaggccatgtggaaggatgctgagtttgattcctaactcatacaaaaataaattacaggtggagtaagctataggcagta

SEQ ID NO: 398682 - DNA, 531 bp, Homo sapiens
ccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaactgat

SEQ ID NO: 398683 - DNA, 681 bp, Homo sapiens
ttttttacactcagcataattcccttgagactcatccaagttacacatatcgatggtccattccttttttgttgttgagtagtattctatggtatggatttataatatttatcttaaatagttagtaaacaacatttttaatgactgcatgatgttcccatgggtggagatgtcatcggtttcctaacaattctattattgttggacatttagattgttgctggtaaaaataaatgctactgaaaatcttgtatacaagggtttcctgattctgatttctttaagatagatttttttagaagtggaataacttagacaaaggatattgacaattttcagactcttaacgcctgttaccaaattaattttgcaaaagattgtacaaatgtatataggtccaccagcaatatagaggctgaggtaagaggttttcctaaattataatacaagctgaataataaatatgtagcttgctttctgcaaaagccaactcaatatccataggaaaaaccaatgagccttattatacccatgatgtacttggtctgggtatgtatgatctaaagttacttgatatcatgctgcccttttggtgagcaacatgattggaggcaaactgtggcatacatgcatagtacaatggtggtctcttggctgcatttgtgttggctgtctgtgcta

SEQ ID NO: 398684 - DNA, 539 bp, Homo sapiens
tcttgcttgtcctgggagtggcccacgttatctgtgcagggtatgggatttcatagcttcacaatcaggagtgaaccagatggggcaagagagtggtttgacctttatgtttggtattcagggccagcacagccaagtgcattcctctgaatttgtttctgtggagcttccatgccagtcagcttggccatatcatgttctattgccatgctagatgagaattttagacgttcaagaatactgagggagagaatttttttcaaattttttatttgcaatgaaacctttttttcccctcaaaagcaatcttatcagacaactaagtaagtataagaaagaagatctggatagtgagggtagaattctcaagaaccttacttaggctttccctttctcggccaagcccctgacttggaattcccccttactcccaaagctctgtaacccatatagtttcttctcctttatttcctctgtaaccctgatggctttctttcttttcttttcttttttctttttttttttttttgagatggagt

SEQ ID NO: 398685 - DNA, 303 bp, Homo sapiens
ctgggaggtggaggttgcagtgagccgagattacaccactgcagtccagcctgggtgacagagcaagattctgtctctctcaaaaaaaaaagagagaccacacacaaggaatcgaaagtggtagagtgaggagccagaaaatctccctcaactgaagtaataacccctagaaatgctctgaggtcacttgggagctccagtagggtccttttgaaaacaggtgggattcctcagttatggaccaagaatgcagtatgcatgtgcattgcctattaatttatgaaagttttaaaggattgatag

SEQ ID NO: 398686 - DNA, 751 bp, Homo sapiens
tgaacgtgtgcatgtgtttgtatgtttgtgagtatgtaatgagtaagcatgtgtgcatactagtgtatgtttgtaagtatgagtgcacctgtgtgaggatgcatgtgcatgtgtacatgggtgagcgtgagtttgtgcctgtgagcatgagtgtgagcatgagcatatgtacgtgtgcatgtgatcagcatgtgcgttgagtgtgtgcatgagcatatgagcatgtttgagcatgagtacatgtgtgagcatatgtgtgcatgttagcatgtgtgcacgagtttgcatgtgtatcactgtaactgtgtgcatgtgtgagcatctgtccatgtatggtgagcatgactgtgagtatgagcgtgtgtgtgtggggccgtccctgcagacaggagagtcctaagccacggtcgatggtccccctaccctccttggtcccctccccacacatgcagcaacccaggtataagcagtaccctgccctttgctcccagcaaagacctcaggtgctgggcccattgcaggcacaagctaggcagatactcgctttcctcagcacctgatgaaccagcctcccgaggccaagataaggacacaccctggaggtcatcgggaacacggtttccagggaacagggtctgcactggcaccacaaacccaagggccccccgaactgtgcagcctcccatcagacagactgtgtcttttttgagacaggggtttgactcttgcccaggctggagtgcagtggtgc

SEQ ID NO: 398687 - DNA, 512 bp, Homo sapiens
caacaatttgactatagtgtgtctcagtgtggatttctgagtttgtcctgattggaatttaccgagcttcttggatgtgcatattcatgtcttcatcagatttgggaagtttattttttcaaatatttttttctgcccctttttctttctgggactccagtgattcatgtattggtacacttgatggtgccaccagtctctcaggctctgttcatttctcttttttttctctctctctttctactcctcagaatggacagtttgaattatcttgccttcaagtttgctgatccttacttccccctgctcaaaggtttcaacagcagatttttcatttcagttattctacttttcaattctagaatttctgtttggttcctttttacaatttctttctctttactgagattctcattttgtttgtacattgttttccttatttgtttttagttatttgtccatgttttcttttagttcagtaaacatttaagatagttcatttaaaaaaaaga

SEQ ID NO: 398688 - DNA, 332 bp, Homo sapiens
actttggattatttaaacttggccaagagaggttcgcattttggaaaactgtattcctgatggcaatgctctttagggtgtgtgggtcactcaccgtaagtgtcacatcacggttgttctgcatatgtgtaagtatgtgtgtgtgtttatgtgtggggggctatttatacacacacttatttaatatactgatttaccccttatttcaaaatggcaaatcaaagtgttgacagtattcagtattgtcttgtttcctgtgaacccagccgtatgtgttgtaagtgggtgcatgagaagatctcatcaattaaatgtacctgctggtatagtta

SEQ ID NO: 398689 - DNA, 1811 bp, Homo sapiens
  misc_feature (122)..(122): n is a, c, g, or t
ctgtgtcccaggggcagtactccccttctacagcagggggagccagagacccacacagcatcaggaatcccacagcgcgatcaagcagggagggaagagaagggagtagtggtgtccagccnctactcccttcatgttcctgatccagtcccctgggagctgtgcagctccaggatgttggccccagtgaggtgggttagcagaaggaaccgcaccgttgggcgtccgcgagaacagctggcgtcagggacttcctcgggctccctaaggacctgctctcccagttctctactcttccctctgaggcagaggctgggcaggacccacaggcagcccttagtgacccgcactccacaccctgtctgccttaggagaaatggggtctgtgaatctgggctctccctccatgctgccgtgtctgcggagccaggtgccggcgtggcctctgctagccagcagagtgagcatgcacagctggtccagggcacggtgttttgtttgcactgttccagacatcgtcatctccatctgatgatgatcactcggcagctttgagccctggcacagcttcgggtcgaagcacgttcccttttcaggagagttgagccgagctttccttcacgcagacttaatttcctggacttagtgctaacgtcaagaccaaacctgtagggtcccagaccggagcctgtgtccctagcgcaggtgtgtctgtcgggcagccgacggtgcctgtgcaggcagtggctggacaccactactcccttctcttccctccctgcttgatcgcgctgtgggattcctgatgctgtgtgggtctctggctccccctgctgtagaaggggagtactgcccctgggacacagaactgcaaggccagtggcgccaggtacctcccacaggaagaagatttgaggacatttaaaggtacccactttaccccgtgcccaccttctaccccagctccctggcagccatccaaaatttgcctccaagagcatgtctcacagacaaaggtctgtgttttatggaactgtgctgacgggctctgcacacatctcactgggctactctccctggtcccagcctgcccagacagtcaggcgcaaagtaacatgtgagtcagaagaggttctggaggaagttggagaaggctccagaagtggcctcatggaatgcggccccatctatgccgcatatgttttactgcaagctcatctccagccaagacttggctccttctctgatgcaggaaacctatcgccagtgcaggtgcctttaatgtttctctgagaaaggaggaaatgctggcttgtgctgtcgataagtccccaaggctgcatgtattagcaggaagcacagcaggactctgagagaagaatgtgtctcttctctttgttgctgagaaggtagagaaaggccctgcactctttgacttaccttcctcagtcctgtgcatccaggctgttaggtgactctgctgtgacttagtcccacccagcaccataaagaaaggcaaattgacggccgggtgcagtggctcatgcctgtaatcccagcactttgggaggccgaggcgtgtggatcacctgagatcgggagtttgagaccagtctgaccaacatggagaaaccctgtctctactaaaaaatataaaaaattagtcgggcatggtggcacatgcctgtaatcccagctacttgggaggctgaggcaggagaattgcttgaacctgggaggcggaggttgcggtgagctgagatcgtgccattgcactctagcctgggcaacaagagcgacacttcgtctca

SEQ ID NO: 398690 - DNA, 1865 bp, Homo sapiens
  misc_feature (122)..(122): n is a, c, g, or t
ctgtgtcccaggggcagtactccccttctacagcagggggagccagagacccacacagcatcaggaatcccacagcgcgatcaagcagggagggaagagaagggagtagtggtgtccagccnctactcccttcatgttcctgatccagtcccctgggagctgtgcagctccaggatgttggccccagtgaggtgggttagcagaaggaaccgcaccgttgggcgtccgcgagaacagctggcgtcagggacttcctcgggctccctaaggacctgctctcccagttctctactcttccctctgaggcagaggctgggcaggacccacaggcagcccttagtgacccgcactccacaccctgtctgccttaggagaaatggggtctgtgaatctgggctctccctccatgctgccgtgtctgcggagccaggtgccggcgtggcctctgctagccagcagagtgagcatgcacagctggtccagggcacggtgttttgtttgcactgttccagacatcgtcatctccatctgatgatgatcactcggcagctttgagccctggcacagcttcgggtcgaagcacgttcccttttcaggagagttgagccgagctttccttcacgcagacttaatttcctggacttagtgctaacgtcaagaccaaacctgtaggaaaagagctttaactacacaaacacatactgacagattcagccaaactccgagagtcccagaccggagcctgtgtccctagcgcaggtgtgtctgtcgggcagccgacggtgcctgtgcaggcagtggctggacaccactactcccttctcttccctccctgcttgatcgcgctgtgggattcctgatgctgtgtgggtctctggctccccctgctgtagaaggggagtactgcccctgggacacagaactgcaaggccagtggcgccaggtacctcccacaggaagaagatttgaggacatttaaaggtacccactttaccccgtgcccaccttctaccccagctccctggcagccatccaaaatttgcctccaagagcatgtctcacagacaaaggtctgtgttttatggaactgtgctgacgggctctgcacacatctcactgggctactctccctggtcccagcctgcccagacagtcaggcgcaaagtaacatgtgagtcagaagaggttctggaggaagttggagaaggctccagaagtggcctcatggaatgcggccccatctatgccgcatatgttttactgcaagctcatctccagccaagacttggctccttctctgatgcaggaaacctatcgccagtgcaggtgcctttaatgtttctctgagaaaggaggaaatgctggcttgtgctgtcgataagtccccaaggctgcatgtattagcaggaagcacagcaggactctgagagaagaatgtgtctcttctctttgttgctgagaaggtagagaaaggccctgcactctttgacttaccttcctcagtcctgtgcatccaggctgttaggtgactctgctgtgacttagtcccacccagcaccataaagaaaggcaaattgacggccgggtgcagtggctcatgcctgtaatcccagcactttgggaggccgaggcgtgtggatcacctgagatcgggagtttgagaccagtctgaccaacatggagaaaccctgtctctactaaaaaatataaaaaattagtcgggcatggtggcacatgcctgtaatcccagctacttgggaggctgaggcaggagaattgcttgaacctgggaggcggaggttgcggtgagctgagatcgtgccattgcactctagcctgggcaacaagagcgacacttcgtctca

SEQ ID NO: 398691 - DNA, 459 bp, Homo sapiens
taattaggatagctatttgaccatttgaaaattaaagactgctgagacagagttattttagaattttattgccttttttgtgttgattatgcataggagtatgtgttttgatttgttaaatgaaaaactagactgttttgagaaaagcaaggtactcgaataaattttattaattttttcgttcattagggagggcattttttgcttggaaatagataatttagatatatttacatgtttggtatttgataatgaattataaaaaggtttagtgactgaagcttttaagtatgcttatttaaatttctagagctgtaacagtaaattttacccattttataaagtagtagagaacagatacaaagaagagtcccaaaagcatttttttaaatacttggttttaagtctccttttatcttaatgatcttaagaattggcagtagtcatcaaaggggaggt

SEQ ID NO: 398692 - DNA, 397 bp, Homo sapiens
atattccccatccctcccaaaagacccagagatcccaattccttggccatccatcatcctctctattgcttaagcagctctgaggtccgggtcctgagaagaaacctcaaagaagaatctatgcatagagtaaggccatctgcctgattgccatttcattgcacaagcaagcatcaaattaactctccccacagccttttcctctcatcatgatcacattggaagcagctactattggggaagaaaaggcatatgatgtgcctcctctttcctggcatctgacaagaagctcagtgagaacatcagttgggttgggctctgggttcagtgccaacaggccctggcagctgcctggctgcagtggaataacagcagttacaacttaactagaggcaga

SEQ ID NO: 398693 - DNA, 280 bp, Homo sapiens
ctgtggtctgaacctcctgctgtctcttgtaaccactggctgggcccctctcagctccttcttggcttcctgtacgaatctccaagcagagcattgctggttgcctctctgtggcctggaacaggaccccccaccatgagcaggtgggctgcacatcagtacagcttccaagcaatcctgcaatcacagcatggatagcagaactgtgtcatgctgtatgttaatgttcaaaaagttaatctgttcaacacatacatttaaaatatactgtaacagttac

SEQ ID NO: 398694 - DNA, 300 bp, Homo sapiens
tagctcaccacccctatttttcccatcttgcagtccacttgaagtcactaataaataatatttctgcttctgcaataattcagcttttaagcactagtgactgcctaattaccaaacgcaacaatttttctttggtccttaatctacttgtcctcttgtatttgcagctgttaaccatcttcatattgttcagggttttttttttcctcctttgatttctcaatatgaacactatctccattttatgcttgcctttccagaagatctctctccttcatgggattcctttgctttttccca

SEQ ID NO: 398695 - DNA, 284 bp, Homo sapiens
atggatatcgcccaacaccaagttaactaccagctttccacagggccctgggatagagtcatcaccacctagaatgaatggcctgaacacctttgaactgtggtaggactatttcttccatttcagcttagatttgtggtcttctctataattgggtgttggggataacatcactgatgttatcgcccaacacaagtttgtaagtgttcttaaaacattatgagactttttgtataatttttttttttcctcatcagctattgttagtgttggggataacgtca

SEQ ID NO: 398696 - DNA, 381 bp, Homo sapiens
agctttgaatctcatttcattaaaccataccacctatcatcctccctctcttgcaggcacatactacagtcttttcttacttctccaacaccacacaactccaacaatcatatgaccccacaacaagactttcaagccattgatcttaccacctttttaactaaccttcacctgcttcctgtttttgcttccctccttacctagctagtgtaaatcccatggccaatcattataatcacttccttgaatgcaccctcaacctgccctcctcactagactaaaccgcaatcccagttaaatcaaatgttctgcctcatccacacatgtagctggggaaacacacacacatgacaacgctagtatccttttttttcttccctt

SEQ ID NO: 398697 - DNA, 367 bp, Homo sapiens
cgcccaccaccacgcctggctgatttttttgtatttttagtagagacggggtttcaccttgttagccaggatggtctcgatcccctgacctcatgatccgcccacctcggcctcccaaagtgccgggattacaggcgtgagccaccgcgcccggcccatcatacaatactttttgtgtctggcttctttgacttagactccagcctgggcgacagagtaagactctgtctcaaaacaaacaaacaaaaattggatttttgtttttcttcttcttgcctggctagaacttgaatagcagtggtgaaaataagcctccatgtcttgtttctcattttagggggacagttttcagtctttaacctctcag

SEQ ID NO: 398698 - DNA, 671 bp, Homo sapiens
gccattggaggacttaagctttgacgctgaatgagttgggaaagcatgagagggttttgagcagaagggtgacatgacctgacttatatgtttgaaggctcacctgggctgctgggttgagactagcctgtgggaaggatgcaagagcaaaagcaaggagtggaagacggagggacacgtgggcagattctggatatgtgttgaaattggagacaagaggagtcactgatggatcagatgtgggatataaatgatggaaggaatcaagagtgactccggagcttctccatggaattgccttttgctgagacggagaaaactataggaggaataaatttagtgggagctggaatcaagagtttttgttcatgctgagtttgagatgccttttagaaatccaaaaagagatactgaggaggcagttttatatcacagactgaagttcaagtcagggtctgggatgagatggatacgaaggaaatgttggcatacagatggcatgtaaggccatgacacctgaaggaaagaggagcatatctacttaacaaaagagaaggaaatgtcagtgcaagacaatgaaagctagctttagactctgggtcaggggcagtagcctcagttcctaatgtaataatgatctaactgagtggctaccatgtgccagatcctat

SEQ ID NO: 398699 - DNA, 735 bp, Homo sapiens
gccattggaggacttaagctttgacgctgaatgagttgggaaagcatgagagggttttgagcagaagggtgacatgacctgacttatatgtttgaaggctcacctgggctgctgggttgagactagcctgtgggaaggatgcaagagcaaaagcaaggagatcagttgggaagctactgcaggaatgcaggggagagataaagtggccttgacaggaggaggagtggaagacggagggacacgtgggcagattctggatatgtgttgaaattggagacaagaggagtcactgatggatcagatgtgggatataaatgatggaaggaatcaagagtgactccggagcttctccatggaattgccttttgctgagacggagaaaactataggaggaataaatttagtgggagctggaatcaagagtttttgttcatgctgagtttgagatgccttttagaaatccaaaaagagatactgaggaggcagttttatatcacagactgaagttcaagtcagggtctgggatgagatggatacgaaggaaatgttggcatacagatggcatgtaaggccatgacacctgaaggaaagaggagcatatctacttaacaaaagagaaggaaatgtcagtgcaagacaatgaaagctagctttagactctgggtcaggggcagtagcctcagttcctaatgtaataatgatctaactgagtggctaccatgtgccagatcctat

SEQ ID NO: 398700 - DNA, 446 bp, Homo sapiens
aatccaggcatcggaggcaacacacaaggcagacttaggttcccttctgttcctgatattctgtgagagctaagtcctcagagaccctctgctgggagtcacggtttctgaccctgagtgtgacctgccttggtcacatacttctctcttgtgtaaaatccacagcttccagctcctggacaccaccaccaacttcaagctctactattaatcaaaaaaactgaaggcaatggccatcttttcgctgtctctaccatgacttccaaattaaaaacccaaagcctcactaattctcgtgttcgctcactggcagatctgtaaaatggtcagagggtaccaactgcccacaatggggatgtttggcaagaggccaagaactcactgagggctgaagaagcatgttttgatgggggacaaggttggtagaaggcaggggaaacaagaca

SEQ ID NO: 398701 - DNA, 484 bp, Homo sapiens
atactttaccttggaatgcagccggaggagccatcctaggcagtgacccgggaatccttcagtgtactttgtgaaagaggctgtctgctgtcataactgatctcttccatacttggtggtttttccttcccaggcactagtattacatacatcttgtttcttaagtcactacttggtaagagaagcgttgcctcaaagcaggtaattctgtgtactgtgaacctagagccaccagggaaggccacacttctctaacggtgaagtgagtctgcccaggcagtcatctccagtgatgggtcctggaggctctgccctctgtggcctggggttgctgctgtgccccttacaagacagcctgctgtgtgtggctgccatctcctaaactcaagtttggctcattttctttgagcatgggtgatatatctttttcctttcctaggagaaggggtgacttctaaataataaagttccattgttgctaggg

SEQ ID NO: 398702 - DNA, 350 bp, Homo sapiens
tttcattaagccattttcataaacattaatatgtatttagacatacatagacatatgtatatagtgagttgcaataaaaatatattttttattgtctgtctgggtcaaaaaaaagtttgcaagccactgaactacacaatctcaataccttgaaaatagttgatgttcagtaaatctgtactaagttgaattaatgtattgttaaataaaaaataacccataaacagtgttaggataaaatacttctgctgagcatataatttccctatggagtaggactgaaaatgttagtctcacagttcttaaccaatgaaactgtaattatcaaacataatctattagtttatacc

SEQ ID NO: 398703 - DNA, 860 bp, Homo sapiens
gagatggggtctccctctgttgctgaggctggagggcagtggtgcaatctcagctcactgcaacctccacttcctgggttcaagtgattctcccccctcagcctccggagtggctgggattacaggtgcataccaccacgcccggctaatttttgtatttttagtagagacggagtttcagcatgttggccaggctggtctcgaactcctgacctcaagtgatccacctgctttggcctcctaaagtgccgggattacaggtgagagccactgtgcccggccacctgtgcactctttcatgggatttctaagcagtgccgggaggcaggcaggatcgcttttgacttatgatgatggaagaaaattaagctaaagtgggtcatcttgtttcaaatgcagtgattgtcccatcatgccttgaagcctctcgaaaggagaggtgtgagagtcagtacaacactttgccatcggcagaggtctttgggctggctctcgatgcctctgggccctggaacaagagaacaaatggaggccgcccaccatgtgtctaaatattatttaaaagttattaattaggggctgagcgcagtggctcatgcctgtaatcccagcactttaagagactgaggcaagaggatcgcttgagcccaaaacttcaagaccagcctgggcaacatacaagaccttgtctctacaaaaaaaatgtaaaaatttgctgggtgcggtggcgtgcctatagtttcagctatttgggaggccaagataggaggatggcttgagcctggggagttgaggctgcaatgaaccaagactgcaccactgcactccagcctgggcaacagggcgagaccctgtctaaa

SEQ ID NO: 398704 - DNA, 353 bp, Homo sapiens
gtacataaattatactcatcaaagagacaggatattcctagcattctggaattcccaggactccagaaccatcctaaaatttctacctatatgacctcaatacaggtatgtttgggttcacctggcactgtgtgagttctattcttttccatgaaatggcgactgagagacattatcagcaatgtaaacaaaagtaaaacccagtttgattcttggctattactatagttggcaatgaatgtgtcctgaatgcaggtatcaagtaggatcatatattcagtctgctaaataccagttttctcactgacctgttaaaaattgactgatgactagtatcaggcctataactgtac

SEQ ID NO: 398705 - DNA, 132 bp, Homo sapiens
agagcagatgccgtccagccctcccgtgccctgctcctcggagtccctgccacccaggacgtggccatggtgcggctctcaggctgaggccggcagccaccctcctcctttatcattcctgcagtggtgtca

SEQ ID NO: 398706 - DNA, 402 bp, Homo sapiens
ggagaagcgggggtgggggagagagagagaagtaaaaaggattcactcaagaacctggtattcaaaactacgtgtaccagcactaccacagcagtatgactcagtgtccacctaaagcatgatgatactgcttaccaaaaaaagtctggagggaatgaaaagttgggttagttttaagttatgggtcacagaacagaattcggtggtaaaaagcttaggctgggaacagagcttgaaacagcaaaggaatgagaggaacgaccaaaaagccaaggaccatatagtgatgtctgaaaaatcagaatcaggtaataatattgaatactgcaaaagtcagagaaaatgtggaaataagaaagcaagcgatctggaaagtggcgagtaagatggaatatgaggagg

SEQ ID NO: 398707 - DNA, 310 bp, Homo sapiens
cactggcacaatgttacttctgcctgaatatcattcaccaaagcaagtcatgtggccacgtccaaagccaaagaccaggaagatacattccaccgacactgaggcaatgggggatggtgaaacagcaatgtgatcaaccacagccaccaacataacatgcagtaattttagaatacttgatctcttttaaatacaattgtttttatattctgtatcacacaaattattttggaacaatttcaatcatttcatcacattaaactggatttatttcaatcaaaacgaatgtactgagaggctccaaacagca

SEQ ID NO: 398708 - DNA, 760 bp, Homo sapiens
acgttacaatgtagatttattttggtttcttttgtggtgtggttttttttttggcttttgctgactttattgagacataattgacaaaaccgtatatatttaaggcatacatgcaatataatgatttgatatacatatatactgtggaatgatttccacagtccgtttagttaacatatctgtcacttcacctcattaccattttatgtgtatgatgaaaatgtttaagatttactctcttagcaaatatcaagtttacaatacagtattgttaattacagtcactgtgctatatattagatctacaggactttctcccagatccatagaatttctccattatgtaaactccaaaagaatgaaattctgtggatgaagccttaattttactcttgataattaattttagttctgataatttgtgttaaacaaaaaaaataggagggcttgttttgctgcatagttttaaaatatcacctttgccttctttcttgaaaacatcttgcgttttcatttttttattttttaacagcctccaagggatgagccatcattagagatcaatacagataacacgaggatataattactttgtggcctaggatataattatttagctgtcatttatttctcatttggagggaaaaataaatgaaagtattatttatgagccacataaaaattctgtgttttttttccctccttgagaaagcgagaaatcacactaatgtttcagctattttactttgttcaaactgga

SEQ ID NO: 398709 - DNA, 389 bp, Homo sapiens
  misc_feature (10)..(10): n is a, c, g, or t
  misc_feature (13)..(13): n is a, c, g, or t
  misc_feature (17)..(18): n is a, c, g, or t
tttgagcggncgnccgnncaggtacaggagggagatccctgagttgggaacatgctggtaatgcttgggaaatgttacaaaacaccctataaacaaaacattcagcttcccaaagagctggccattatcttgagctctttcttaccattcaggcttagaaatactcattttgtggtcagtgtgggagacctttaatcataaagtgaagcttattaaaataaagatttttttatttaagtatttgttttaggaagcaagattgttatttttttccttctgtttttaaaacactgtaatatagcatttatattcataactaaatattttaaaacaaaatatgaattgccagccttgttcataagggaacatgattctgtagtcaagtcatg

SEQ ID NO: 398710 - DNA, 679 bp, Homo sapiens
ccataaatggtatttccagtttttgttgatttattgggctgtgggggtctctggttattctcttctatttcaaaaagctatggtaactgatttggttttaatttgctgtaatataaagacagtctctagatattaataaagttcagcttcattgaaatagccaacaaactaaagacataattgaataaagcaatagtacacagctttccagaaatatgtaaaaaccaaagtgaatatttagatttgtttttaataaaccttagttctctccttttccccaaagcactagataaacattttaaaaatatggctgcaatttgatttgaatattaggctaaaatgatttttaaaatctaatgttatatttgagaagcttaaaaataacccaaatccccttatacatttctacctgtatcatggtctaaagtatagattaatatgcttgtcatgggatcggtcatcacattatcagttggttttacaatcagcactctccccctctcacaaagtgtatcaagttaaattccacctaagcttgcctcaagtataacagcttaattatacagttaatttccccaaggtagtatctgtttgggagaaatagtttctttaatgtaaatttgattttttggctaattaatggccactcgatgtgtttcatacataaattcaaacaaag

SEQ ID NO: 398711 - DNA, 313 bp, Homo sapiens
caggaagctattgtgctcccgtgaagttcaaaggaaaggaccgtctgtccgggctgctgagccgtggtgcaggcagagggcgcggagggggtcgctggcccctttctctttgcaacaggaaaaggggcgaatgtctgggacagaaaatgacttctgaagacacgaaaagatttaccgtgtctggagcaacctctgaacttttgtggtggtgatctcagaaaaatgcatattttcctattggttgcttagatcatctcccatccttcttccctccccctccccccccgcggaggtggggggatccctaaagaga

SEQ ID NO: 398712 - DNA, 455 bp, Homo sapiens
ttctctcttctctctctctcgtagccccctacgaggcaactaaggtggtggccgcggtgcgcggggccggacacgcgtggggctctgcctggcccgggcctccgcgccctctgcctgcaccacagctcagcagcccggacagacggtcctttcctttgaacttcacgggagcacaatagcttccctgcaacttagctggagctccctcggatgcattcctggctcttcacgggtcgctggcccctttctctttgcaacaggaaaaggggcgaatgtctgggacagaaaatgacttctgaagacacgaaaagatttaccgtgtctggagcaacctctgaacttttgtggtggtgatctcagaaaaatgcatattttcctattggttgcttagatcatctcccatccttcttccctccccctccccccccgcggaggtggggggatccctaaagaga

SEQ ID NO: 398713 - DNA, 560 bp, Homo sapiens
ttgctcataattttgcttttttaaaaatcaagggaaaatatagtaggaaatcataaaatttgggtcttgtcttgattgtgcctctagctgttttacttcagtacttccgttttccagccttctatttcttcatctataaaaccaatttgattaatttatcaatttctctagcaagtctctgacccctctgaaatcttatcagtaacatatttagttttacctttttgatatcactatttcgatttaaagaataggatggttttggccaagcgcggtggctcacgcctgtaatctcagcactttgggaggctaaggtgggcggatcacctgaggtcaggagttcgagaccagcctgcccaacatggcaaaaccccatctctactaaaaatacaaaaaaaaaaaaaattagccggacgtggtggcgggcgcctgtaattccagctactcaggaggctgaggcaggagaatcgcttgaacccaggaggcagatgttgcagtgagccgagatcgtgccactgcactccagcctaggtgacaagagtgaaactcttgtttcaaaa

SEQ ID NO: 398714 - DNA, 447 bp, Homo sapiens
agacaggtgacagagtgagaccctgtttcaacaacaacaacaaaaatgaatagtcctgtttgcttattatactgtcctgtttgtatattatacaacacccaggtgtttcactctttctatcacttttctgccccatgtaggaatttgatttgatccatttttgacattatactagcagccaatgggattgctctagatttttgaatggaagccttgacatgctgaaagtaaaaggctctcctctatccctgacctccaattgtccagcattcagacatattgtacactagtctctacatgttcttgtctgttgggagagaagaagcccttcagacttaacaagaatgcccataagtaaagagaagcaaaagagaagatgacaaggaaaatcagaaagatggaacaggctcctttcttttctttctttctcatacttgagtcctgttt

SEQ ID NO: 398715 - DNA, 559 bp, Homo sapiens
tcaagtatcactcttagagccatgttcatgccactgcactccagtctgggcaactaagactctaactcaaaaaaataaaaaaaataaaaaaaataaaaaatcactcctgctgcagtgtggagaaaaaagatatgaaaaaagtaaaagtggctagagaaagggagtcagattaaaagaagttagtagcagtccagctaagataatggtagcttaaattagggtgttgacagtagaaattgagagaaatggttccagagatatttagggcttggtagctatgggtcaggagacaaaagatgtagaggatataaatgagaaagtctaaacgagatcattcaagaggaaacaggttaagtattagaaatatttagcaattaaacagtataataaactgaaatctagaactgctctgcttaaaaacaagaagggagtcaccaacaaaaaataagaatatctaataaaaaaatacaagcccaggtctccattgatagaaactcgccttagaaactaaacaggaaaaaaaatcaggaaaagttccacagaaatgatggacgagtag

SEQ ID NO: 398716 - DNA, 293 bp, Homo sapiens
tcaagtatcactcttagagccatgttcatgccactgcactccagtctgggcaactaagactctaactcaaaaaaataaaaaaaataaaaaaaataaaaaatcactcctgctgcagtgtggagaaaaaagatatgaaaaaagtaaaagtggctagagaaagggagtcagattaaaagaagttagtagcagtccagctaagataatggtagcttaaattagggcatgcctgcagtagtaataaagaaatagttctggatgaatcagtagccactcatgtccactatcttctgtcc

SEQ ID NO: 398717 - DNA, 403 bp, Homo sapiens
cctgagcaacagagagagaccatctcgaagaaaaaaaaaaatctttacacacagacattcacacagttagacataaacacagacttccaggcatagatggctttgccaatgaaaatgaagcaacatatcaaacttatttcatgaaatcagcatgatcttgatatgaaaatctgacaaggttattacaacaaagaaatattacagaccagtagtctcgatacagatgcagatttataagtgaaatccagcaatatatagaataaatgatacattaaaaataaattggtttattccagacatgtgaagttggtttaggatttgaagatcatttagattcaccacatttataggaaaacaggcgataagttatgtgatcatttcattagatacaggaaaaacattt

SEQ ID NO: 398718 - DNA, 293 bp, Homo sapiens
gagagagagagacccaaatgggaattccctagggccagtttcttaatctttctgtgcctcagtcccctcacctgtacaaaggggataaacatagcccctaccacaaaggattgcaatgaggattcaatgagttagcatgtgcgaagtgcttccagtgcctggtacgtagcaaccactcttcatttagtttttattggctgggctccgtggtacacatctgtagtcctagctacttgggaggttgaggcaggaggatcacttgagcctgggagtttcgaggctgcagtgcatgc

SEQ ID NO: 398719 - DNA, 415 bp, Homo sapiens
tcctgaccagtgttagtgtatattatgtgtggcccaggacaattcttccattgtggcccagggaagccaaaagattggacacatctgttttaaaaccttccttttatttgaagatgaatatgaaaattaaataaatgtccatacttaggtttaaacaaaccaggaatgtcaccacccacaagcacagaggaagaacagttctatttctttagacctacaaccttcgtaatttgtttttggttttcatcctctaaactgtcttccatattgcccatgttctgtgtgcaattcaatcaagtaaaattgctgtgatcttctactgtgttgccatgtaccatgctagactgaaagacacagagattaataaaagcaatgagttcccaattctccaggaactcacattttggttaagtgt

SEQ ID NO: 398720 - DNA, 518 bp, Homo sapiens
gacctaccaaaccagaatcagcattttagcaaaatccacaagtggctcgtgctcgcattcaggtttgagaagcacttctctagagcacccgggagcttctcttacctttaactggggcttccactggtctggtcttcccaagacacccccggccactggtggccctgtaaacatggtgccaccatggatgagttgatgcctgagtatcgatgggggcaagccagagcgtccttcctaaacgctatcgaagtctctgacataggtacagcctgggggtgatggtgggtgagctgctgcttaagggccacagccccgaccctggagggagcaggaaaaaaatgaagcctaccagattcactctgggaccactatcccacccccaacttcagcctttcaagatctttttattaatacccacaattactctgatgtgattacattacacattgcatgtctgtttcaaaacatcacatggaccctataaatatatacactattacgcacccataataatgaaa

SEQ ID NO: 398721 - DNA, 755 bp, Homo sapiens
tgcagtgtgtgtgaaccccaaaaacatgatgcctaagtgagagaagccggacacaaaaggccacagaatgtgagattccactgacatgaaatgcccagaacaggcaaatccatagagacaggaagcaggttggtggctgtcagggattgggggaggggaatgggaagtgactgctgatggggacgtgggttttcttttgggaaggtgaaaatgttctaaaataatgttctaaaatggatcgtggtgatcaatgtacaactctgtgaatttacaaaaaaatcatcaaattggctgggcgcggtggctcacgcctgtaatctcagcactttgggaggccgaggcgggcggatcacgaggtcaggagatctagaccatcctggctaacacggtgaaaccccatctctactaaaaatacaaaaaattagccaggcgtggtggcgggcgcctgtagtcccaggtagctgggaatacaggggtgcaccagccatgaccaggtaatggccgacttcagtacagacgggggtgaccaagtcagaccaggggttcagaacacatgcactaaaggattctagtggcttagctcctggcctgagctcccaagtggtgaataagacgagactcgcacagcgacacagcgtcgaattgatcacgtttcatcatagactgagccaccagcaacacggagaggacgagcgtacaacactgcacgaaacactgtcggcagcacaccactgagcaggctcacagcaccacct

SEQ ID NO: 398722 - DNA, 463 bp, Homo sapiens
ttgttcttttttgacagttgcagaaaaccctttattatggtttttataatccccaaattacctcccttctgatacctaggaaaactagacttctgaaaggtcagacactgacagaaatttcagagattttccaatccaaatcccacactttcctgacgtgaaaacagaagcaaaggacaacaaacaaaaaataatcagcccagatttattaagcttagtaacagagcctgtattttggaatcaaaatctcctcattaggaaactgagtttcattttcctacctaaggaatgtttgtccattgataaaatagtgattgacaaagtttagattggtgcttctcaaacgtcagtattcacatagctctcagagggatcgtgttaaaatgcagattctgatttggtgcgccccagtgaagcctgagattctgctttttaacaagctcctagatgacgctgatgctac

SEQ ID NO: 398723 - DNA, 218 bp, Homo sapiens
ggtgagggcttgctgtttgcttccaagatggtgccttcttgctgtgttctcacatagcaaaagggcaaaaagctccccaaccctcttttattggggcactaatcccacttataagcgccagaaccctcatgccctaatcacctcctaagggccccacctctaaaaactgtcatattgagcattagattccaacataagaatttaagtgggggatacta

SEQ ID NO: 398724 - DNA, 234 bp, Homo sapiens
cacatctcaggcccagtcctgctccagaggctctaccaatcactcccttgggccttaagggtccatccttcttcaatgttctctccaaagctgccaaaatgctccccaaaccttgcaaacctgctccccacaggcaacactagctggagagcatgcagactccccaaagtccacccattcttgtagcccctgaacaagcacagaaacagcactattgtttctttcatgagcatg

SEQ ID NO: 398725 - DNA, 333 bp, Homo sapiens
tgtgtcccagactcctgagagagtcaactttgaaggacatcttaaataacctgcccttctgccctgcccctgggtactgtgtgttaagtccttgattacagaaaagctataaacctgactggttactttaactctttcccctcacctggaactgtcccagagtcatgctttaatgtgatatctgaaattgacagaaagcaattagataacctacctttagatcccatgaaaactaatatttgtatctgctgtcttgtagtacagttatttgtgtaggttctttatatatcctattaaattgaaagatccaggaaggcagaatttatgtctgat

SEQ ID NO: 398726 - DNA, 336 bp, Homo sapiens
gaaaagcattaggcagaaaggatcatgagcagaaacatgaagacataaagaaaatggtatgttgaggcaattagtcctgtaacttttggagtggcaaatgacacgtgtaaaaagataaaccagacggaatagtaaagaaccctgaaagccattctaaggttttatgtatcaccttatcaaggcaataaggaacttctcagtatctgtgacatgatctgtatttgggtttctgaaagacaactctaagaataagacagtgggataaggtgggtgacagggaataaacagacatagcatacaggataacccctgtaatacttcaagaaatgacttaaa

SEQ ID NO: 398727 - DNA, 442 bp, Homo sapiens
acagtgcccatcataactacaaggtattgctacctaatttatgcaaaattccatatgctaataaagtatgaacatcaaaaatttgattgtcatactataaacatgggtgatttgcagagccaaggtaaagaaaaatgtgggaatttatttcttgagtttatcactaaagctaagataaaattattatcaaattcatatgtccctaaaataaataacaaaatggatcataatccctttaaaaatatgtcaacagtataaaatagcataaatatttttacagaaacaaagtagtttatccatgtgtctaagttgagcaagtacagtacggcaataaactgacactgacattcaattctgtaaagttaaaacaaccatgaaaaggagttcttacccacccactgccaggaggctgaggtcttgcctgggctaataaaatgggtga

SEQ ID NO: 398728 - DNA, 375 bp, Homo sapiens
gttccattaagttaaccactttagaataccaataacacttctgcagcacttttcatcttcatagtggttcacaaacatctccttcttcactaatgaagatgagtcgaatatcttatagcatctaaaaccaaagctatttaatcattgtctggtgtgggaaagtgagacaaaatgcaagaccaacaaaaaagtatattacatttcaaacttgctgattcaaacttttgaaaaattctttgaatatgcaggcagaacttatgccacaaaaccctagtttttgtaatgaaaatggccataagcataatagcaacattgcaggggtatttttagctcttcatattttatagagtgcttttcagttcattatttcatttg

SEQ ID NO: 398729 - DNA, 465 bp, Homo sapiens
tgaggaattgggatgtattaccgggcccagcacctggtagacttgactgtacttttttgcctggactctccctacagaagtgattgggacaaatcaatgggccaagcacccagggtgatttgtaacacattgctggacccagcacccagataatttggctctcctgctatggccctgcccacagaaggcattgtgatatatcagtggactcagcagccaggtcatgtgactttcctgccagggctcttctctcaaaatggatactgacatatctctgggtcatcattcaggcacctcatatctcaccctggaaacaagccatatgaatgtgaagaaaatagacagaagccagataaaccttaacaatgtcagaaagccatcattttgttcacacatcttcaaggacacatggcattgcacactagaaatggaccttataaaagtactgtatgtgaaaaagccttt

SEQ ID NO: 398730 - DNA, 349 bp, Homo sapiens
cattatacgctggttgttgggcatttggtattctgtgtgtttcccacccttcctcatttttcctatgaattcttgatacagaaatggagatttgtaacacgctggtagtgtctagctagaatttctgggttccattccttcactttttagctgtttgcctttagagagttatttaacttctgtgttcctcagtcttgtcatctggattgttgtgggggttaaattaattcatatatgcaaagcacttacctggcacatagtaaacactaagtgctgttattagtgttcatacatattacatgaagctctaaaaattagaggttaattaagccatttatatagccaatag

SEQ ID NO: 398731 - DNA, 656 bp, Homo sapiens
ggacctaacagtcttacagtactgatgggagaataggttaatttaagcactcagaagagctattttgcaaagccaaataaagtcaaagaatacataaacacctggaaattctccttctggtgtgttctctagagaaatactcttctataaatgcacaaggaagcacataaaggaatgtttattctaacactgtttgtaatggtgaaaattgtaagcaactaaatatcaatcaaatgagattgtatgctattatatatttgcataatggaatattatacaatttctaatgttaatattatatgctacttatggatacataacgtatagtaaaattgtatattttcaagcatgttttaaacaccaagtcataataaaggttacctctgaggaagtacgtgaatggatggagggatacaaaaatgtagtgaggtaaacaaaatattgagttgataaattgagtggtggctacatggttattatgggcattcttttggaccctacacttgtttgtatatttgagattcttcatagtaagtaatttaaaaataaattaccaaacaagtttcattaaagattagtggactagagctatatgtatcaacatggacagatccctcacactgatgaagaagatgcagaagtatattcacatcgta

SEQ ID NO: 398732 - DNA, 341 bp, Homo sapiens
tccccaaaaaaaaaaaaaaaaaatctgcatgactgtaggcttaaaagaaaatgtgtccagtgtgtgagcgaggggcacagcacttggtaaatgctcaaggcacgttggctgtatgtatagccataggcaagaaagcccaggaaaaggtctgtgagccaatccagaattgggggctggggagctgggtctgggcaacaaggagccaggggcatgttgtgagcccagagacgtcaacaagctccatgaggactataatttttttgtttgctcactgctatagcttagtgtctggaacagtgcctgtatatagtgattgtccaataaattttggttgataaata

SEQ ID NO: 398733 - DNA, 3330 bp, Homo sapiens
  misc_feature (1808)..(1808): n is a, c, g, or t
  misc_feature (2609)..(2609): n is a, c, g, or t
gggcttggcttggagggggcaagggagggaaagagagaagggggaaacacaaaaaacttctttctttccccctccgtttatcttcagcccgacattgtcacctcctctttgaggggttagaagaagctgagatctcccgacagagctggaaatgcattgcactttgactatggaaacagacgctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaaaatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatacngcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagtttagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatntgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacacccaaaggaaagtcctgcacatttttctgtttccaaaatatttaactgtgtaagtccttgtcagaaatgaatctcaatcccttagtatagaattccccttacatggtataggttgccatatttcatgtgcagattttaatttcatttatgtgggcgctctgttttttctttgcagtccagccaca

SEQ ID NO: 398734 - DNA, 1542 bp, Homo sapiens
  misc_feature (821)..(821): n is a, c, g, or t
gtagccatggtgatagctgactctagaggatacacccgcgagacgacctttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagtttagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatntgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacacccaaaggaaagtcctgcacatttttctgtttccaaaatatttaactgtgtaagtccttgtcagaaatgaatctcaatcccttagtatagaattccccttacatggtataggttgccatatttcatgtgcagattttaatttcatttatgtgggcgctctgttttttctttgcagtccagccaca

SEQ ID NO: 398735 - DNA, 3793 bp, Homo sapiens
  misc_feature (3)..(3): n is a, c, g, or t
  misc_feature (6)..(6): n is a, c, g, or t
  misc_feature (158)..(158): n is a, c, g, or t
  misc_feature (403)..(403): n is a, c, g, or t
  misc_feature (596)..(596): n is a, c, g, or t
  misc_feature (663)..(663): n is a, c, g, or t
  misc_feature (2271)..(2271): n is a, c, g, or t
  misc_feature (3072)..(3072): n is a, c, g, or t
gtngantacaattcaatttttttgacccatctataggttaatcaaaacttggatggaatgttgatttctttaaacatgtccaaatcatgaaaacattttttcacactatgtttcattttcttcaaaattggtaacctattggttattaaatacatcanctgaattgtgcactgaattttcctacctttcatctcttgctttctcacttatttttgtgtctgccaagaggatccccttataaatgagactacatttttttgtacacagtgggactatcttatacaaatgaaaggatcagagtaaatcatttttacagggcatactgaacaagtaaagttattctaagaaatgaaagctttaggtttccaaacagtactggcacaagtgcaactggagaaagcancaataaacaacaagtaataagttatgttctttcctgagaacactgtttttaatcaactgattcgccttgtctgagttgttaccctatccttaattaaacatccttgggcagtatttctactcaaaaaacaactgttttaagttctttgtctgcactatgaatgtcagtgtctaagggctaacagattagtccntagcaacttagaaaaaagggatgaatagggaacagcattggagagtatatgtcaaatgaattagggnagtagtttagtgagccaatgtgccaatttagaaatggattcttcttcctgctgaagagctctttttaaaataaattacaatcataaagctgccacagtttactgtgcatagacatgttcagaattggctcttcttcatgagggctgcttggtgcaggtatttaagctactgccaataaggctaacagctcatcaaatagaaaatacgctgcaggaaaatacatgggttaagaaaaacagttaaataccgtgctgttattttgtatgtctgtttaagcttttctctcaaacaagttgacttacttaaattgttttttaaaaataaactctaaaagccttgaaaatagtgcagtcttaaaagtagtattgattttagtcaatgctaaaaacactttcaggggaataagatgagaaaccacatgaacaagtttgccaccaatagtggcaacagtgtatgtatgtcatggatttaagagagactcaaataaaaacaaatcctctggtgtatatgtgtgtgtgcaaatttaaagagtatactttcacactagagggtattctttctacttgcttctactgaagcatactagcttttataacacatatcgagatggcatatccagctttgtatcatccaaaatgttgaagaaattatcagattgcatttttctatggttttgtatagtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatacngcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagtttagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatntgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacacccaaaggaaagtcctgcacatttttctgtttccaaaatatttaactgtgtaagtccttgtcagaaatgaatctcaatcccttagtatagaattccccttacatggtataggttgccatatttcatgtgcagattttaatttcatttatgtgggcgctctgttttttctttgcagtccagccaca

SEQ ID NO: 398736 - DNA, 3399 bp, Homo sapiens
  misc_feature (1877)..(1877): n is a, c, g, or t
  misc_feature (2678)..(2678): n is a, c, g, or t
aaccctgctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagacgctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaaaatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatacngcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagtttagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatntgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacacccaaaggaaagtcctgcacatttttctgtttccaaaatatttaactgtgtaagtccttgtcagaaatgaatctcaatcccttagtatagaattccccttacatggtataggttgccatatttcatgtgcagattttaatttcatttatgtgggcgctctgttttttctttgcagtccagccaca

SEQ ID NO: 398737 - DNA, 218 bp, Homo sapiens
caaccccagagagcagtggctatcagtgcagactccagagtggtgctgtccaatagaaatactatgtaagcctaggagttacatttaaaaagtaaaaagagctgggtgtggtggcttttgcccatggtcccagttactcaggaggctgaggcgggagagttgcttgagcccaggggtttgagaccagcctgggcaacatagcgagaaccctgcctcta

SEQ ID NO: 398738 - DNA, 479 bp, Homo sapiens
ttgttgttgttgtagagacagggttttgccatgttgtccaggctagtcttgaactcctgggctcaagtcatctccccaccaaagtgctgggattacaggtgtgagccaccgtgtctgcctatgcctggctagtttttttttaatttctgtagagacgaggtctcactacgttacccaggctggtggcaaactcctgggctcaagccatcttcccacctccatctcccaaagcactgggatgagaggcgtgagccaccacgcccagactggttggagatattctctacacaatgagtgcagagccatagatgccttctaggggatctagctcgtgtgtgtgtgtgtctgagagagagagagagtgtgtgtgattgtgtgagtgtgtgtgtgtttgtgtgtgttgtaggggcacaggccttttccatggaggccttgttctggtctgacttgcatgccgtgtgccttgagcaagccacttc

SEQ ID NO: 398739 - DNA, 396 bp, Homo sapiens
aataccagaccacagcagtctgaaaatgcatcccttcttaattaccatttggtttggaacgagactgactcatctgtagccctggcagcagcaggtcctggttgggatggaggtgatgctgggtcactggacatgcctggaactctgcctcttcctgcctcactctggattgctgcttcattgggtcatttggactcaacaaagcaaaaatgctgtgaacgtgccattttacttaagaagcttgactttgagagagccaaagaagggatgcctacaaagaaatattcagtgtttcccattaccttggctttacttcaaaagaatcacacattctacccaaggctagcactatctgtgaaatcctgatatccctgatattaaaccatgagaaataag

SEQ ID NO: 398740 - DNA, 560 bp, Homo sapiens
tctcttgttttgttttacagtgccgtggacactgccagaatttgtcaaaggtcctaggaagaaaaggctctttcacccctcccctcaatgaacagatggcgtgtttggactgttcgcattcgctcctcataggtgggatcctggaggaagttaaggggtgctccgttccctggggatgggacagcagctcgcctttttactaatagctataagggactgtcagacatttacctgactagaccttcacctcagagctcagaaggggaacagctccagaactaaaagagagagcctctggcagaccccaaaagacagcatgtggagtgaagctgggcttccctgcccaatcactaggatcatttattgcacaaatacctgtattttaagctgcagattattgtgaatttttgtattttcttcatttccatttagctttttttcaattttagaatagcctttctctagataactcgaggaagtgggagacggaatttcctttgtttctgtcttgagcccaaagggacaattgagtgtcaggtatgacagggataaagggagaa

SEQ ID NO: 398741 - DNA, 221 bp, Homo sapiens
aaaacttagttacttaaacaacaatgcataattcgctctcagatttttgtagggtggctgggctcaactgggcagttcttgcttgatgtctcttgtgtgtttgcagtcagatgacatctgaggccaaagtcatctacagatttcactgggctgaacattccaaggtggcttctttactcacatgtctgacacttcagctgggttggcagaaacagtgggag

SEQ ID NO: 398742 - DNA, 639 bp, Homo sapiens
tctgtacatgtttctcttctctctctcctctctcctaatagaaggaggtcagtagaatatgatgagagatgtgggatgcccagcctattagtacagtgcagggagaaagaggatgaaaggggattattacaagctgtggaataaaggatggaaccaagagaaaatgtgttgaaactctcccaagttcttactgtggacaaaattctcacagcgaacagaatgatcatcatcaggtgcacgtttctgagtcagatgcactgcagtcctcagggacaaaggccccagttgcgggggcagctttctcctcttggaccctctaagtgctgctctgcaggaggactgtgggacaccagtccccgtggtcgtgggcagtgctggcgggttgagtggctgcaccagcaactgccacctactcttctttaggggcctggcagagtgtgtgagtgttggtggtggggaggtgggaggagtggtggctgaggggatctagactaacataatctttgatccttacagcagacgtccttggtggacggttcccattttggagaagatctgtgcactgctacccttctctcctggtctctctctcttttttctggatgtttgtttccaaaattctgctgcccatgccttctc

SEQ ID NO: 398743 - DNA, 429 bp, Homo sapiens
taaagccactgaaagactttttcccaagttcttactgtggacaaaattctcacagcgaacagaatgatcatcatcaggtgcacgtttctgagtcagatgcactgcagtcctcagggacaaaggccccagttgcgggggcagctttctcctcttggaccctctaagtgctgctctgcaggaggactgtgggacaccagtccccgtggtcgtgggcagtgctggcgggttgagtggctgcaccagcaactgccacctactcttctttaggggcctggcagagtgtgtgagtgttggtggtggggaggtgggaggagtggtggctgaggggatctagatggagaagatctgtgcactgctacccttctctcctggtctctctctcttttttctggatgtttgtttccaaaattctgctgcccatgccttctc

SEQ ID NO: 398744 - DNA, 472 bp, Homo sapiens
tggcggcagcatagatgacagccaggctggcttctcttggtgcagctggagatggaggttgtggagaggggaactctagagaggggtcttaagagggaagctcatggccctgttccattcccttgttggacagatgaagagactgaagtctcaaaggcagagtttgaagcaaaagccagatggcacaaccctcggtccatagctacagccatgcttttctctggggtttcctaccctgtttaggggtgctcgtagcatttaggcttgcaaccaaggaagctaaatgtcctctaccacaaggaaccgttgcaccccaaatgctagtacttatggagaaacacggccctaacgtgattttaagttgacacatgggccttggaatgggttttccattttcttgagtttctcctctgggccagggacttaactctgacaggatatgctctttactgaaccatgccaggcctcagtg

SEQ ID NO: 398745 - DNA, 466 bp, Homo sapiens
tcgagtgttgcagtgcttttctgatggctcatgtgatctttggcttgggctgcatttcagatactctgagtatttgaaccctgggccaggcagttggcaggtggttgcgtgatctgatcttagaggacattgctttggaatgcattgatttgaggtgcgttagtatgcactctgtgtgcccacaggttgcacctccttgcagggttgttcctggggaattgccagaccagcagtttgggaggcctaagtgggagaatcgcatgaagccaggagtttgagaccagcctgtgcaacaaagcgagaccccccccaagttctacaaacaattttaaaaattagtccaggcatggtggctcatgcctgtggtcctagcgctttgggaggcttaggtgggtggatcacttgaggtcgggtgttttagaccagcctggccggcacggtggagcctcgtctcttttaaaaataa

SEQ ID NO: 398746 - DNA, 193 bp, Homo sapiens
tttttttttattttgtagagaagaggtcttactgtgtttcctagtctggtctcaaattcctgggctcaagctttcctcccaccttggcctcccaaagtgctaggattataggtgtgcccaccaccacacgcccagtgcttgtttttcttagagatatggttatcatgctttttctaccctttctgtgatttta

SEQ ID NO: 398747 - DNA, 328 bp, Homo sapiens
gacgttgttaaaggggggcagattttgcctctagctgccagttctgctttctatttcactgactatcccaggacctaaattgcttggctatgtaattactagagtataagcctatttaacttaaaagctttcttttttttttttttttttccaactctaaatgaaacttgatgagggcccgtccttagttatcaggggagtcagtttctggtcagtcttcttgattcatctcttttagatttaatcagcattaaggtattgcttgtccttaagagctttagctaatggggttactggatgcttttctcagtgtaatgtttccttttca

SEQ ID NO: 398748 - DNA, 505 bp, Homo sapiens
atgaacatgcataaaaaccgtagaagatgtaatgcagtatagtaactgtttacctttgaattctggtaaagtatgagtcattttcttcaatatctatgttctaaatgtaaagtttttagcagatatgctatgcaattctttaagctgatgaaaggaaatgcctttgacttctttattattggtactcttggttcaaaaggtcagtattcattacattcagatctattatttactctccccatttccatctttcccattcatccctctatacaatggcttccacacaaaacactgcaccatacttcctttttgacatagtaattaaagaccaactggtaaagctattttcttttttgtcatacctttacttcgtaatctttctggaaactcactgtttccttgagttgcatggaattcaaccagtatctttatcaaattcttcccagactcattctctatgtgcttcacgttgaaagcttcaacacccgcagactccctctttgcc

SEQ ID NO: 398749 - DNA, 430 bp, Homo sapiens
  misc_feature (430)..(430): n is a, c, g, or t
cgcccctgcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatggtaattctgctcatcgagctgaagttcgggccttagccctgtn

SEQ ID NO: 398750 - DNA, 399 bp, Homo sapiens
gctcttctgtcctgcagctgaggcacccggggctggtggtacagccagagtaggagttttcagaagatcccagagggaatgtaggtgctgccatctcaggttctttatgtaacctggctatgtgtaaatttcctcattggtaagacagggataattctccctttgtgaattcagtgtctgttgtagaggtcctgtctaatggcatgacccccactggggtaggggtaggtaggagccatgtccctttcaagtgctggtgctacaattcttgctttgcatgcattctagtttcacaaaacttctgcatgctgggtatgcctttccctgcttcctctgccattttcagataagttaaatgccttatgcaagtcacccagctcgttaagtggcatggctaac

SEQ ID NO: 398751 - DNA, 494 bp, Homo sapiens
gagaaataagaatatatatttacatttgcttgtatttgataaagaaacattgggaagaggctgggtgtggtagtgtgcacctgtagtcccagcaccttaagaggctgaagtgggaggattacttgaggccaggggttccagaccagcctgggcagcatagggagactccatttcaaaaattaaataaataaataaattagtaaaataaacactgggatgacaagacactaaaagtcattatttatagaaagagggagtgagtcagggttggggtgagggtgagacttgtcatggtaaacattaatactgtcttaatttttcaaccatataagtaagtgtttatctattcaaaacaattatatgatgggcttaaaaatcatagagataagaaaataaaatcacctagaatcccacaacccacagcttacactgataacattttaaagtacatccatttagaatgtagccatgcagattcaggtacatgtacattt

SEQ ID NO: 398752 - DNA, 907 bp, Homo sapiens
acagcacttggcccggggtctcctgctcgcctcccttcagagcatctgccaaacttcgggcatctaccctgcaattcccgcttggctgagaggagggggagaaggaggggaagagagaggagccccacttcactccggcaggcagacctgctggagctgctttgcagaatgacttgggtcttgctggcccctgggtgtgcctggaggggggtcttcctatccccctccacctctccccttggtgcctaacccaggactttgtccccagagacccactgtgtgccccctggagctcctcctagagcagagtctgctgctgtctgttctgcagagggtagcctgaggcccaaggaggttgtcagggacacagagcagggggaggcagcccagatccctgctcatgcgtggtttgggcctctgctaacagctgggccacatgcgtgtatctagagcctgggtcccctctgtcctcatttccctgtgcatattcagggacatgcctcgtcagggtttggcaagaaaatggggcatttaataatctccccagtttcattccttggtccttactccatgccaggacttgtgcacatctttttggagccctgtctcacttgattgacagccggccaggcgcggtggctcacgcctgtaatcccagcactttgggaggacgaggcaggcggatcatgaggtcaggagatggagaccatcctggctaacacggtgaaaccccgtctctactaaaagtacaaaaaaaatagccgggcctggtggcgggcgcctgtagtcccagctacttggtaggctgaggcaggagaatggcgggaacccgggaggcagaggttgcagtgagctgagatcacgccactgcactccagcctgggcgacagagcgagactccgtctca

SEQ ID NO: 398753 - DNA, 575 bp, Homo sapiens
gactgtgcctctagtgcattcctagttgatgagggaacattatacaagaatgccactcaacaagtgtagagtgatagaattagaaaattgtcattttgcaaacattgatgagacaatggattcaggcaacgatcaccgttggttactttttaccaggtaaaaagttgttggcaatcaaaatatccatgtgctgccagtgtcagtccacagattaattgcaataggaaaaactacctttatattgggaagatctggtgacctcaaatgagtgatccattgataatgagtcaacctgatattaatgagacttttgatatgatgcactatgaaatacatctgtgaggtgttatcattaaaaatgtttaaacaacccaatcaagccttttgccctaacttctaatttatggaaactacagggggtaccggaacaacccacatgtaaataatcagttgaatcctgaacatgagacatttttcaagacaactgacctgctctcttaaagaggaaaaactgtccgggcgcggtggttcacgcctgtaatgccagtactttgggaggctgaggcgggtggatc

SEQ ID NO: 398754 - DNA, 451 bp, Homo sapiens
actgtgttccatgctggccaatttcaccctacttgcttctgtggcaattggaacatggtctctggccttctgtttggaaactgcaactagttagcctccatttccaaggtttctttccttctctctgggcagcacactgggcaaagttgcccaaaacaggatgcctaactctaagtactactttctctgcattgcctgtgaggacagactactctttttactgtggaataaattctattctatttgacaaatatatctcattttgattccatgcagaaatgccctcattttctcccctctgctcccttcaaccaaccaagatcagccttgaaatttgcaggacattaacagggatcctaatctgtcatggaaaggagagaaaattaagacatgctatttcatatctttttatttctaagagaaattaaaggacttacatcttttcccaaaa

SEQ ID NO: 398755 - DNA, 531 bp, Homo sapiens
ttcctctttcctcactacccaaactaatccttaaggctccattttccctggcgactcttcgagcgcccctctgcttctgtagaggggtcgagccatgtcaaggtagaccctgtgtcggcccgtctccctcggatcctccgcaccaatcactgttgctgaatccgacacccggcggatccagtgcggagtctcgaacagctgcggagctgggagctacgggacatgaagagagcggggtggaagagaagacggcggaggaaaatcccccggcgatgctcaactgcggctttctctctcggctgtgagccggctccgccctccagcttccagagccggtggcttctgcgttcaccgccccgcgccgtttgcggggcggggctgattcataagaatcggttctcaccaatggagggcttagcttgtttaacctcaggatcataaacaaaagacactgctagaacggtcgggaaagtcatacgctttgcttatcttatatatagatatctaaaactccaaaccgggtacgcgttg

SEQ ID NO: 398756 - DNA, 131 bp, Homo sapiens
cgatgatggattgtcactcaagggaaccattatatttccatacgtagagaagttcctttgccaatcacaacaaaatgatacaataaccgttaatacagaaagaatgagtatgcctctacctgctcttatct

SEQ ID NO: 398757 - DNA, 426 bp, Homo sapiens
ctgagattacgggcatgagccagggcacccagcccctttgcctttatcttataaggacatctgtccttgaattcaggaaccaccatatgcaggatgatctcaagatccttaattgctaagtgagggcttagtgcctagggtgagggcaagggcagttctctaaagaactgccattggcctttaggataaaacatcagttgtaccagaccatcccaagcattgaaggattttaaagttcctggtctacactcattaatgccaatagccctctaaccctaatatgacaattaaaaaaaatgcccccatacactttcacatccctttcccagcaggaggaggaatgcttgtcttaagaaagaaaggatatttagaacatatattgccttacttctccatgctaatggaaggcataatgtcatacagaaa

SEQ ID NO: 398758 - DNA, 296 bp, Homo sapiens
tttctgatgtttgctagtagcttttataccccactcttctcatttcccattttgccccacatctgggcaagctgataagaaagcctgggttcttctgttggcactgagattccaaccatgtgggcccccgcctgtgtgcaggaaccctcaccccagccccactccccaacgcctaagaaaacttcaagtcagttttctttccctgctctcttacgctgtttttggacctgtttgggaagctttcccagctgtctccagaaaacctcattatgtgcgtaataaaccttttcacactc

SEQ ID NO: 398759 - DNA, 414 bp, Homo sapiens
  misc_feature (50)..(50): n is a, c, g, or t
  misc_feature (61)..(61): n is a, c, g, or t
agccagcctgtccaacgtagtgaaagtccgtctctattaaaaaataatancggcgggggancagtggctcacgcctgtaatccaagcactctggggccaaggaccctggtcacaccttggccccagagttactctatcccttcactttctttcttttatagcacttatcaccatctgtattagcacatttgcttaccagatttagttgtttattgaatagaaatgagggcatgaactctgtccatcttgttcactgctatggcatcagtgcttaacatactatacctggcacattgtaggcacacatatttattgattttatgaataaataaaaataggtagtaatgtatgtacgaaatattgctttgtaaagataagagtttataatatacacgttagtcttgggcctccaat

SEQ ID NO: 398760 - DNA, 530 bp, Homo sapiens
cagcttgttcacccttcttctgtgtatgggcatttgggctcctggtttgggaccattatgtgtaaggatgtcatgaatatttatttatgtatgtagcctgtgagcttgccttcatttctcatggttcattcctaggagtgcagtggccacatcatgtcatggtaggtctgcatcgaccttgttaaggaatcactgtcccttgtgctaagtgtttggtccattgcctgctttctctcttgctccctctgatttagtcatacaaacctcttgtatccttcaccctccagggcaataacttcttagcataccgcctttctttacacttggaatcaccagctccttctttatgtgctggctctgattccctcactaaatttgccctttgtgccccatgtgtgacccattcccattgatacaccctatgtatgagagggctttgggataagagactgtttctgatgagtatcgagtactacaatggctctgaatggaagaaagatgactgggtgggtcttgtcaaccattgtccc

SEQ ID NO: 398761 - DNA, 508 bp, Homo sapiens
ggcaggaatgattatataagacttagggccaaagagagcctgggtgactgtgtaggggtattaggctatgcccagcaccacatctggttgtcattcaggggagcagctagggctggaactgctggggagtgcaaactgcagtattccctgttcccttgtctcagagcagaattgtggcctctatccaggtccaatcccagttaaaaaaaaaaattccaatggtctattcttcttttgagctatattattgtagagaatactgacttgaaaaaacaaagtcactaactagaaataaaatttgaactgggtgcagtggcttataactgtaatcccagcacttttgggaggccaaggtgggaggatcacttgagctcaggagttcaagatcagcctgggcaacatggcaaaatcccatctctacaaaaaatacaaaaattagctgaagtgtggtggtgtgcacctgtagttccagctacttgggaggctgaagtgggaggatggcttgagc

SEQ ID NO: 398762 - DNA, 526 bp, Homo sapiens
gagcagttggtttcgttgtcttaatttggggcagtaatgatttctgagaagcaggtgattgataacgcgcaaattcaaagccccttgggggctgcattgtagcatggtgtggggatggggagacagagggctggtaggatcccgaattcctagtttttctctccctctcccttgcttcttcattttcttccttcaggctttcttccatttctttcttccatcaaatatttgtggagctggaactgggcttcactatcatattccaaggccctgtactgggaacagacaaagaagctcctcccagagactggaagaatggtacaaggtgtgaaaaccaaggcttaaagcatgcaagttatttgcccgaggtttttcagccacaaatgaagaagctgggtctgctccacacctgtgaaccaggctatttccaccataacctgaactcagatgagcaccagcccatggagaatagtccagaaggctgcccatagccttaaaggacagtgtgagcattaatcacagcctg

SEQ ID NO: 398763 - DNA, 404 bp, Homo sapiens
agaagcaacgagacaggtcaggatatgaaagagttggccccaacaaggcaggtgtctccagggggaatgcagaaaggaaatattgccaaagaaattaaagaagtcttaaatattatttccaaagagtgaaacgaaaaattttaggaaaagagaatcagaagacacaggcatatatgcatgtgcctggtgtatgatacgtgtagcacaggatggaagcagagagcagatcttagtcttaacacccttgaggagactgactctgcacctcagacagtcacatatcctaaagttcagaaggagctgggtagtgcattttcagaatttagaagtagtaaaggtaatgaaacaactttttttttttttagatgagtcttgctctgttgtccaggctggactgcagtggc

SEQ ID NO: 398764 - DNA, 930 bp, Homo sapiens
  misc_feature (658)..(659): n is a, c, g, or t
  misc_feature (672)..(672): n is a, c, g, or t
  misc_feature (680)..(680): n is a, c, g, or t
  misc_feature (683)..(684): n is a, c, g, or t
  misc_feature (741)..(741): n is a, c, g, or t
  misc_feature (744)..(744): n is a, c, g, or t
  misc_feature (746)..(746): n is a, c, g, or t
  misc_feature (753)..(753): n is a, c, g, or t
  misc_feature (758)..(758): n is a, c, g, or t
  misc_feature (762)..(762): n is a, c, g, or t
  misc_feature (765)..(765): n is a, c, g, or t
  misc_feature (772)..(772): n is a, c, g, or t
ctctggccctacttatcagttagtgtcatttaagctatttcttgttcagaaaacaggtcccatgatggacatgtattatgtaatggatggaagtagacatggctctcaataattcatttatggaggaagagaagctgtcagaaagtgggatttaagcagtgactttcccaaggcttgcctagtttatttgggaaaatagccagagaagtgctttcttgtaacccaaaagagaaatatacagataagaatttcagtagttgcagatcgttgctttttctaagtgcctacttaatgagcagattattgtcttccagcaaatacttctactttatagagaggtatgggaaacaggacataataggtattaagtgagaaagtgtgtgttccaatttttaattataaataaaagatttaattaactgtattcagttaattcatttggtaaagtgaacagttttgactttggattagttagaaggaaaacaaaattgacatatctagttttcgcttttaaattatacatagacttaattaattgggacaaatgtgaactaagatactgggtaaaacttgtgtgtactcctaaaatgacatttgcatggctggtagtaagctgtgattcttgtccttgtaggaatgaaatcacataattgggganngtcttaaggtaanagtaagcnatnncgttagcatttcttgtgctgaaattatgcctacattttatttttcaaaaaatgtggntgnantcattantgtgntatnctngttggcnacgaggggtttttccttcattactgggtctgataagtttgccggctgttatcacaattatatggctgctggcagtttaggattgtgttgaactggttgccagggaagcggcaaagctggaaaaaacgccaatctcgtggacaagccgcggagatggat

SEQ ID NO: 398765 - DNA, 469 bp, Homo sapiens
gaagtcatgtattttaaagccttcaggaaactgtgagtgtaaggcatggttatctcaccttgcaggaaggtcttgaatccattccaatagcctttattggatgagtggtttctggtgttgatttgtgtgcttgaaaacacttattttgtttatttgaccctaccactccgatagtacaggctacacttattttcctggaagattaagaaaaatttggcggtgagctatgcaaggggaagtaaacaaagtcacgagacacagacagaaaacttcatttccattcaatctctgaccccaagaaaaagtcactttggggagatacataaagttttaaaaattaaagtgcaattaattgtagttaagttttaaaaaattaaatctgggttccgctggcacatgaatagagcaatgaaatggaataggaaatcaagaagtagacccaaatacatacagggatttagcatatgat

SEQ ID NO: 398766 - DNA, 494 bp, Homo sapiens
agggacttgtatccaaaatatgtaaagaacacctataaattaagaataggaagacaacccaatataaagtgggcagaagattatacagatactttaccaaatatgcaaatggccagtaagcacatgttcaacatcattagctgttagggaaaatgcaaattaaaaccacaatttgctactgcacattcctggaataactaaaatgaaaaagtctgagaatacgaagtgatggtgagaatgtggagcaactcgaatgcccatatattgcttgtggggttgcaaaatggtacaaccactttgaaaaacagtctggcaatttctcatgaagttaaacatgtacttaccatatatcccagtaattctatttctggatatttgcctaatataaaaacatttgtctacagaaagacctgagtgtcatagcagctgaatgctcaataagctgaatgtttatggcaactttattcataacaataaaaaaaaacttgaaacaa

SEQ ID NO: 398767 - DNA, 172 bp, Homo sapiens
ctcacccttccattctccctcaaggatcacctcctcagaaatgccctggctgaccacctggctcaagcagcacccatcacccattacccattattttactgtcacctgaaattctctgtctttactcactgtctgggtctgagttatcaaatacaagaaccactagtggctg

SEQ ID NO: 398768 - DNA, 358 bp, Homo sapiens
tgctggctggggcaaaaggcccttgaaagggaccctaaggcctctaggctttcatatgtacttcccctagggctggaatgccctccaccacacccttcaaaccactctccctcctcagaaagataagcaggggaccctggtgggagaggagaaagaaatgaggcacagggaaagggggcttccatccaggatggaaagacaacctgatgaggacaggagcaaatgccacacacattccttggactctgttcacatttggccacagagaaaagcatgttattcctggtacaggttgagtatcccttatgcaaaatgctcagaaccaaaggtatttcagagttcatatttttttcgattt

SEQ ID NO: 398769 - DNA, 469 bp, Homo sapiens
aagcgcgtcatcaccgaggctctcacagctcccaggaccttatgagcccataaagggaagcggacacgaaggcggccgagaaatgatactttaagtaaaatgcctatgagtccatcactaaagggaaaatcatttccatggaggcctgtgtcatagtttatccaggattttaaagagatgctgctactctgcaggtgtctaatgtcttaggatggcaaaagagagaagcctgaaatatttatatgaatagaatatgaaacttaactaatggtgcccgcttcgattacgtgcattttcacattgctactaacctgaaagccgccctcaatattttataggctaccatttcccgcctgggctacacgaggcctctgggttcttttacgaacattgtctgtcatttattatgtgatagatgcataattgtaaattacacggaaagccaaaataaaaacatgtttacgtttta

SEQ ID NO: 398770 - DNA, 449 bp, Homo sapiens
atgtgttccgaaggggaggcctctgaaatggctgctttaggaacgtctgtcttttacagttgtagataagggatgaaaaaagtcccggtctcccgttgcgctcccaggcttattaggaagaggaaattccctcctaataaattttggtcagaccggttgtctgctctcaaaccctgtcccctgataagatgtcatcaatgacaatgtgtgcctgaaacttcattagcaattttaatttcaccccgtcctgtgatcttgccctgcctccatttgccttgtgatattttattaccttgtgaagcatgtgatctctctgacccccaccctattcatacactccctccccttttgaaaatcactaataaaaacttgctggttttgtggcttagggggcatcacggaacctgccaacatgtgatgtcttccctggacacctagctttaaaattt

SEQ ID NO: 398771 - DNA, 344 bp, Homo sapiens
cttgtgatgacttctgcccctcttaaacatacataattttatctttaacactagactgacgactctccttcctccctcataccaatcaaagaataaaatcttaatttcattttcttggacaaaaagacccaaaataatcaatctccacgaagaggagtagttttaaaaacaggttctcaaaaagttttttttttaataaggcttaaattaagagctcctattctcacgtactcaacagaaaactaatcaatgagacaggcagcaaaggccagaaatgtggaatgtgtgtgtttttggtgggtttatgtgtacgtgtgttgtttttttttttgggggggggcgcg

SEQ ID NO: 398772 - DNA, 522 bp, Homo sapiens
agggctttatttatcaaaccccatggctcagctcttacgtcaccttctctgtgaactctcctcactgcctcattcagaatcacttcttccccctcagtatgaacagcactttgttcacgcccttgttacatcactcgatgcgcaaaggtttgtctctctctaagctaagagctgattgagagcacccttgtgtctttaggctgggccaaggctggcacacagtagatacttagtgtatatttgctaaatgaatacatccctaccctctgctaattgtgcagcatttccttgcatcctgttgatgactgagccttgtttgctttttcctctttttgtttagtctagagggatgatactaaggatagtttatgggagctaatttgaagaacaggaatagacttgataggtgcaacaataagatattattgaaactgcccaaggattatcattatgccaaactattttccttattacttttaactccacttgcagagtgttcaggaggattgttattcaaaaaaa

SEQ ID NO: 398773 - DNA, 291 bp, Homo sapiens
agagcagccattgttctctgcagacagacacattctctcacatgtccccggggccacagacctctttatgttctaactgggtctgcacagaagaggcaggagacaggctttagcctcaagggagggagagagaggcaagaggccacagtccccaagttaggaggccacaaggaaagaaaaggacttctgtgaagaaaagagtcccgtctgagttgcagtccacttgcctggggccactggaggagatggggctggggaggggccgctgcagggaggagggcgggggtcagc

SEQ ID NO: 398774 - DNA, 219 bp, Homo sapiens
tggtgacaggatgatttttaatgttttggcccatgccaaatattttttgaaagttggcatactagtatctataagaaaatatcaaaatagcccacctgtagtgacaactacttgggaggctgaggcaggaggatcacctgagcccaggaggttgaggctgcaataagccgtgattgtgccactgcactccagcctgggggatagaatgacaccctgtct

SEQ ID NO: 398775 - DNA, 460 bp, Homo sapiens
cctgagttcatcaaatgcatctagcaaagagacgtataaaggcaggagactcaaactatctgctacccatgtctgactgccagactgactataaaacacaaacttcatattgaacagctttgtcacgttcacctgcagacgctgttgccccagttttcctctttcccaccccgcactgcacacgctcttctccctctccttaccatcacacacatgcagtttctagccctgtttttagctctgcagtcagcacttgcctcataggtgtgagagaatcaattgaagtggaactgaagaacagccttctagatagtaaacatgtaattgttcatttcacattgcctccccagagtcctagggggataaagttttaaaattacatatttttatttatgagttacttatgtgaatattcctgtttaatgtgatacacatagggaataaagaatgcttgaacaca

SEQ ID NO: 398776 - DNA, 483 bp, Homo sapiens
atggagaaagagaaggaggttaggcaggaggaagaggttacagctcatgttgtgcatggcagggaagcaataaatattgcttaagaggaaaggtaatatataaaggtgtcattataaaaataactatcagaaaaataaaacagcatttaaatagcagaagaatgacagaaacaacagcaacgaaaagcagaattaaacttcttaattattaactgcaacagacatacagaaaaacacataaaatacgaattacagaataatcaataatgataaagcacatacgtattaagcactacccaagtcaggaaatacaacattactagcattccttcctgatcataatctcttcccctatacagatagccactatcctgacttttatagtaattacatgctttttttggtttacagttttacaatctatgtatgcatttctagttttgcctacttttggactttatataatataatcatactgtattt

SEQ ID NO: 398777 - DNA, 236 bp, Homo sapiens
cgatcttaggtgatccgcccgcctccgccttgcaaagtgctgcgattacaggcgtgagccaccgcgcccagccagggcttttacatttaacatcttgtagcttcctgctgagcggcgaacagcccgtgcagactttatcatgagcatctttcttcttccccaaggaggcactcacacgtgtttggtgaattactatttccactggtcaaggcgcacatgcggtaaaatgtctgcac

SEQ ID NO: 398778 - DNA, 408 bp, Homo sapiens
ctaaaaacagactaaccctgcccagagaggaggtggccggctggtgctcagggagggcggaagtctgggtgctaaacactcttacctctcaccacttcctctctgagcagactctgcaggtgtggggcagcatacctgtggctccctgctccccctaggctccccccagacaaattcttgggctccttctggtgtggggctcaggctgggccctggagatgtggcccccacccctgcagggccctccagtgaggggaggtgcgcaaatccaatcagtgctatggccacaggccctaaggaggtgatgctgggctcggttctggggcatgagtaggattagcaggtggcgggtgggagaagagcagcctgcggcagaggcacggcaagggcgagcgtgctgagcgggaa

SEQ ID NO: 398779 - DNA, 612 bp, Homo sapiens
cacacacacagactaactttcagatttaggagtaaagggaagactgtgttattttatgccagacatttcaagagatttatgtcggagcctggaattgaaatagagtactctgtcaaagtagtcagcttttgtgtaggctttctctttatcttcctctcattatgtgaatttcattctttcagtgattatattgtatatgtgtaaaatcactccaatacttgaaaactgagtttgacttttaaagtgtgtgtgtgtatatatgtttgtgttccagtatatatttgttaagagcatgtaatgccagactctgtcctgtttagctgctggactggtggatcggttcggtgaggatgtgagtatctcctgggtgccaggtctgtcctggatagcgagaatgctggaggtgtcatgtgcctgtatcgcagaaaggcgtggggtgagccctaagctgcctgttgacaaggtagaagactgtgacctggatcactggtacccagattccagccagggcctggtatcagatttggatgaagtttttaccagcccttggtcaaagtgagaaaattaagaaaagtgcagttttctttaataaagataaatttatttgattta

SEQ ID NO: 398780 - DNA, 958 bp, Homo sapiens
ctgacacgacaacaaccatcacgtcccaacgagcgaacacaaaacaaactttgatccaacttgaatgcttcctgattaaatatatacaggagtgatttcagaggaatttaagttttggatcattcttttgagaaagaaagaaaagtacccttttaaaagaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaataattgaacaaaggagagaattgtgagagtgagaaaaagtgagacaaagaagaaaaactataaatcagcaaaatacagtgccaagagctctggaccacaaatcagaagacctgagccctaattcctttccagtcattggatttgttcgtcgcttgccaaaatagcagcgaactctctgtcaaactgcaactcattttatcggagcaaaaactgaacaaagaactgctatcatttctgaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactct

SEQ ID NO: 398781 - DNA, 957 bp, Homo sapiens
ataagagatagtcgtgacacagacggacatcgcaacccgccgacacatcactatccaacttgaatgcttcctgattaaatatatacaggagtgatttcagaggaatttaagttttggatcattcttttgagaaagaaagaaaagtacccttttaaaagaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaataattgaacaaaggagagaattgtgagagtgagaaaaagtgagacaaagaagaaaaactataaatcagcaaaatacagtgccaagagctctggaccacaaatcagaagacctgagccctaattcctttccagtcattggatttgttcgtcgcttgccaaaatagcagcgaactctctgtcaaactgcaactcattttatcggagcaaaaactgaacaaagaactgctatcatttctgaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactct

SEQ ID NO: 398782 - DNA, 1073 bp, Homo sapiens
  misc_feature (50)..(50): n is a, c, g, or t
  misc_feature (56)..(56): n is a, c, g, or t
gaaattgtaaaactcgacgattatcattaatcaatcatcaaacccccgcntttatngagagattatttgaggacaccaagaggtgaccatcagcaagcccaggagagaggcctcagaagaaaccagacctgctgattccttgatcttgaacttctagcctccggaactatccaacttgaatgcttcctgattaaatatatacaggagtgatttcagaggaatttaagttttggatcattcttttgagaaagaaagaaaagtacccttttaaaagaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaataattgaacaaaggagagaattgtgagagtgagaaaaagtgagacaaagaagaaaaactataaatcagcaaaatacagtgccaagagctctggaccacaaatcagaagacctgagccctaattcctttccagtcattggatttgttcgtcgcttgccaaaatagcagcgaactctctgtcaaactgcaactcattttatcggagcaaaaactgaacaaagaactgctatcatttctgaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactct

SEQ ID NO: 398783 - DNA, 965 bp, Homo sapiens
tgtagttgcggtcgctccctctccttcaacaacactcgaagaccggtatatatattcacagagaaaggattatttgaggacaccaagaggtgaccatcagcaagcccaggagagaggcctcagaagaaaccagacctgctgattccttgatcttgaacttctagcctccggaactatccaacttgaatgcttcctgattaaatatatacaggagtgatttcagaggaatttaagttttggatcattcttttgagaaagaaagaaaagtacccttttaaaagagcgtactttcaacataaagacgacgaggataaaggcatttatgatgaactacttccacataatgaataattgaacaaaggagagaattgtgagagtgagaaaaagtgagacaaagaagaaaaactataaatcagcaaaatacagtgccaagagctctggaccacaaatcagaagacctgagccctaattcctttccagtcattggatttgttcgtcgcttgccaaaatagcagcgaactctctgtcaaactgcaactcattttatcggagcaaaaactgaacaaagaactgctatcatttctgaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactct

SEQ ID NO: 398784 - DNA, 979 bp, Homo sapiens
tgtagttgcggtcgctccctctccttcaacaacactcgaagaccggtatatatattcacagagaaaggattatttgaggacaccaagaggtgaccatcagcaagcccaggagagaggcctcagaagaaaccagacctgctgattccttgatcttgaacttctagcctccggaactatccaacttgaatgcttcctgattaaatatatacaggagtgatttcagaggaatttaagttttggatcattcttttgagaaagaaagaaaagtacccttttaaaagaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaataattgaacaaaggagagaattgtgagagtgagaaaaagtgagacaaagaagaaaaactataaatcagcaaaatacagtgccaagagctctggaccacaaatcagaagacctgagccctaattcctttccagtcattggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactct

SEQ ID NO: 398785 - DNA, 732 bp, Homo sapiens
tgtagttgcggtcgctccctctccttcaacaacactcgaagaccggtatatatattcacagagaaaggattatttgaggacaccaagaggtgaccatcagcaagcccaggagagaggcctcagaagaaaccagacctgctgattccttgatcttgaacttctagcctccggaactatccaacttgaatgcttcctgattaaatatatacaggagtgatttcagaggaatttaagttttggatcattcttttgagaaagaaagaaaagtacccttttaaaagagactttcttctgccactgccactcctgagacaacatgaccaatctctccccttcctcctcctcagcgtactttcaacataaagacgacgaggataaaggcatttatgatgaactacttccacataatgaataattgaacaaaggagagaattgtgagagtgagaaaaagtgagacaaagaagaaaaactataaatcagcaaaatacagtgccaagagctctggaccacaaatcagaagacctgagccctaattcctttccagtcattggatttgttcgtcgcttgccaaaatagcagcgaactctctgtcaaactgcctgcctcactttccctttccctggagccaggaagagagcctttaccaaaaactgaaccctgctgataccttcatcttggaccttccagcctctaaaactgttaatgttaataaacttccaagaaacaaatata

SEQ ID NO: 398786 - DNA, 859 bp, Homo sapiens
tgtagttgcggtcgctccctctccttcaacaacactcgaagaccggtatatatattcacagagaaaggattatttgaggacaccaagaggtgaccatcagcaagcccaggagagaggcctcagaagaaaccagacctgctgattccttgatcttgaacttctagcctccggaactatccaacttgaatgcttcctgattaaatatatacaggagtgatttcagaggaatttaagttttggatcattcttttgagaaagaaagaaaagtacccttttaaaagagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttccta

SEQ ID NO: 398787 - DNA, 1049 bp, Homo sapiens
ttttaacagtggcccgggagttacagaccctgtcaggcaaatttgcctaggcatgtcaaaccctctatcacagaagaagagttctgcctgaaagatatcacataagctgccaatccaagataactcccatctccccctatttgaatgtgatctttttaaatgacaataataataataataatttgccagcaagcctgcctggaagacttgcagtttaaaatctggtcatctggcgtttactgtgcctaaatataaatgatgtgggacaagcccaggtactgagtttcctcttagaatttggccaacgcaatttgaccacgatatccgtggaaaaaaacgttgtgcatccgttaatctaacctatttagtgtttactctgcaagctaaagtatcaggggtatggacatacctgccctcggtctcggtgagccagcaatgttcagcggtgtgttcatgcccaggcaagcgtagacgcactctacgcttaccagtgtgaacggtgttgcagtctagaatactcccccagcttggggccggccctcgcctttctaccgtgcctgcgccgtcgcctaccactttcttcctgtggtttctaccccattttgcagattgctgcgtatcccagtgtcggcgatggataaacaggtctcgtctcttcccagttgcagcccgtgagctggtggcacaacggattaatgaggcaacagggctctagatggtgagtgggatcaatgagacccaattgagctgttagcggtcttaggcggagagcatctctcaggaggaaaggaaggcacagcgagaagacctaaggccgaaagtcgctgtgcagcacccacccaaggctggactcgggggaggtagacgggacggtgtctgtgactaaacggttcccacaccttacacgccgcaccgggattatgttttgaaaggtgtcttataaaatcaagaccggttcctaacaacctgcaagtgccagtgaatcccgaaatgtttgtttgaggagagggagtgtgagggaaggagcagaaaaaagaaagagggggagg

SEQ ID NO: 398788 - DNA, 234 bp, Homo sapiens
ctggtatctgtacttttgggtactctttacccacataaacttgggtttagccatgtgattttctttgctcaatgagacaaaagcaaacactagaggaagagattttaaccatgtctgctcttggggtccccctttctttctgtgattataatccttagtgaccactaagtgaacaagactgtgctaatctgagggagaatgaggggccatgtggagaactgaggtgcttcagcc

SEQ ID NO: 398789 - DNA, 266 bp, Homo sapiens
gagatgctgggggttaggatttcaacacaggaatttggaggaatacaattcaatcaggcttatggacaattctggtcttaagtcaagagtagtgttctccagtctgtatgtggaggcgcacacctatggtcccagccacttgggaggctgaggccagagaattgtgtgagcccaggaggagttccataccagcctgggcaacatagcaagacctcctctcaaaaacagacaaaaaaagtggtgttccagagtgattagtttgcttt

SEQ ID NO: 398790 - DNA, 327 bp, Homo sapiens
gtagagaagggtgtgcaaggtgtgtctttccatgtatttttaccctcatttaaatctccctttttataaataacctgttccctgtccaagctatattcatttctgtttcaagcacatgaaaatggatacttaattaaaatgaagtaaaattctgcctaattaagtttggtgattaggttgtgaatttgtctgtgttcttgaataaatgatttagtaaagaaatgatttgtattatctgtaaagagaattagccaagaggaaaggaattctatttgaagaatgtagtagccaggtgatatagctgatatgagaaactacatgtggatt

SEQ ID NO: 398791 - DNA, 324 bp, Homo sapiens
tttggagaatctccttccatcactgtaatctggggggggcctatcagtcaaggaaccctgtcctgctctggacaactgggggccaagggacaatggtactctctccctggaatcttgagcataatggtgcagagacctaaaacagctggaaccaattcaccaatagtagtaagcctccatcgttccacttacccaggccccagaacatccttggttagggctttctaagctttcccttaaattctgtgaactgctctatttccttctaataatttcctcatctgcttagtttagctggagtcattctctgttgtttataaccaa

SEQ ID NO: 398792 - DNA, 327 bp, Homo sapiens
catagccacatgtagcaagtgggacacatagcaagtcccagatttcacataaattttataaaaactgatggccctcatcttcttcatcagcaatatagggaaaataattcctacctctttggaatggtgtaagacttttatgcacacataggtaaaacaattagtatggtagcttttattattcccagcattgttgataaaagaaagaggaagatgaagaggatagaaaaaacacttttcaaaatcagcaaaacctggctaggcacagtagttatcttttctttaaagttatttacttgttttttaaattgatgtattacattggat

SEQ ID NO: 398793 - DNA, 743 bp, Homo sapiens
gacttcctaattctgtccccattgatgtatatgtcttattcttttgccaattgcagataagaatttttacttccaaaaagcaaagggccgatgtccaaattttcttccctcatccaaattttgtgcacatcattttctggatattgtcaggcctctgagccgaagctcagccattgtaacccccgtaacctgcatatatacgtccagatggcctgcaggagccagctaaaaaaccacagaagtgaaacagctcctgccttaactgactgaccaaccttacgacattccaccattatgacttgttctgccctgccccaactgatcaatcgaccttgtgacattcttcttctggacaatgagtcccaagatctctccaccatgcaccttgggaccccctcccctgctaacaataaataaccacctttaactgtaactttccactgcctactcaagccctataaagctgcccctctcctatctcccttcactgactctcttttcggactcaacccacttgcacccaagtgaataaacagccttgttcctcacacaaagcctgtttggtggtctcttcacacagacacgcataacagatatcattatctctgaaaggaaaattagcagtgggaagaatgggtgactagaatctaggaggaaaagtaccaaggccattcaacagcttagcaccccctgagcatagatatggtaggataagaccataggtctgagtcaggggacagaca

SEQ ID NO: 398794 - DNA, 398 bp, Homo sapiens
tggctcatcactgagtggagaatcctcattatactacccattcagaagcaagggtttgtcatggcagctttgatgccctgattggagcattggtttgaaaaggtttagtgaaaggctcctcttttttctttctctcagcttcattagaggtgaagcccttgttggttcattctaggatgtaagagccaagataccaaaggcttgagaaccaaagacccctcaatttaaaaaccgttagccaggtctggtggcacctgcctgtagttccagctacttgggaggctgaggctggatggcttgagcccaagagtttgaggctgcagtgaactatgatctcaccactgcactaaagcctgggcaacagagagagaccctgtctccaaaataaattaaaaata

SEQ ID NO: 398795 - DNA, 736 bp, Homo sapiens
gctgactatttgttgcagtcagacctgatatagatctaattgctcatcaacgtgtaaatggatataagcaaattgtgatgcatccatacaatggaatattcctcaggaataataagcaaagagctaaagatacatgtaaaaccatggataaatctcaatattattatgcagcgtaagaaaacccagacataaaggaacagatattgtgtgattccattaatataaaatattagaaaatgcaatctaatctacagcgacagaaagcagatcagtggtttcctgtgggatggggaaagtgctgattacacagggttaagaggaaacttttgtgagtgatggatatgttcattatcttgattgtggtgatattttatagatgcatttgtataccaaaacatatcgacttacaacctttaaagataagtaatttactctgccaattaaaccccaattaagctattaaaaatacatgaaactctcatgataaaagcacaaataaaaataacaaaaataaacttgacatcatcaagtttgtgcttcaaatactatcaagaaagtaagatgacaacccacagaaagggagaaaatttttgaaatctcatatttaataggggacttgtatctagaatgtattaaagaaattttacaactcaatagcaaaaagacaaataacccaattattaaaaaagcaaagaatctgaatagttttccaaggaagagatacaaatggccaaca

SEQ ID NO: 398796 - DNA, 392 bp, Homo sapiens
cagcctcagctgggagcttgttagaaaggcaaattcttgaccaacccagatctactgaatcggaatctctaagggagggggtcaagcaagctgtttttaataagcccttcaggtgattcttatactgtacagccataccgcagggatattgtgggcttagttccatatcactgcagtaaactgaatatcacaatagagtgagtcacacacatttttttgtttcccattgcatataaaagttatgcgttttggccgggtgtgatgtcacaggcctgtagtcccagctacttgggaggatcacttgagctcaggagtttgaggctgcagtgagtcatgattgcaccactgcactccagcctggatgacagcatgagaccccatttcttaaaaaa

SEQ ID NO: 398797 - DNA, 422 bp, Homo sapiens
attaagtagtcaacagaagttgctttaggcagaggaatgaactaggagaaataaacccttctatgtttttcaataatattacaggaaacacgtattaatgttagaatttctaaaaagccttttctcaaaaaacgtctggccccttaagttctcaaaacagtacacatttctcatatattttagtaaaagccaaaattaagcaattattaaaagcagtttagaatcttgttggattgtgctaaattgtatcaaagtgtttcctcaaaaatatcattttgtatcacttacattattattcaatattgggctatgtttaagtaagttaacctatattattaattaaaatagtttgcatgagaaaccaaatagcacacaaaataaaccatgactcctcagactctaagataactgcatgacataag

SEQ ID NO: 398798 - DNA, 466 bp, Homo sapiens
tgatgtgaggaagataagaagggaagtggggtcagaagggagctgatggaggacagtcatgtcctgaataattgaaggatgaccaaaccctcaagcctggcatccacactgtcagcattacacagcctcagctcaaggtctaggtatcccatatggagccttgattttccttcccacactttctttctgatatgttgcttatcttctgtgaaaaaaaaagctcatcgttagagcttgccagattatcataactggcaactggttattaacggttattcataatattttcccttcactttacatcttacaaaatgctttaatgtacgctttaccttctgatactcagggcaacttcctaagatgggcagggttggttctctttccatcttatatgcgataaaactagaggggaagataagcacttccttccaaaagcacaacatcattgcacgttggtgtgattgtc

SEQ ID NO: 398799 - DNA, 4490 bp, Homo sapiens
tgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcattt

SEQ ID NO: 398800 - DNA, 1182 bp, Homo sapiens
aatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatggtaagtagagaaaataaatttttaagtttggaattatctaagttggcagttgtctgaattgacaatagaaagtgtcagtacactatcaaatgaacagaatgaaaacaacaattcatcagcctaaagaaaaaaaaa

SEQ ID NO: 398801 - DNA, 551 bp, Homo sapiens
tcccgaatcatttataattcagaattttgaataaatttacccttggtcttttaactttattttcataattgagacattgtatttgaaaaattatatcttgtcattggaaaagtaatgagaatgtcagtgatgagaaacttataactttggatttttcttaataatgaagaatatattatacgtttatggcatttctcaggcaagtactgtagtggtaagagattggaaaaaaaagtgcttatcatttcaggttttgagatcaccattgaacacccacacacagatgtggtgaaatgtacccagttagtaagaggtaggtgatccttgaaacttttaagataagtattaatgctttttattatctgtaattgatttgggtgctattttgtttttctagccttttgttaggtttcattaaaattagggagaaatgtcattttttaagcattactttttagtgttctacatctacttctatttgtgattctacctggtatgttagcttcctttaaacataggtaagaatctcatttcactaaaactccggaggg

SEQ ID NO: 398802 - DNA, 6927 bp, Homo sapiens
  misc_feature (5152)..(5152): n is a, c, g, or t
  misc_feature (5963)..(5963): n is a, c, g, or t
tgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398803 - DNA, 7239 bp, Homo sapiens
  misc_feature (5464)..(5464): n is a, c, g, or t
  misc_feature (6275)..(6275): n is a, c, g, or t
aatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398804 - DNA, 7442 bp, Homo sapiens
  misc_feature (5667)..(5667): n is a, c, g, or t
  misc_feature (6478)..(6478): n is a, c, g, or t
tgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtacaagcaaggatttggcacagacatcctatttcatggctaccaacaggttgttatcctgaccctctttgttgcactgttgtagcacactatagcttcctttaatgcagggccccctcaatgtgtctcttacccttgttgcgacaggagactggaccatctactgtggtggtaccttcctgtttgctttgcggtgtattgtacaagggactttgggcacagaggggttaaatgcacaatgtgaagtgtagtggtgctttctgatgacatattctcgatttgtgagtgcataagtctaaaattggtagcctgaatagcagctaaagattacaaagagctaaacttaacgtagaaattcgagcaacttgtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398805 - DNA, 7021 bp, Homo sapiens
  misc_feature (5246)..(5246): n is a, c, g, or t
  misc_feature (6057)..(6057): n is a, c, g, or t
tgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagatctttgggggatagcaagaaacatttgagtgaatgttgttgaagattttcagtagtatagaaaatgatggcgctcttgtgatatttgtaagtacaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398806 - DNA, 6019 bp, Homo sapiens
  misc_feature (4244)..(4244): n is a, c, g, or t
  misc_feature (5055)..(5055): n is a, c, g, or t
aatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398807 - DNA, 1605 bp, Homo sapiens
aatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggtaagagaattgacagggtttaacagaatttcagtcttttatgtaacatttacatagctaaccagtttgaatttttgtggttaaataatctttgcagtattcctgaataattcaacgtatctcaagttacatatactcacatattcaactactgagtccagtggactttgctaaagtacattatacttttaaaaaattttttgcagtgattatgacaaaagtatcctcttcattttacaaatggggaaactgaagcctagacaagttaaattactttctgaagtgctgggctaggatttaacttgtatctgattctaaaatgggtgttttcaattttttatagccttttatgcctctaaggcatttatttactgacaacataaaatcttgaaccccaggtcattttatttccatatgtttaatatataatgtttttaatatataacttttataagacaagaaatttgcattaaattattttgctata

SEQ ID NO: 398808 - DNA, 763 bp, Homo sapiens
tgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagaggtaggtgatccttgaaacttttaagataagtattaatgctttttattatctgtaattgatttgggtgctattttgtttttctagccttttgttaggtttcattaaaattagggagaaatgtcattttttaagcattactttttagtgttctacatctacttctatttgtgattctacctggtatgttagcttcctttaaacataggtaagaatctcatttcactaaaactccggaggg

SEQ ID NO: 398809 - DNA, 6873 bp, Homo sapiens
  misc_feature (5098)..(5098): n is a, c, g, or t
  misc_feature (5909)..(5909): n is a, c, g, or t
tgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagagagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398810 - DNA, 7192 bp, Homo sapiens
  misc_feature (5417)..(5417): n is a, c, g, or t
  misc_feature (6228)..(6228): n is a, c, g, or t
aatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcaacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctaaaaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtatnttcagaaccaaagcaaagggtggtttgttactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgcgtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagncagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaaaaaaaggct

SEQ ID NO: 398811 - DNA, 447 bp, Homo sapiens
atccagttgctacagcatcatttgttggaaaaaagtagggcttacaaaaaattactgccattgatcagctctagtgcctttgtcaaaaataagttcaccatataaggtggacctatatctggggtctctattctgttctaatgatccatttatctatcaatctttatgctagtatcacacttccttgatgactattgcttgaggataattcctgaagtcaaataatgtatattgtctaccctttcttctttttcaaaattgtttttctattccaggttctttctatttctatataaattttagaattgacttatcaactttgtaaaaatacctgctggaattgtgaacctgtagtttaatttggggagaattcatagtttaaagcactgaatgcattttgataaatatattcctaagtattttattctttgagtcttgtgaatgtta

SEQ ID NO: 398812 - DNA, 202 bp, Homo sapiens
gctcctcccactattttgaagcaaatctagacatctgatcacttcttccatatacttcaggctgtagctctaaaagacaagaactcttaacaattaccacagtatcattattctccctagaaattacaataatttcttattctcttcaatatagactcagtgttcctacttccacttatcttgcgaatcctatagatttttt

SEQ ID NO: 398813 - DNA, 506 bp, Homo sapiens
cagaagacctaaaggtgaagagtgaaaaattcatcaagtcttagataacaatgtatgtttaagaaataaaggaatgaattttctgaaaacgagggtataacttcttagcccaagtcaaaatctagaatgtctgcatattaaaatgaggaatcttatcataaatgattaggtgttcttagagaaatattaaagactaaaaatcatatataacgtcagaatgttgcagtttcacttgaaaacagggagtttaaaaagaggacagtccatactaggaagatggtgacataaaacttccctcctgaaatactatctatctaaaatccctgtcttagagacatgcaaaagtgaacgtgtaaatgcagactctgataagactctagtttgaggttgtctatatccaaacccaatatgtcctatggcctgaatcagccatatttctattctcctcaaagtacacctattgccattacaggctttatgcttccctttattttccatattctttt

SEQ ID NO: 398814 - DNA, 491 bp, Homo sapiens
gtatcctaggaatctgttgctctcaagcagtcatccttaggaaactaagctctgaaggcttctggaagtatttttaagaagtaggaagctgctcttgaatttattgcttttctttggaaggaaaggaagagagagtatttttaagaagtaggaagtatttataagaagtaggaagctgctcttgaatttattacttttctttggaaggaaaggaagagagagagagagagagagagagtatttttaagaagtaggaagtatttttaagaagtaggatacagtagggagatctccctactgtatccaagcagtcagtgtcctcccacgtccctaacgtggctctaccttcaggtataatctgttgctgcttgaaggctcagggcattcagcttcaccccaagctgtccttctcattgctctcatctgggacatcccccttctctgggggccttgatcctggacctccacctcctccccaccccgagccctgc

SEQ ID NO: 398815 - DNA, 490 bp, Homo sapiens
cccagaggtacccttaagactggaggatcaccaggcgggccctgacctcatcacaggagccctttaaaagcagtttcctttgcctggttgaagaaatcggagggatcaaaccaaagaaggttttctgttgttgagatgagggggccacgtggcaaggatctgagaactgctcccagccaacagccagcaagacaacaagaccttaactgcaaggaagtgagttctgccaacaagaagagaatgggcttggaggcaggtttgaccccagggcctccacacaagaactgagcccaactgcccacttggtttcagccttgggttactaagaattaggaggtaatgaatgagagttgttttaagctgttggttttgtggtgatttgctatgaagccatatcaaactaatatacacacagaggtgttggcccctgggccattcctaggaagccagctctgcgaaggaggaagaagggcagagaggcacacagagc

SEQ ID NO: 398816 - DNA, 185 bp, Homo sapiens
ctgcactggctagaactttcaggttttaggcaatatattcttattatctaatagtggtagaaatgtaccatgtttctgatgttaaggggaatgcctctaggttttggtgcaatgttcatttgagatttttttttcttttttctttttggcggggggacgagtctcgctcgctctgtcgcctagct

SEQ ID NO: 398817 - DNA, 351 bp, Homo sapiens
ccaaggctgggcactcagtctggcccttggggttcccaacattgagcccccagccctgatcggtggcttcttagccccctgccccccaccctttagaactttaggactggagtcttggcatcagggcagccttcgcatcatcagccttggacaagggagggctcttccagccccctgccccaggccctacccagtaactgaaagcccctctggtcctcgccagctatttatttcttggatatttatttattgtttagggagatgatggtttatttattgtcttggggcccgatggtcctcctcgggccaagcccccatgctgggtgcccaataaagcactctcatccaccc

SEQ ID NO: 398818 - DNA, 386 bp, Homo sapiens
gcacatcattgtagcctgttgagcttttaaacatcccagtgaccaaactgcactccagactaattaaattagaatatctggggatgggacccagatacatgcagttttttagagcttcaatattaattgattttaatatgaatccaaggaagagaactactgatctagtgcagaagtcattaaactagggtgaaatctgattcactgcctatatatggaaatagagttttataggaacacaacatgtatatttattattgtctatggctgttttcatgctacaatggaagaatttagtaattgtgaaagaaccaattttgcctacaaaacctaaaatatttaccttttatggaacatacttgccaaccccagtgtagagagactca

SEQ ID NO: 398819 - DNA, 686 bp, Homo sapiens
atgataaacattgccccagtctctctgttgagcctgcttgtgtcaggtgaaggtgagggatcgggagtgatggagatgcatacagatcagcaccttctctgtacctgctggacccccatgtgcacccttctccctccagcctgggctactctcctcctggttctttctaatcttaaacttcctggtgagcattgccccagccacactttctccctggttttgcttaattccacttatgcatcagtcatttcaacagcatgaatgtggttctgtacagtgatgtatgtggagatttctaaaatattctatgtgtgatttctgttcccaactaggttctaagtgccatcaaagcacggttgggtctcccttgtatcttccacagtgtgtagaaatttgtgctgcccagagctgtgcctagttcatagaaactgactggaagcacattgctgagggaggtttgttgaattggtttttaaggtttattgaaattgatttgctgaatttttctgctagttcaaaatgtgaattaggacctggtcagtttgaaatataccaaattctatgccctttctcttacctatcatcaaattgtagtaatgtatttcaccccactggacttatcttcagagttttaaaagagaggagctctcgacttagaggtaatatgaacagatgaacagacactg

SEQ ID NO: 398820 - DNA, 415 bp, Homo sapiens
gactctagaggacccccacgtatcggggttgcaaattaaataggagaactgaaagttagctaatatctgcaaacttacttcctcttaaatgaacttgtccatcaaaccttcagatttcccctactttctcccttaaagaaacagatcaaaaatatttcgtgatgcacaagctagctaatgtcacacagctgaagcactggagtgaatgaaagttgaagatatggcagactccttgaggctaaaattactgcaacctagatgttgaaaaaatacctagtaaagaatagaaactgagggccgggcatggtggctcacacctgtaacccagcattttgggaggacaaggcaggcagctcacttgaggtcaggagttctagaccagcctggccaacatggcaaaaccccgtctctacta

SEQ ID NO: 398821 - DNA, 609 bp, Homo sapiens
gggacctggatgtggaactgcagtgtgccttgcaaacttgaagagaacgaccttgataatggatggtgaagcaagaaagaggagcctgaggctgagcgcagtgactcacacctgtaatcccagcactttgggaggctaaggtgggcagattgcttgagcccaggaatttgagaccagcctggataacgcgtggtgggcagttccaggacacctgacatgttcccactgcagaaaccacacgggtttctccagcaccactgagacttgctcagcctgtgtagagtagcctggacatactggggctttattttcctgaggacaaccctcaaccaatgagtgccaggaatcattttgccttttctgggatgctccagaactctaggaggacaaaaaagcccttcatgtccaacattagaggaaggcagcatcctccaaagaagagtgactcaccctgaccagctggcagagaagcccaaggccaggccctgggatgtggagagccagtcccagcctggtctggaaggaggcgtgccagggtggcaatgatgcatcacccacgtggtttactggccttgactaacctgaccatgacttagcaaagctgtgagg

SEQ ID NO: 398822 - DNA, 402 bp, Homo sapiens
tctgtcgacaagccaagaaaaagactcatcaattgtgggcaaatgatgcaatatcagaagacaactttatgttccttgtcttagtccattcattcaacaaatgtctattttttgttatctccatgcaaatgagttacaggctacttgaaatcatcttgttttacagtaaatttttggttgtccatagtcaatatgacatggctctaaccaaacaattcatttcaaccatggatggccaggtggggtggctcacacctgtgatccagcaatttaggaagctgaggcaggaggattgcttgagggcgggaattcaagaccagcctaggcagcacagtgagaccctcatctctacaagaaacttgaataaaaaagagaagaagcgagaagcatggactctggtga

SEQ ID NO: 398823 - DNA, 352 bp, Homo sapiens
tagagtctgctcctcacgtgttcattctagggtcatcatatccgatgtagatgatattggttgcacatgtcatatgatcagtgttgccagccatgttcatgcctgacaaggtatggcgattcggcgtgtgcaagtgatcctcgaaactcgatcggcagacatactcgctagggactggcgcgtcggtattgtaacatttatagccaccaccttcttccccctttaaaggccctaatgaacctacatagggcacacgcaagacattaacttcttcctgccagaagcttctatttgctcgatgagggtccttctaggcaagcaccacagctccaacacctcccactgttcacat

SEQ ID NO: 398824 - DNA, 626 bp, Homo sapiens
aaataaagcctccttttttttctggagagctggccttgagtctctgttttcagcttcagacctctggggcttctccggtcctgttagatgactaacagtgaaaatctgttgtttagcgtagccacctccatcaatgatcttagccagatcttctgaataacttgctgcagcttctaaatcagcacttgctgcttcgctttgcacttttatgttatggagatggcttctttccttaaacctcatgaagcaacctctgctagcttccaactagctgttgatgactgttagatcagtggagtagattgcaccgaagctgaatactgctgggtggccgttcccctaaacagaagctcttcacagtaaccaacgggtagacaccttcttacttacctagaggagagaggctccagcacacaacacagaggctgatgtggtctagatatcagtagtgtccccacccgtcacaacctgcactgtttggagtgactgcagctcacaccactcagcatttactgaaatgtctcactcagagccctttacgcaaccaatgcttggtttctgttgaataataaatgtgatatgaatacatgaaaaaatgttcaaatacataatgagtaaccattcta

SEQ ID NO: 398825 - DNA, 300 bp, Homo sapiens
atctctcaacaaattagatatagaaggaacatacctcaacacagtaagggttatatgacaaatccatggataacatccaattgaataaagaaatgctaaaatatttttctctaacaaccagaacaaaacaaagatgtgttcctctaccccacttattcaatgcagtacaaaaagtcctagacatgaaaataggcatgagaaagaaataaagagcatccaaattagaaaagagaaagtcaaattttccctctttgcacatgacacagtcttatatatagaaaacctaaagactttgccaaa

SEQ ID NO: 398826 - DNA, 956 bp, Homo sapiens
acactagaggcacacagtattgagtataatgagacttacagagaagaatatagcaatctggggaagcagaccacacttactgaaagtagcactgcagaagtagtgtttattaatttagattgtaatttgaaattgccacattattcatttctaagatttcaaattgctttatatctgacagtttgtacttcagacctgcctatttttgttttacaggtcctatttagttactaatggatattgatcctttatttctcagatttgttttgatatgtttatcacatttttctattaagagaaattccacttagagtcagttcctttccaaagttgattttgttggctctctctcatggcattgcatttcttcacattttacagttgtgatttgcaagttttttaagtagactttttagtttgtttcattctttggtagattgtattaatgtttctaattctttactccttcccttttacagaattataactggacatcttttgccaggtgacttttcagtgccttccactatagtagatggaatatacttccccactccattgagtccattttttgttggctaacctgtagttttaagattgtaatttttttaaatctagttaccttgattgctttttagagagctattagtcccaataacttagaccaccattatttaaaaatggaattcctaaccacaatgtgtgcacctcatcataggaaggaacacaaatgggggagtagaagaaaacagaaatgtattaataggcgacagtgagtacttcagctttatgtgtaatgttttatttcttgtattacaaagtaaaagatatgaagcatttgactaaaaatgttaatttatataatttgaatgatgggtacatgggcagttgttatatttatatatacttttatgtattctaaatttttttctcaaaataaaaaagagaaacagtca

SEQ ID NO: 398827 - DNA, 623 bp, Homo sapiens
acccccacttccatgtctgtacaggctttgtgtgtgtttgttttgagtggatccagtgtggatagtatgattagatactctctgattctgcgtcttactcttttggacactattttaattgtgcccttaaaatttggtgtttgtaatctgaggccaggttaaggaaagagctatgaaaggcatttatttggaagagagtgataaagtgaggaggttatatatttactctgaaggtttacagtatttgatgaagtctcttcttagagattacacctggggatccaggcaaagatgtagggtggcgcagggctcccttctgacaattctctacatcactgggccaaaaaaaggcagtttattggtacagatgacccttctctcccacctcttctgcctgccataagttttcaaaatatgtagccttgacaagaattggaacttgtaccttcctgcatttcagtgtgggcttttcttttttttctttctttctttaaatggagatgaggtcccactttatagcccaagctggagtgcagtggcactatcatggctcactgcagccttgacctcctcagcttaagtgatcctcccactccagcctcccaagtagctgagactccatt

SEQ ID NO: 398828 - DNA, 671 bp, Homo sapiens
agacacatttgttaaagcaaggtgtacaatgaaacctgcaacatgatttgtctgtttagtaaaacacagaaaatctaactccgcctggcttacgaacacacacatgtgttagaatttgggaaaaggaaagggagggaggccggctacacgtgaacttttggaaaatctcagagggtctggggcaccaggtggagaccatggcagccttcagggatatgaggtgagtccttcaactacatttgcaaggttttatttcttaggaaaatatttaaagcaaatatttcaaaaatgactaaatctgagtggtagggagtcactgttttatagattattcacttttccctgggcttggaatgtttcgttttttcaaaggtcaaatgagatgctgcctttccaccagataaagatttacctggtgcctctgttactgcccagcagcgcctgaggacgtgggggctgctgcccaacacggaggctgggctggcctggtccgtgggctcaggttctcatcctctgcacgtgcatctgcctcctgtgcgtctctgtgcacacgcttgtatctggatgcagagtcctgtgcccagtgtacatgcacagatgtgcgcatctgggtagatgtgctggttcgctgtgtgagcatgcacagacccttgttcaccgtgtgtgcgcat

SEQ ID NO: 398829 - DNA, 358 bp, Homo sapiens
agggctataaacaataacacaatgaaaaaaatcaaacttaggtaacaacatgataaagagaacagtaactcacatctcaatatttccattgaatgtaaatggcctaaatgctacacttaaaagatacagaatggcagaaaggatttttaaaaatcacaaaccaaatatttgctgtcttcaacaggctcacctaacatgtaagaattcatataaactcaaggtaaaagggtgtaaaaagatattccatgcaaatggaaagcaaaagtgagcaggaatagctattcttatattaggaaaacaaaaaacagacttcaaagggttaatggtaaactatataatgataaaaggatcaatccaa

SEQ ID NO: 398830 - DNA, 203 bp, Homo sapiens
gactctacaggatcccctcgttgtcagtgaggccgtcgtcagtgtttcaagatgggtggctgtttctgtagagcagccattggctggggtcccggggctgcccctttggcagggcacatggtccctgagggccacagatgccctgcactttgtcacctcacatccaacttacttcacctctaaagaaagcacatactgaaaag

SEQ ID NO: 398831 - DNA, 398 bp, Homo sapiens
gatcacgaggtcaggagatcaagaccatcctggctaacatggtgaaaccccatctctactaaaaatacaaaaaattagctaggcatggtggcagcgcctgtagttccagctattcaagaggctgaggcaggagaatggggtgaacccaggaggcggaggttgcagtgagccaagatcatgccactgcactccagcctgggcgacagagcgagactccatctcaaataataatcataataataaaagaatgggatttgaagagttggagctgactgagcagtgggtagtgcctccatcagttctgcaaggaagggccagagaccccaggatagagtgtaataagaagtgccacccaggtaaaacagagaggatttctttccagtgaactcaagaatctg

SEQ ID NO: 398832 - DNA, 602 bp, Homo sapiens
taacaatctagggaactgtcagtgaactgcattgtgatttacactaggcatttaaaatatttccaatggattaaagagtttttgaacatagggggtttcacatttcaagcccaaatacctaaatataattgcacactatgctcctgtcagtatacttgctggagcaaagtagttcacagcaaccagcttagctctacttagaaaagacttgcttaggaataattgaagtggtagaaatgtgtatgtggtcatcctcattgagacatttagaaactggtattgcatatggtgtcatcctctttaagccactctgtttttaacaaaaatgaaataaatatgtgagtttacagctcacatgaaggaattaaacattttctgggaggtaatttaataaaaatcagatgattcaagaaatggttaccttcatgttttgtttatttgtttgttttgttaaagaaactagttggaaaaatgctttgttcggatatcttaaaataactccataggtagctgttctgtgattgccgacttggggtgtggaaaagttacaaaatgaaatagagagctattatttagcaattaagaacacactttgcttcttt

SEQ ID NO: 398833 - DNA, 635 bp, Homo sapiens
actacagaggatttggagtggaaggcaggaattaacatttatcagcatttatttaatatgccagctggtttatgtaattttcatttatttttatagcaatcttatgaaattatctccattgtagagataaagggattgagactgagagagatacagtgacttgcccaagatctcaaggagaaagttaaggaatctggtttggaagctaaaatccaacccaaaatttatactctcaactgcaaattctgtcttcctgccaccaaagcaacttttactgctttcaaaaggttatttgtcctctctttctatatgtatatacttagtttaaaaagacataatgggtagtttgcccttgcagaatgaactcagaggtgagcttaaagagctttcagaaataatgttctacagctcaccctcatcttataaatgatgaaaatgaaacatgaatgagacaggaagatttttgttccaagctctttggctggtgaatgacagtcttctgacctccaacccagggttttgcccgtgatatggcaatgattcttccaactcaggagaatgagcccaaggccagctggaactaatgttttttcaagactcagtagcccctggttagtgtcaaggagtcacattcc

SEQ ID NO: 398834 - DNA, 758 bp, Homo sapiens
  misc_feature (19)..(19): n is a, c, g, or t
aatcagctcggtccgattngctctaacggcgggattagaattcaggccgtctggggtgggattagaattcaggccgtctggagccgggattagaattcaggccgtctggagtcgggattagaattcaggccgtctggagtcgggattagaattcaggccgtctggagtcgggattagaattcaggccgtctggggcgggattagaattcaggccgtctggagtcgggattagaattcaggccgtctgggccgggattagaattcaggccgtctggagccgggattagaattcaggccgtctggagccaggattagaattcaggccgtctggagccgggattagaattcaggccgtctggagccgggattagaattcaggccgtctggagtcgggattagaattcaggccgtctggagctgggattagaacccagatcgtgcgggtttagaggctgcacactcaactactgtgctatgtagcctctccccttgaaggtcctgggggatccctgagtttcctgtcctttcaacaggacaggtaaacctttaacccccgccaaggtgccattttcctgtttctagaacattcctcagagcctttgcacttgcagtttcccttgccagggtgccctgcctgcctcatccctgcaggtaactcagtgtttctgctcagttgacccctccccagtgagggcctccccacaaccccagctaaaatagctcctccccgtcatcactctgctcctagctcggattct

SEQ ID NO: 398835 - DNA, 323 bp, Homo sapiens
atggtggcttgcacctgtagtaccagttacttggaagactgaggtggaaggatagcttgagcctaggaggttgaggctgcagtgatcatgcttcagctagggtgacagagtgagactgtattaaaaaaaaaaaaaaaaaaaagagattctgctccaagcttccaacattttagaaaataaatgagatatattagataaacacattctgggtttccgggcagacacactgtgaaaattaagtgattttttttctaaattatttaatgtatattttaaatagtgaaatagaaactaatgtatactaataatgagggctttgtgtt

SEQ ID NO: 398836 - DNA, 162 bp, Homo sapiens
aataccttagaaataaatgcataaatttttttctttctgtttttttagaccgtctcgccccattgctcaggctggagtacagtggcatgatcatggctgcagtcagctgcaattgtgccactgcactccagcctgggtgacagagtgagaccctgtcaaaaa

SEQ ID NO: 398837 - DNA, 534 bp, Homo sapiens
tgggttctacattcttcttcccttgatctaggtctctttccctttgccagtaccacagtcttgattactatggttaaatgatgagccttaaaattgggcagagtgattcctcccacttccttctttgtagggagtatttttgctagtcaagggctgggctgcttgttgtcactgggtctccttttctggctttgcatgcccacccttgatgctacttttgaatcttggattcattttctaggtttctctccagaggggtttttgttttactaaaggaaataaattccccttttccagggaattttttcttttttcctctgagtacgctaaaagctaaccctagaagttaaaattgtggatgtgaatgatgttatttttgcccccttaaacctgccaaactcagctggacaaagtagcatgtgtgtgtaatcctagctatgcaggaggctgaggtgggaggatagcttgaagtcacaagttcaagaccagcctgggcaacctatcgagacctcatcttttaattaataaaaaaac

SEQ ID NO: 398838 - DNA, 403 bp, Homo sapiens
aggctgaggtgtgaggatcacttgagcctgggaggcggaggctgcagtgagccaagatcacgccaccgcactctagcctgggagacagtgagaccctgtctcaaaaaaacacaaacctattatgctgttatgattaaatgccattatcacaacaggtcacgctgtgaggcatgaaaatttttattacattttttattcaaattcagttgatttattcatcaaacatgagatgtctgaaaaacatttcatatggtgcaagagttaaattaggcagggcacagtggctcatgcctgtaatcccagcacttgggaggccgaggcaggaggatcgcttgagcccaggagtttgagaccagcctaggcaacatagcaaggccctgttctttaaataaataaataaata

SEQ ID NO: 398839 - DNA, 495 bp, Homo sapiens
gggtgtatctatcaggatatttctgggcctcattcaacccattgaaggcctgtacagaacaggaaggctgattaagagagaatctctgtctttgaggtggaaaatcagtcttctgccttgtgacgtggactcagactggaactcataccgtcagctctcttggttttcaggcctttggaattggcctggaactataccattggctcttctgggtcctcagcttatcacctgcagatcttgggacttctcagcctccagaaccatagaagccaattccatatagtaaagctctgtctctcatctatatatcttatcggttctgtttctctggagaacagactaatgcatccatattgacaggaaaatagttcattcattgtaattgctgtatactatgccactgaatgagcatatcaatttgttccattaccctagtgaagcattattgggttgttcccacttttcccctcttataaatcaatagcaatgcagtga

SEQ ID NO: 398840 - DNA, 529 bp, Homo sapiens
tgctactggaccttgacagacacagcccttaaaccctttctatagagactctcttccaccctgaattgattaaaagacaggcatacttatttaatcagcccatcaacgatgggccttgcactgttttagactactgttttagattactgccgttaataaacaaagcagataatgtggagtggtcaaggagcattcatttaagggagcaagatgtacacctgccacgtaaacaagataatttccaagacaaatgtaatgcagaaactaaaacacagtaacaatatagacagtgactctggctggcagggagggtcatgtaggatacggtgatcagggaagcctctctaagcaggtgttattggacctgagtaacaagtaaacagagacctgcgaatagagctttccaggagtgagatctgaaagaaaaagactgaaaggtgagaaggagcttcagatgtctgagaggtggaagaaaggtcagtgtggctagagcttaatgagcacagaggaacaaggtcagagcacattt

SEQ ID NO: 398841 - DNA, 159 bp, Homo sapiens
tgagaaggctgccttgtggctggctgtcaaacagctggagattcattttatcttttcgaggggtgtgtgtgcgttgttgttgttgtttggggggtggtggtggtggttaatatgctgcaactgaccatgattggaggttcattttatttatttttgtaa

SEQ ID NO: 398842 - DNA, 324 bp, Homo sapiens
gcaacctagacaagagtactgcctcctcttcaaaagcaaaaggaagagagcgaatcatgtagtgattcccagcccttactcattgaggctataggaggggatgggaggaccctgaggtctgcagtgagaagcaggactcagagacaatgcactctgcatgatcatcttggcatctagtggggttccctgcaggtaatgtgacttgtacttcaatttcaacacaatctggaacacacagatcttaatttggaaagctgaataacaggagaaagggggaagaggggaggaaacaaaaacaacaacctggaaacttctagttttatg

SEQ ID NO: 398843 - DNA, 300 bp, Homo sapiens
tggtccatatgggtttctctgacggagaatgaagaactgaaacttctctggcaagcagtgccaggcagaaacaccactttgtccggaaaggtatccccactgacggcctccaatctacaacctgcaatctgaatccttgccaggctgaagaaaccaacagcttctgttttgtctcccaaccctcccatactgccttgtctgcaagagaaaggctggtaccagtaagaagaaggaaagccgtcccctggcaactgtttgaggaagatgctgctgcaaaataaaatcctaaaaaccacacca

SEQ ID NO: 398844 - DNA, 624 bp, Homo sapiens
atttttttatgtgatatacaactcagtagatgattagtatatgggatgtcagaaaattccaaaattttgtcctaatatttgtgcatttatagagaaatttaaaggtgaagtctgagtttttttaagttttactgaaaaaattatcaggactgactgttccagggagtagtgtttttttagccaggtaaaaagtcagaaacaaataaaacctcatgtatgccaaaagtttgtgatactgggtcatttcctttccctaggtcagttaaatctacttgttttgtttctttggaataattgttgcaaatgagttatcaaaacttcgtccttgtcatcctctgcctgttgtttctcattttagggaaaagcagtagctttgctgtgctttttattatctatctttccctgtctacctttacaaatgaaaattattgcagagtgcaagtactatattcatgtctatgtatatgtgaattttctttctgagttaacatgaagtatatagagtatgtgtaataattgtgtgcttttttgtgatgaacttcagtgctcaattaattttatggattaaagagacctgaactacagccgttcatatccaagtgctgaataggacagacctgaaga

SEQ ID NO: 398845 - DNA, 373 bp, Homo sapiens
tgtggcctgaagtttgtgaacctctgtgtttgtttgtttgtttgcttgtttgtttgtttatttagagatggggtcttgccctgtcacctaggctgtagtacactggcacgatcataacttattgcagcctcaaactcctgggctcaagagatcttcctgcctcagcctctcaagtaactgggaatatacaggactgtagtcccaccacgatggctaattttaaaaatttgttatatttttctagagacagggatttactatgttgcccaggctggtccccaactcctgggctaaagtgatcctcccacctcagtctcctgaatcactggggttataggtatgacccacagcacatgactgtgttaggggatta

SEQ ID NO: 398846 - DNA, 271 bp, Homo sapiens
gaggctggggcagaaggtcacttcatttgcccattcctaccgctgcacccacagcccatggcgcacagccactcttggtcatgtgcctcatcacatctcaagtaggagatgctgcagcctcctactcggtgcctcaggcaaccagaggaaccacgccagagctccatgcccaggatgacccctgccccttctaaaccatttggtctgcacattgccttaggatcaagtccagactccttagagtggcttatacccttctgatgggtctccc

SEQ ID NO: 398847 - DNA, 426 bp, Homo sapiens
gggagcggaaaaatatggaaggcaagggaaagctgggtaaggaagagtgcagagtgtaagaagttctcagaaataccagaaagttgtgggaatttgttaggaagtcagtcaagtagggtatgagatttttttttaaatttgcgggcttttcattcactgtcagccgtgagccaccaagatccttgggtgactttctagcaagtgtaattttgaactgaagcgtggtcctgttcccattctgagtagagccacttcccatcacacgatgattgtggtgactgcagcttgactgcggcttcttgcattgttctggcctttcccttctgcagaacttagaaccattttcttgtgggtttgtgatcacaaggctgacctgagactgacagttctttcaaagaagtcagtcttgagctgtttttggaatct

SEQ ID NO: 398848 - DNA, 371 bp, Homo sapiens
tcctgaaagtgagacaaagttatctgtaacagacacctatgcttacctacccagcccccaggccatgcgagcagaggagagggtatcatttaaagggcccgcagcagcaaagaggctttctctcctctgtctttgacccatctctgttctgggtaacttcactaacctggtccctctaaatctgtgcctactttggaatccaccaagagtctgtttctgccctaatttgcccacatgccagctctcatctgcttccctgaccacagttccagcctagtggaaccatttctggtttggagctagattcatctttcaaagcagagagtgagaagaaaattctctaactcttgatgcacagaaggagttcagta

SEQ ID NO: 398849 - DNA, 647 bp, Homo sapiens
ccaagagaaatccagaacttgtggaagaaaaattcatattaccccttcagcaaatttaagaaaaacctgtcattgtactagttagaagcttattatcttaattcagtaggtttatgtagaccttaacaaaaggaaataaatatcttgtaatgagtattgaccaaattctctcagtgcatggtcactctgagtctgtttgccttcttccaatttcatttctttcccttgtgtgattggtttaatttgtgtatgaatcatgtcttgattttaaatgttgtcttaccaattatttgctttttggcttaaggagtttgttattttctaaaaaggaaaggatacagagagtcttacaaattgtgtttttatcatagtatttacacatgtaaacccaaatttattttaataggatatttgaaggatctgtatttatctatttatatctatgtatttatctaccaatctactattgatttcatagggcaggagagagggagagagatgaccctgtcattagattctgaatttaaaagtatcacataatagaaatctggagtaggtataattacccttattgtatctttttaaaatttgccacaactaatgaaaatgtcttttacttccttaacaaaagaatatgcctccaaagg

SEQ ID NO: 398850 - DNA, 639 bp, Homo sapiens
gcacgagagagagctagcaccatgagcttcaataccctgtcggtcatttcaaaaaaatgaagcataaacgatgtgcatatcagtaacttccagaaaaacttctaaccatatttaaatttcttttaaacatctcttatctaactgaactaggaggagaagtatctttttctcctctccgggcagacaaagtgcagcatctgtgtgaggaactataaacattaccgcctaaagtaataaatgaatcatggtttgagtagcctgatagagtgtttcagaacaagagcattattcctctttttctgacttaaactgtttctaacaatcataaaattagtcaaagttattgtgtattcctcaaatatatcaggatgaccttattacagtcataagatcataccccttttttgttattaaacattccaatggacacaatgtggtagttcagagacattgagaaaataaaaatataggccaagcgcggtagctcacacctgtaatcccagcactttgggaggccgaggcaggagaatggcatgaacccgggagcggagcttgcagtgagccgagatcacaccactgcactccagcctgggcaacagagcgagactccgtctcaaaataaataaataaataaatgtg

SEQ ID NO: 398851 - DNA, 468 bp, Homo sapiens
tatattttttaaattcccttttataaattccttcacaaaaggcattgaaagtcacaaaagcaccaatcttatataatcaaatttcatttttgaacaaaaattgatataaaatatcttaatctgcactttaatcaatatacatggttctaaatggcttttagccacatgtgaacagtaaataagcactcaggagataaaaatttgatagcacagaagctattcaaaagaatgtgtaattagcttgaaagatagtcccaaaacaaaaagttgcagaagtttctattgttcttttaaatagcggcaattttacaataaaaatagagattccaaagaaaactgaagtctaatctacatttgtatatataaattacagtatatatttaagctgcctcaaatataaccaaaatttaccctgtcggtcatttcaaaaaaatgaagcataaacgatgtgcatatcagtaacttcca

SEQ ID NO: 398852 - DNA, 477 bp, Homo sapiens
cactttacactcaatagatggctaaaatcaaaagacactaagtgatggccaggatatacagaaattacaaccctcagtggatgatgggaaggtaaaatggtacagccactttggaaaagtctggtacttcctcaaaatgctaaatacaaagtgtccatataacccaacaatttccttctaggtatatatattcgagagtaataaaaacatcagaaacttctacatgaacattaatagtatccatactagctaaaaagtgaaaacaacccaaatatctattgttaaatggataaacaaaatgtgggatactaatacagtggaaaattattcaacactaaagaggcttcagtactggcacatgctacaacatgaatgaccttcaaaagaaagacaaatccagtcacaaataatcatacagtgtatgatctcatttatacgaaatgtccagaaaaggcacatctatagaaaccaaagtag

SEQ ID NO: 398853 - DNA, 605 bp, Homo sapiens
tgtgataaaataatagacgttaaggaactgcaatattttcatccatattagtaaatcaggagcatcaggaaaaaagagaataagtgttaatcaaactgatagatcattggatatccttatgaaggttgtatttgcagcatcaggtagagttcagctcttcctgtgacgggtaaagtctttatctctatttttctcccaagtgttgaccttccaagatattattctgcaaatctcttagcaagcacatttctgacttgtacagcattgagcttaaatctgtattggaacaacatttcaaccgtatttgagtcatagattatgttagtaaaatgtttatgtttaaaatttttagggaaaagcaccattctacttctaattcacagtgtaggtgatgacttatatttgtaggaaaagtaaagctacagcgcggtgttttctctagtattgctctaccgtcagagagtattaccctattattgttctctttaaatacagggtaatatttggctgtgttctataatgccaacaaatacttcaccttaaagggcattttggaaaagttcttgtcaagattggttgacattattataatcaaattaaagttt

SEQ ID NO: 398854 - DNA, 102 bp, Homo sapiens
tagggaaagggggttcctcagtgctctttatttggaaaagagatacggggaagtttgggtgggacacaaacggtgacaaaactttttttttttttttttttt

SEQ ID NO: 398855 - DNA, 687 bp, Homo sapiens
ggatctgagcctcctgacatccgaggcccctcttggtggggagagccagaaacccaagatactgccgtcagttaaagactcgaagttcacattttaaaaagtgcaaggagacacccggttttaggtacgttggggtgcaaggtctgaaggctggaatctgtggctcccttctttcagctctgtcatccctcttgtctgggtgctgcccacctggtagaaaggggacctcaccttgccactccactagcctgccaacaccaccaggaaggcgacccttcatcctggtggctccagtaaaaatcccagggaaggctctgattggatcagaagggccaagtccccatcccaggatgaatccctatggccaggggccctggagcctctgtccagtctgtgtcacatccatattttcagcccagcaatgggatctgcctgatctccaccactggggctgagcatagagaagaggaggttccagaggagaacagggggcccttatgagaagaggggagggatggtaaacaccccaaaaatgaagatattcatgacagaccccctctgatgctgaaatttgtgttgtctttggaaggtgctgggctaagctgtggagtgcctgcatctggcctggctctgctggggatgagcagtgccatgtggcagccccgtcccttctggggcttcaacacc

SEQ ID NO: 398856 - DNA, 289 bp, Homo sapiens
tgagaaaataagggagtgggtggggtgatggtgatgagggtttgtgctttctagtaaatctgctaatccttaatcctgtgaagagggtgggtgttagcaattcactgatgagacaatactggattatgtgtaattaagctgagatcagattagcataactagaattttttttgagacggagtttcactcttactgtccaggctggagtgcaatggcacgatcgcggctcactataacctctgcctcccaggttcaagcgattctcctgcctcagcctccctagtagctg

SEQ ID NO: 398857 - DNA, 675 bp, Homo sapiens
aatagcattctccaatttctcttccttcctttatttttgctttgttgaatagtttcacccagaagagaaagagaaaatccctgaaagcattacacacaaaaggtcatttgtcctattgccagctcaatgataaaagctcagagagtgaatagtactcccctgcaaaataagcgttgataattgaaacaccaaacaaacaaaatagataccaaattctttgaaacaatagtctactgctgccctctcaaattgggatacatttttcttttcttacaaatcaaaaaccctaaaaccctaaaggattcactctccaaaagcctttctcttgagttttgtcctgcaatttgaataagctctttgtcttcatactgtcctcacattgctgagggagctctgatgagcatatacccctctttccaagagggtatggtgacagagcagaccctagcccctgctgctgttctcttgctccaccaagagaatgagtggcagtgctttctgtgaataaaacaaaaaaatgtaaagcatacatcaaactgtacagtcagtactgaaagtgcccaagtgccatcctgttcatgccgtgagctatatgattggcctgggtgtagaagcctgaaggtgaattatcctgttgggttcagatgagtgcaaattagctgcaatttaagtatt

SEQ ID NO: 398858 - DNA, 2264 bp, Homo sapiens
  misc_feature (796)..(796): n is a, c, g, or t
  misc_feature (878)..(878): n is a, c, g, or t
  misc_feature (952)..(952): n is a, c, g, or t
  misc_feature (1172)..(1172): n is a, c, g, or t
  misc_feature (1208)..(1208): n is a, c, g, or t
  misc_feature (1260)..(1260): n is a, c, g, or t
  misc_feature (1346)..(1346): n is a, c, g, or t
  misc_feature (1572)..(1572): n is a, c, g, or t
gggggcagcaggaagagctttgtgtacattcccagtctccagtgtggaccaagggaagccattacctattctgactcatatgggaccttgcagaagtctggcaactgactcaggcagtggtcttacgttggaagaagctcccaactgaactttgtgatacaaccttgagtagggaagaactcctttagccagaactggggggtaagtgggaagtgtgctgcaatcatgagcataggagctgggcacccctgtcgtgcaggtgcgcttttcatgcatggcttgaaagctgtggttgttatccctgcagagaaggtatatggcctgggggagttttgagttctgtgctcagatggcctggaacttagggtcgttgctgctagtagaaagctgtgggtgtgagatctgccttgccaagtgtgtgggagctgggtgggacttaccactgcctgctactccacatttcctgcagtacttttctgttcaacagaggcagctatgctcctctttggaacattaccccagggtccagagaactgtctcctgactcccacaggggctgctgcttgctctgcacatggagagtcagaccaaagacctgcctaactcagcccccacctggctttgcccctctacctgcctggtatcttaacacaaaggacagaaacttttgggagctttatgcccaccacctgagaaaccggagtacctctcttgggtaacataaagcaagcacaaatcccactgctactaccatagctggtgctcttttgcaagtgccacattttggctggaggcnagctgacgcagtccattacagcatctccaagttgaataataccacacccaggaaggagaaaacttgtgtgtgacctcagctntcaccattgcctacacaaccctggctaaccaggaggtcctaagtctgtacatgtgaccagttcattactactanaaccagcatttgagaaagccaacacactaaggctatctataaccaaggaatttcacaggatctacatcactcccttgccacccccatcagagctggtgctagtacacactcctgggaaacttaaagacaggtcacatctctggatcccttgaagacattccccagaaccagcctggagtttaccagccccactgggcaacttgactcaggggcaacagcnttcacagtagtctggccctcaggggctcctactccnaggggaagggagagtgcagctcatcaaggaaacaccctgtaggacaaaggancctggatggcaggcttgagtcccagatctttctgctggtgggaagtttctttcagcagatgcacagttgcaatgctgggttcaacngggaaagtctgcagttttgccccaacaatcaggaggccctggtgcccatgaaggatctcggagaagggggggttcttctcctccttgtccaccactgcagacacagctggtgttctccccacaggagcttagcatgagtgcacctatacacaggctttctgtaacacttcagggtgactgcatctccacaggaggagcaccttccaggtgcaggcttgcatgagangtagggtcacatttcctctctacttggtacatcagcatttctgccgatgaaaagaggcacttgtctgatctgaacagctggaacacttggtcaggagtgtgtctgggaggtggatagctttcctgttggcctggcaggggagctgagatggttatggccattccctctgataagacctcagtgtgtttcactgagggtgcccccagccacttctgtcaaggctgggacttctgcccaccattgagtgttgcatttacccacctgctttagctacagctggttttaatctgtggacacctttcctattggccccaatcctgaagcattcaatccagtaaataaaatactggggaataaataaagaagtacacaccaagggggaatcaaatacacttcaagatacctctgtcattccaaccctataggagacagtgaacttgctcactcaccgagcacgttggtactgcaaccagcatctgaggaagccatcatacaaagactctctataaccaaggaactcatacacagtcttcagccctgaaagcaccaagagccaaattaagctataaactataaacattaaaagtcacatccttaaagggggaaaataaatttaacaaaatacaaataaaaaataagttcaagaataatcaggagaaactgtctacccaaactaaacccaaagctagcag

SEQ ID NO: 398859 - DNA, 2472 bp, Homo sapiens
  misc_feature (796)..(796): n is a, c, g, or t
  misc_feature (878)..(878): n is a, c, g, or t
  misc_feature (952)..(952): n is a, c, g, or t
  misc_feature (1172)..(1172): n is a, c, g, or t
  misc_feature (1208)..(1208): n is a, c, g, or t
  misc_feature (1260)..(1260): n is a, c, g, or t
  misc_feature (1346)..(1346): n is a, c, g, or t
  misc_feature (1572)..(1572): n is a, c, g, or t
gggggcagcaggaagagctttgtgtacattcccagtctccagtgtggaccaagggaagccattacctattctgactcatatgggaccttgcagaagtctggcaactgactcaggcagtggtcttacgttggaagaagctcccaactgaactttgtgatacaaccttgagtagggaagaactcctttagccagaactggggggtaagtgggaagtgtgctgcaatcatgagcataggagctgggcacccctgtcgtgcaggtgcgcttttcatgcatggcttgaaagctgtggttgttatccctgcagagaaggtatatggcctgggggagttttgagttctgtgctcagatggcctggaacttagggtcgttgctgctagtagaaagctgtgggtgtgagatctgccttgccaagtgtgtgggagctgggtgggacttaccactgcctgctactccacatttcctgcagtacttttctgttcaacagaggcagctatgctcctctttggaacattaccccagggtccagagaactgtctcctgactcccacaggggctgctgcttgctctgcacatggagagtcagaccaaagacctgcctaactcagcccccacctggctttgcccctctacctgcctggtatcttaacacaaaggacagaaacttttgggagctttatgcccaccacctgagaaaccggagtacctctcttgggtaacataaagcaagcacaaatcccactgctactaccatagctggtgctcttttgcaagtgccacattttggctggaggcnagctgacgcagtccattacagcatctccaagttgaataataccacacccaggaaggagaaaacttgtgtgtgacctcagctntcaccattgcctacacaaccctggctaaccaggaggtcctaagtctgtacatgtgaccagttcattactactanaaccagcatttgagaaagccaacacactaaggctatctataaccaaggaatttcacaggatctacatcactcccttgccacccccatcagagctggtgctagtacacactcctgggaaacttaaagacaggtcacatctctggatcccttgaagacattccccagaaccagcctggagtttaccagccccactgggcaacttgactcaggggcaacagcnttcacagtagtctggccctcaggggctcctactccnaggggaagggagagtgcagctcatcaaggaaacaccctgtaggacaaaggancctggatggcaggcttgagtcccagatctttctgctggtgggaagtttctttcagcagatgcacagttgcaatgctgggttcaacngggaaagtctgcagttttgccccaacaatcaggaggccctggtgcccatgaaggatctcggagaagggggggttcttctcctccttgtccaccactgcagacacagctggtgttctccccacaggagcttagcatgagtgcacctatacacaggctttctgtaacacttcagggtgactgcatctccacaggaggagcaccttccaggtgcaggcttgcatgagangtagggtcacatttcctctctacttggtacatcagcatttctgccgatgaaaagaggcacttgtctgatctgaacagctggaacacttggtcaggagtgtgtctgggaggtggatagctttcctgttggcctggcaggggagctgagatggttatggccattccctctgataagacctcagtgtgtttcactgagggtgcccccagccacttctgtcaaggctgggacttctgcccaccattgagtgttgcatttacccacctgctttagctacagctggttttaatctgtggacacctttcctattggccccaatcctgaagcattcaatccagtaaataaaatactggggaataaataaagaagtacacaccaagggggaatcaaatacacttcaagatacctctgtcattccaaccctataggagacagtgaacttgctcactcaccgagcacgttggtactgcaaccagcatctgaggaagccatcatacaaagactctctataaccaaggaactcatacacagtcttcagccctgaaagcaccaagagccaaattaagctataaactataaacattaaaagtcacatccttaaagggggaaaataaatttaacaaaatacaaataaaaaataagttcaagaataatcaggagaaactgtctacccaaactaaacccaaagctagcagaagaaaagaaataacgaagatcagagcagaacttaataaaattgaaacaaaacacaatacaaaagatcaatgaaacaaaattagttatttgaaattataaacaaaattgatagaccattagctagattaaccaacaaaagaaagaagattcaaataagctcagttagaaataaaactggagaaattacaaccaacatcacagaaatac

SEQ ID NO: 398860 - DNA, 123 bp, Homo sapiens
ctggttcagaattaatcacttcttactttctaagtggtctatctggttctagtgcagtctcctcactttcctggtgtttggtttatctttcaagtcaccatcttgttcatcatccgagtatta

SEQ ID NO: 398861 - DNA, 417 bp, Homo sapiens
gtaaaagtttgtcatcacacctgctctgatcccccaggggggcctgatactcggctgcagtcctgcacaagtgcccatggaggatgtgtccaccagttcattcttttgacacttggaaagaagtggaacgtggattcagatttggccagattacattcagaggagagtaaaacatggccaataatactatgaggaagctgaggatcagagaagttaaaaaatgtcatccaagatcacatatccagaagctgcagagccaggacttgaactcatgtctgtctgactccagccatgcttttaatcactctgctgggctcattagtacctatcaggcctatgattgtgtccttagtgattagcactttccccagagctggaaatgagatgcgagagaaataaaaatgcttgagatctaaa

SEQ ID NO: 398862 - DNA, 511 bp, Homo sapiens
ttccatagtaaaggctagcggttctacagtgctggaagatgctatagaaatctcacccctgtaagaggtgccacttcagaatctgcccccacctcctctcttgcctgccaagccaataactaggattgaggtcatgctgggcctggtctatgtttctgccaccctctgtgatggtgagtctgaaggaactggactgcctgaacaccccacagaacatcactctgatctattacattgacaacatcactatgattggacaagttgagcaagagcccatggaggatgtgtccaccagttcattcttttgacacttggaaagaagtggaacgtggattcagatttggccagattacattcagaggagagtaaaacatggccaataatactgtaagaccaatggtgtgctttctgagacggtgaatgcctatagaatctgtcaatatgaccgtatttttgcgtgtgtgttgtaaagtgcatataacataaaatcgacgattttaaccgtttcaaa

SEQ ID NO: 398863 - DNA, 463 bp, Homo sapiens
ctttatatttttcttttttttttttgagacggagtctcgctctgtcgcccaggccggagtacagtggcgcgatctcggctcactgcaagctccgcctcctgggttcacgccattttcctgcctcagcccccgagtagctgggactacaggcgcccaccactgcccccggctaatttttttgtatttttagtagagacggggtttcaccgtggtctcgatctcctgaccttgtgatccgcccaccccggcctcccaaagtgctgggattacaggcgtgggccaccgcgcccggcgaaaactttgtatttttcaagttcagccactttaaaaatacttgtggctgggccaggcatattggcttacgcctgtaattccaacactttggaaggctgaggcaggaggattacttgagcccaggaattcaagaccagcctgagcaacaaagtgaaaccctgttggtaca

SEQ ID NO: 398864 - DNA, 269 bp, Homo sapiens
ttcttgattcttctggttttgatgacttacatctgaaggtgtcattagtaaggatggaaaacataagaagtttagggacaattgtgagttcaagttgaagtggagttggggtgtctgtggggcattcttttgatcttaagaggcctgagccccaggagagaagtgagggctggagacaattattgaagagtgactaggattgatcgtggtagccatgaatgtcgttgaaactccacagggatggccaaaggatcaaagactgagcagac

SEQ ID NO: 398865 - DNA, 111 bp, Homo sapiens
aaaggtaagagcaggctaccagtatgggaggaggacagtactatggagtgagacccctgctgcagtgcagtttgcagagattatgaaagttgaaggtatatcacaaacact

SEQ ID NO: 398866 - DNA, 637 bp, Homo sapiens
aggtttccacaggatgagtttttttctgagggctgtgacgaagaatctgttccatgcctctctcctggcctctggaggtttgcgggcaagctttggggccttgtagatgaagttctccaattcctgccttcatcttcaaatgatgctctccctgtgtctctgtcttttcacaggatatgcattccctctgtgcatatccttctctggacccaaatttctctttttataaggacatcagtcctattggattagggactagcctcatgacttaaacttggattgtctctgtaaaaaccttatttccaaataaagtcacattcttaggctctggggctaatgacttcaacatatatttttggggagacacaattcaacccataacaatatcatatgcacaaaaaacaaaggattgtttttaaaaagggtgattcagaataataacactgatttgtctagaactccttcagtttttgggaaacaattgcaggattggagtcataggctgacaagggatttagctgatggtgaggctcaaaagtcaaaatgcaatcaaatacattaaaatatatttaaatatcctgaagccctttataaaaatgctcttaaagcccacaaattcatttagtcttcctgtact

SEQ ID NO: 398867 - DNA, 832 bp, Homo sapiens
ataagttaatcaaatttttgcattagatcataaaactggaaaatcacacttagttttaccacaaagttttcactttattttctgaactatttctgcaaaagcaacagtattgtctgactttggtaagtgttttgtgagcttacactttttcattcaattaacatttattgacccttattatgtcccaggcattttgttctgtaggacaaagttcttggagaaaaccaaaaatcatctctgctaggggcttctttcaataatacaagactaagttcatttttctgagcctctaaatgtttgctgtttacaattcatacagggtgactacattgacagctgaaagcaatacatattttatttttttttaatttaagaagtgtgtactttatgataggtgatttgggtcagctgtcagattgaaaaagcttttttctttgtttcctctgcatcaagaccatttttcagcattaatatactgtcatatcatcttctatttgtcattaccatacagcatgcctgtgcatttagaaaaagcaacagaaaccacaccatgtcattacttcttccgtatttaataacagaaactaactcttgcacatttagggactagctcctctccttggtcttcagaatataaactttgccatcaaagtatatggaactcacgtggggttcactggtcttctaaattctacttcaaaatttatctcccaagttgtactcaatattagctatatatttttatgttcacatgtcaaatacgctccctttcagcctgccttgtgtttcaaattctcttttccttacaacattgcttgccatgtcttcattg

SEQ ID NO: 398868 - DNA, 344 bp, Homo sapiens
gcagaaagcaagcgggaagatggaagatgtgcccatgccagccttggatctctcagcgtcacacacgacgcccaggaaggagtgaatgatgcacagatgaccagaaaccaggagaagaggccagtgacacaccagaccaggaggcccagctcatggggtcatcggacccaccttgaactctgaaggtcacacattcaaaagccacaggaagtctggagatggcagcagagagctgggaagctcagaggtgtcaggatgaacctggggctgaaggcggaacagttggagattgagacctgtgtataggttttggtcgacgtgggattgcttgtccctgggagcca

SEQ ID NO: 398869 - DNA, 649 bp, Homo sapiens
gcctggtgaaaggttctgtataccctgcagatgccagcagaacggagggggtccagccagtctctggcagtgcccgcctgcctcacccctgtcagtcacatgctacccctctgctacccaggaggcccccatgatcctccctgaggcccagcctgcctcttgtccttctagctgacctcatacactcattggtgctatggcagggccttccctctgtagggcacctgcaggtttcggggggcctcttggggatacctgtccttgttcatggagacctcaggctccctggggaggcaccagggtggagaggggctatatttttttcaaggtggtaagccatctattgcatgcccacctggaccacatctatctctgcctttaaaaaatttattaaaattttttttttagagacagggtcttgctctgttgctcaggctggagtgcagtggtacaatcatagctcactgcagcctccaactcctggtgtctctgtctttttcattttttttttgagatggagtcttgctctgtctcccaggctggagtgcaggggtgtgatctcagttcactgcaacctccgccttccgggttcagcaattctcctgcctcagtcccccaagtagctgggattgcaggtgcccacaaccac

SEQ ID NO: 398870 - DNA, 395 bp, Homo sapiens
tgcatttgctgttgagccgccctctcgctctatgtgtgtctttaaccctcaccttcccttggaaacctaacaagaagcaggagccaggaaggtaggaggaagacagaagcccatggtgttaaaaacagccacaggaattatgtagaacagtgattctcaaagtgaggtccacaaactctcggggctcccatgacccttgtaggaggtccacacaagccaaaatatctctatatggatactaaggtgttatttgttgatttcgttctcatgagcacatgaatgcagaatggagatttccggaggctaccggaaaggtgatattgcaacaaactggagaaacaacatcatgaaatttctccattttaatttctaataaatatcaatgtttataagca

SEQ ID NO: 398871 - DNA, 507 bp, Homo sapiens
tgaatcagggaataggtctaattttactctgtgaacagacttgttgaataattttagcttattacatgtatcacattttaggcacagtattatatgtgtacatcaataattctttcagttcacaatgctttgtgatacaaaggttattcttgctccttttttacagatgtgaaacctgaaattagtgatttgccaaaggaaatgatgagctgtgatcccaggtctgtctaacctatacttgtctccaaacggtaggacagtgtttccgttctctccatagtgagattcagcctctttaatgcctcttttagcaaaatattacaatgaactcttctccaatgaacagtgagcaatgtctccttgagcaaactttcttggatgaattgagatgaggcaactgaagaaggcattgaaaactataatattccttagaaattaagatttcttctcatcttgaataatggctcttacatcatcctaaagtataaaatactttttttctgaaaa

SEQ ID NO: 398872 - DNA, 305 bp, Homo sapiens
aagccgctttccttttgtgccaagtcaaaggccttagattgtaaaacacagggcactttgattgcaaaaacaaaaatagtggtaaggtagaattaactgacccccaaatgccttttcattaccaatatccttattttggaggacaatggtatcttccaaaatgaggcagtgtgacacagtagttagacctttagactgaatttgccccttactaggttggagcctctggtgaggagtttcacctctgtgcctcagtttcctcatgaagaggatgatacagagataatgttccctgtcatgttgag

SEQ ID NO: 398873 - DNA, 138 bp, Homo sapiens
catcattatcagcctttttggaatatgtccaggaaaagccaggatactcaataatgtatgcattcatttcaaaacatggaatatcttttcttggcaggcccagtgttatttgtaggagggtacagtaatgaacaatat

SEQ ID NO: 398874 - DNA, 253 bp, Homo sapiens
gttatttggttgctttcggtttggatgtgggagtttggaaaggctctcaggggaactccaatgcagtctgagcagccttgggaggcttgcaggtgctgaaaaggccttttatcttttcctcttactctcactcactctttctgcaatacttcaatcgttaagcagtcatttaaggcacaatagaagctgggcatggtggcacatgcctgtggtcccagctactcaggaggctgaggtgggaggatcccttgag

SEQ ID NO: 398875 - DNA, 121 bp, Homo sapiens
gaacacaggtaaaagggatgtgatctgaaaactgtttggtgtgtagaatggggagagaaaaaaggaagcaaattaaattgaaggaggaaatatggtaaatttaatttttgagtttattatt

SEQ ID NO: 398876 - DNA, 280 bp, Homo sapiens
taaaccagagcattggaagttggactagtgcaaagctttcaggggaccaaagtccctgcagggtcacaggtgcagtctgagccttttccttcctgctccacagtgcaggcattcctgcccctttccccaacatgaaacacagccacctctgtggtctctatcaggttgctaaatgattttccgaacctgagttagccagcggccctgtgagctgccagccatgctgagtgactgttctaaaagggcctgagctccttcaaacagcccatgtagaaggttc

SEQ ID NO: 398877 - DNA, 611 bp, Homo sapiens
cctgtcatatggcaaaggccacagaacaataaatgcatttcttttaaactgagaagtaactctgatgtgtttttacaagagaattacttccatttctctgtaatttcactgctttcaaatccaagagcaaaattcatacttagaatgacatttaaaaggaaagccaaacgggcttttattcattatatcacaacacttcttacttcattaaaacattctttatgcttgataattttcagattgataatacattaccagattaaggaataggagtatgatatacaatgatatacaactaacagtttttggttctttttttgagacagggtctcactctgtcacccaggctggggtgaagtgtatgtgatgtcagctcactgcagcctctgcctcccaaggtcaagcaatccttctgcctcagcctcctgagtagctgggattacaggtgtgagccactgcacctggccctttgactctttatacccactctgtttcccaccccattagtcaccaaattgattttcttggttttatctgtcttgtctctccctccttgccatcactgtcaccctaattcagtgagcctctgcttcctgcttggcctcttgcct

SEQ ID NO: 398878 - DNA, 423 bp, Homo sapiens
ctttcaagtttttccttttgattctcagttgccagtgcatttttttttgtcattgctaaggcgaagcatggaaagagctctctgggtacaatcaaaatttaaaggtagactaccatgtctaccttgtcatactcccaacatgtggaacccatgtgttgggaatatgacaatcaaaagagaaactctcaaaaggaagaggacattgagggtgatggcatcaggactccatgtattagcacttttttttttttcctttgagacagggtctctctctgtcacccaggctggagtgcaatgacactcaggtctcactgcagcctcaaccaggagagctcaagccatcctcccaccttagtactcctgagtagttggactacaggcaagcatcgccatgcctggctaacttatttttaaaattctttt

SEQ ID NO: 398879 - DNA, 460 bp, Homo sapiens
atcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttg

SEQ ID NO: 398880 - DNA, 363 bp, Homo sapiens
acgtagggatagtagtatttttggttggcttcaagctttgatgagtttttgtgtgttttgttttgttttactttaaaaacctgctttttaaacacgtaaatccttatttggctaattttcagggcacagtgtgagtataaactcatatgagagtctattgttctctagaaactacagattaaggtgtctttaacagactgatgtctaattattacataaaggcatctgatttttataccaggacacctataagcacattattatagaggtggaacatttgataactctgccatgctacagtctgtaactgaccttttgccttgccatggattctaccctaaggggaaaaacaacctgacatta

SEQ ID NO: 398881 - DNA, 411 bp, Homo sapiens
tcccttgtttctttgcctctctacttgctgcactgtgtacctgtccaggtgtgtggccctgtgaggatggctgcttcacatcccaggaatcagaccacgtggaaggaaccaggctcggtggtcaggacaccagagcccaagtcttagccccatccctctccaaggcaggcataactcccaagcctcagtttctccacctgggaatgactctagctcaatggtggctgtgaatatcaactgagatgtgagataggaatatatttcttagaagcccagaacactcttggaatgaaagtttattgtgatttacgagttatcagccaaatttgttttctttatgttgaaacccaacattctttcccagtccacataaatcaagtatgtgggaggagggggatttgatccactgcc

SEQ ID NO: 398882 - DNA, 408 bp, Homo sapiens
gagagttcggctcccaggaccttgacctcgctacatgggcagagaacgcccaggtgttgttgcaattgttgtgctggacgatgagtgcccgggggcgggggcgggggcgggggcttgacgcaggtctttgcagctctaaagctcagtttacaccatctctcaacattaaaatattgtgtactggggtttaataataaaactgtacagatgtgataatatactaaaactttcacttaacggaagaggtgcctttaaagaaaaaaccgcacaggggcatcatttgggctagtgaaggccctttttcctccttctttattaaggtataattgacaaaaattgtgtttacggcgtacacatgttttgattatgtgtatattgtgtcaaatatatacagcttctgaaaacaga

SEQ ID NO: 398883 - DNA, 296 bp, Homo sapiens
gaatccggccggcgtcggtgctgggaagatgtcaggtcatcagcactgccatcctcatctacccagtgcatatcaccaaagatgagacgactctctcatcttctgcctctaagacacactgcggttggttccactgtggtacaaacagcctacagctcctgctaacttgctacagtaaggtgatctcctctaaggtacctcctatacggtgatctcttcacaagcaccagtcaggccattttagaacaggtctgggatgttgatattttccttccaaagaaccctgatactctaca

SEQ ID NO: 398884 - DNA, 394 bp, Homo sapiens
gcatacagattaccataagaataaaatcagcaatataaacataggaaaagtaacagccctgaaattattaaatttaactcaaatattttattaaatacttactccatgacctggatgcaacaagacattaggagacacaagaggtacaaactgtggttcctgccctgacatcgcttactatctgagacagtagaaaactcgttaaattattaaagaacaattatgagccagactataaccaaatcccataatgagagatcatctgcaagtgcattggaagaggtaataggaaaaaaagggagagattactagggagcaccgtagttggagacatcttcagttatgaattgtggcctatcttgtactgtaaaggctaggtgatatttgaaggatg

SEQ ID NO: 398885 - DNA, 370 bp, Homo sapiens
aagaaacgagattgagaatcagattaaattgaaattaggcaatttttgtttttgccaaaagattcccttagaagaggaaaaggtcgggccgggcgcgttggctcacacctgtgatcccagcactttgggaggccaaggcaagtgaatcacttaaggtcaggagtttgagaccagcctgaccaacagtggaggaaccccggttctaataaaatagaaaaattggccaagcttgatggcgggtgcctgtaacctcagctactctggaggccaaggtgaggcgggagaatcacttgagcccgggaggtgaaggctgcagtgagccgagatccagcctgggcaccacagtgaaactccatctcaaaaaattaaa

SEQ ID NO: 398886 - DNA, 346 bp, Homo sapiens
gggaaaggaagataagacaatgagggcaatgttgggcatttcttggattcttcttcagttgtccagtgattgtcacctttcttggcagatgcaagagttcagtgaatgaataaaatagatatttggagtgtgactctgaacacctctcgtcaaatatttgtttgagcctttaaagagtctcgtggtagaagcaggtgttggcatctctctgaggccttgtacctgtgaggaagaggatttgggagacgggagaggaagcacaaagcagcagtggagtgaaccgctggtgtttcttatttcacatgttttcatctcaaagaaactctcccttagagcacccagtcaa

SEQ ID NO: 398887 - DNA, 427 bp, Homo sapiens
actcaacgccctctgtgtgctcggcactatgtgacacactttcataccttgacatttacaaccagcctgtcagctaatattgtcttccttttacaaatgaggaaactgagattctgtgagattaagtaacttcaccaagagcatgcagtttgactgaaagcacatttgtgacatatgggtcaaaggaactaatatttcatttgtcataaggcctggtgagtcaatatagcctagtgatgaagagtttgcctgggctgtgttttaatccatgccttagcgcttcaagctttgtcacttaggcaagttacttgatctttctaagtttcagtttccttaatcttaagataaaaatgaaagtaattcttactctatagtaaatggcaagcccatggtacatagtaagtgctcagtaaatgtaagcttaagg

SEQ ID NO: 398888 - DNA, 693 bp, Homo sapiens
ctctgtcggccaggctggagtgcagtgacacgatcttggttcactgcaacctttacctcctgggttcaaacgatcctcccacctcagcttctcaagtagctgggactacaggcgcatgccaccatgtctggataatttttgcattttttgtagagacaggattttgccatgttgcccaggctggtgttgaactcctggactcaaacgatcacctgccttggcctctcaaagtgttgggactgcaggtgtgagacaccgtacccagccttgttttgtttttgaagatgagctgaggttatcagtggaaaagtgatttggaaaccataaaatgagatttgggaatgtaatagagaatcaaggcgaagactaagttttctgggagtttttaaaaagattctttcgtgactgtgattctcagaaaaggtttgaggcttactgactagatagttgattttcaattttttattcaaataattttgcatttgttgtgactctttcttttgcaggtgacggaaatacaattcagacagacttaaccaagagagggactttattgactgagtaactagaaagcctagaagtagttctacttttagacacagctagacacagggaggtaaattatgtcattaggactcactctctccccctttggctctgcttttctttgtacggtgtcgctatggggcaggc

SEQ ID NO: 398889 - DNA, 239 bp, Homo sapiens
gctttgggttgaaatagaaacttcagcctaaactgtcctaggcaagcaacaagacaatgtctgggctcacaaatgataattccagagaataaggaaagcatgctgcagttggggctgtactggagctccattaaggtcacctgttctgtttccttccctatctcgcttggctttgcctgctgtggagagctccatatttaggcatgtttaggcccttgtgtttacaatgtggctgctcc

SEQ ID NO: 398890 - DNA, 575 bp, Homo sapiens
ataaacactgctgttttcaaggttctatactgtgaactcttaagtgtttaggtaaatgtaggtataagccctcctacaaaggaattcagtttgataggagagaagataccagcacagactttccaatttttgaaaacaacagtggaagtctgtagctcctaggatctcctatcctagatctcttttcccctccttagccagactacctccagagaaatctctagatccattgcctcccagtcattccccaacaggccccggcatacagtaggagcttggtggaatgtttattaactaatgaatggtcaacacaggtaaaaatacaaaatgctatgaagtttaaaggaggaagagatcacatggctattaactagcatttatttaacaaatgggtgttggttttctcaccctaatacaatgaagttgtcagttaaagattagtttatcttaatgttttcatttgttattttctgaatgcctatatgcaggaaaatgcagatgactctgatggtataaaagtctgttcattcatctaaaagaactgtcataatgggggtctagatatcttttgttta

SEQ ID NO: 398891 - DNA, 287 bp, Homo sapiens
atttttaagaattacttttggtttcaaccacagtttgtagcacatatgtctgtgtagcatatttgtacatactccttcttttgttcgtgttgaaccaagaaaatagactggtagtaattctactttgttaacactcccagattaaaagaatatgctatattaatgctctatgtggaagttagagtgatatgaaacattattttcttagcaacttagttggattggctttctttcctgaaaaccacacacaaaggctattttagtgtactgctttggtttaattttct

SEQ ID NO: 398892 - DNA, 434 bp, Homo sapiens
gttcacatgaagctggcatgcttcatggttctttctttgccgcttcctcggaatcagtgcaggatttccaggatgccagaagacagctcaggatttggctcagggattcagcttaaggagtgtctgtcaggaaggctgtgccctgaggataaggaaatgcaaagacaaagacagagaacaccctcttgggaaggaaagttggccttgcccttacccaagactgtgccagccaccacagatgagaagcagcattctccccattctcacctcaccaggagctttgacagacctgagctgctctgcccaacagaccccagggagtgcccgttcgcctcatctggtttatgtcacattgttctgccttgagtcctgtcaacacctgtatctgaagaaaagccagtgtggataacaggttctggaatcttccctcccac

SEQ ID NO: 398893 - DNA, 500 bp, Homo sapiens
cagtgcattgtcgcagggattagatgacacaggcggtgtgggcttctcagccctggtctggtgcatagtgggcatttggtgaagggtgtagctgttgcttttctggtgccaggtggagctctggctggattccaagcgtgtggcaagggtgaccaggcacgcacctgcagctgtcttcatccacgacctgcccttcctcctacctaaacccagctccagtttcagagcccaccttttccttcctcctcagagacctctctcccttcccactggtctgttccctctgcctcagtctcccaaacagccaatgttttcctttagagatgttctgaagcacaatgttgacaagcctagactctggggccacactgtctgggtgtccctcctctgccccttacctcctgtgcgatcctaggcaagttccttagttgttctctgcctcagtttcctcatctgagagaataaagagcccactttatacggtggctgtaaagaccaaa

SEQ ID NO: 398894 - DNA, 362 bp, Homo sapiens
tgacccaggcaggtaacccagtgaagtgggaagggtggactgcagtgaacacaagctttcaaagggtggtcctggagaagcagctatttcaaaaccatgtgggccaaacatttctatggaacagataattccttgaagcccatctgtaaaactctagttgatgggagtgtatacttttaactccattctttaaacatataaactactgttttgaatcttgctgaatgctccatcatgtatcttggactcctttccctatgagcacctgtagctctaccttagacttgtcagtgtccacaaggtactccattgcatgggtgccccaaaatgtatccacacagcccccagggagagagatttgg

SEQ ID NO: 398895 - DNA, 98 bp, Homo sapiens
tggaggtggcaagaaggatgacaaggacaagaaaaagaaatatgaacctcctgtaccaactggagtggggaaaaagaagaaaacaaaaggatcagatg

SEQ ID NO: 398896 - DNA, 218 bp, Homo sapiens
gaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtg

SEQ ID NO: 398897 - DNA, 427 bp, Homo sapiens
tgtcttttctttatgctgaaaacatcctattataattattctcctccgactattttgaactgtacattggattattgtaaattatagtcaccccactgatctatccaacactaggtctcatttcatctctcaaacggtgggtttgtgctcattaatcagcctctcttcatccctcctccctgctgccacttttgcgcctttaatctatgtgttatggggatgtccatatttgataaaactctgtcccattcatggcacaagctgcaacctaactatagtagtttaaaatactgtgaatgaaatatttgtcatacatctgcatgattaaattttcttcgtgaaacgtaaagccagaaactcagtgcatgtgagttataaatccgtggtggtactgatagcttaatcctgcatatttcaaagaatcaaa

SEQ ID NO: 398898 - DNA, 484 bp, Homo sapiens
cccttacctaaaaccttctctaagcatagttctcccaagtcaaaatgattccttggtaatattatggacattttagaaaacccagtaatgcattcaaaactttggagaattctgccaaagtgtaatctgttttcaatcacttaccatttactgagttcataacaacgggccaggcaatagtggcagatgatttaagacgcagtccccgaccttgtgaaagtcatggtcactctaatggcatgagataaacatatgaaccaatagaggaggaaatgacattacttgaaaccactaaggtggctccacagaggaagtgacatccaatccaagacctgaaggatgacaggagctgggcaaagaaggcaaggaagacagccagtgtaaaggagcagtgccaacaacatcaagtacagagtgcaaaattaggcagaatccaacccttaagaactaagccaagcagccaggtgcggtggcccatgcctgt

SEQ ID NO: 398899 - DNA, 129 bp, Homo sapiens
catcatcattccccacccccatccccgctaacaacccagctccaaccaggtctgggcaaggttatggcgccctcggaaacggagaaagggctcggtgaacagcgcggcgcacagacatggcggcggccg

SEQ ID NO: 398900 - DNA, 274 bp, Homo sapiens
tgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaataaaaaattttaactccgatccaact

SEQ ID NO: 398901 - DNA, 280 bp, Homo sapiens
gtaaagacagggtattgccatgttgcccaagctggtcttcaattcctggcttcaagtagttctcctgccttggcctcccacggtgctgggattacaggcatgagccaccacactggccttgaagtacttttaatgctttcaaaagtccagatgccttgaagcagcatcaaccaccacacagaatggagatgaggatactaggaaaatgtgtaactacaccttggttactgcatccaatggttcagtcattagaatatgcaaataaattgttccaacttca

SEQ ID NO: 398902 - DNA, 388 bp, Homo sapiens
gctgaggaaaccaactgccagcactgcagcagcaaaagccctgtagttttttccaccttcacagtctccaggtgcctggccctctaatttctccttcctctgtccctgaaaccacctaagctgttcaataccatggtcacccagaccagacccagggactcaccccagtggccatcgcattctctgggtgcctaagccaatacccctcctctatggagtcaccccagctgctgcctctacaagtgctctgagccaaggacccagcacagctaccatgcatgtgcctgcacacagccatgcctccccatccccaggttctaactccagcatcacgtttgcaccctcagctaggccccgcggctgcatgtgcacacacgcctccagctca

SEQ ID NO: 398903 - DNA, 409 bp, Homo sapiens
tccctcggtgctcttgatgttgctggatttctgcctatagccgactggttctccttagaagaaatgcccctttgagcaatgcattctgaagtgtctggcctaggctggcgctgtgctgtcttgggcctgtctcaatcagggcccatgcccaagaggaacaaagctccttccacaaagaataagtgaggccatgcaaccttttctgaggggctgccgtgtgccaggtacccagcacaatgtcacattcattataacccagccttgtagacacgccaagcttccagcacctcagtgccttcacgtgtgctgttctctgtgcctggagaacctgcccggccacagatcccttatctccaggtcgcagcctgttgatcagtcagggaggccttttctggcctttcgtcccccg

SEQ ID NO: 398904 - DNA, 476 bp, Homo sapiens
ggcagctccctatgttgctcaggctggtctccaactcctgggctcaagccatcctcctgccttggcctctcaaaatgctgggatttcaggcaagagccaccacacccagccaacctgtgttgttttgaaccaatctccagttgttcacatttgtgattgactgggtttgttgttcttgtcatttttggggttttttttttttttggtttttgtttttgtttttttgctatttataaatactgcgattgagtagtattgtagaaataagttaagtttgggtcaactgattttttttaaggatgtgtttcttgaatctcctacctttcctttcagtcctttcctgattcttcttctgacttctttcatcatctttttcctgcttccaaaatgtatgtatcactgaagcctcaactcctattcctttgcctttacctaccgcttcctaatgttctcatgtatccatactgagtccctgt

SEQ ID NO: 398905 - DNA, 876 bp, Homo sapiens
gttaggtatcattctgtgacctggaggatggtgccaggaatagacccttgcccagcttccattgtctcagtgaacacactgaatcattttgttggtggcagtgctgctgctttttggtgtaagacaggtggcattttctgacctaactggttattcagttgctggggctctctttggcgtggagtgcctgtgtgactaggtgacctgttatttatgtgactggaagaacaggttgaaatgttggcattagatgtgcactgctgccttccttctgtggcctcttcgtcagaggcaggcagtgtctttggaggtttactatggaatgtgcactgagcaggcatgttacaccttctgagtcttggatctggagttgctgggaatttggtcttgaacagtgagtacttttccactgtaaagcaaaactgtacacttactcttgccagcacatgccagctgtccatagctttggctctgctgcattaacaagtttaaatagggtgtgtgtgtgtgtgtgtgtgtgtgtgtgtgtgtgtgtgtgtagcaggaaggtcaggacagaggtaaaactatttggcaacacttttcctggagtggagcaattgccttcacttaagagaggggaaggaaaaagtcattaaatggagattaaagtaaaaacagagaaggaaagaagaaaatagtgggaaaaaaatggaaaacattgaagggctttgagaccccacagtgttattttatttttctaacttttttttttcctgtgcttctctggcacctagatacttcctacaatttgaattcctttaactgtcatggagcattgatgattaaccagatgaatgaagtgtttggcttaattattgagacagcatgtgcaca

SEQ ID NO: 398906 - DNA, 209 bp, Homo sapiens
ttaaggctccacccttacaacctcatttaaccttaattaccttcttccgggctctacctccaagtcacattgggggttagggcttcaacatataaatgctggggatacacaattcagtccatagcgaacagcaatggaacaccatttgtgttcccctcacacatgcagctattcactacttctcactacagcatatttgagtgcctact

SEQ ID NO: 398907 - DNA, 587 bp, Homo sapiens
ttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttccctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggt

SEQ ID NO: 398908 - DNA, 405 bp, Homo sapiens
cagccatcaccacattcaagacacggagcactccattacccagtaacttcccttctgtcctatctcagtcacctaatacctcccctcaccttaggcaaccctggatggtttctgttgctggataacagaattgtcttttctagagtttcatctgaatggaatcatacaattatgaatgaaaaacacacaggtatactgttttgtgtctggcctctttggctcggcataatgtctcttcagatcctttcacattgttgcatgtatcaatatttcattcgtttctatttccgagtagcatttcattgtatagatatatcatcatttgcttatgcatttatttattgatggacatgtggatagtttccagttgttggctattatgaataaagctgctatgactattcg

SEQ ID NO: 398909 - DNA, 1403 bp, Homo sapiens
tgcctaacttttaattttaactattgtttatctgtatgcttaatttggctttttattttttttgttttcctagtgcatttggattttacttagcttttattatgaagccatgtgtttcagtttttttctgtatgtgtaggtgattgggcttatgaattgatcaggagcatggaggaataggtacatctggattagcgagtgtgtgaattcttgagctgatgggcctaagctctaaaggatagattagttgtcagcatattctggtctagatagtatggcatagtttttaccagtatgctttcttttccccatcttcccagtttgctttttactctaatggcttgaaaaagtataggttaggttggaagtgagagaacaaaaatctgctaatttaactctgaacaaggaaggctttaggctgatgtttgaaaagtgtgttccatggaatactggtctcctgaggtagtctgagaaaagaagggtcctgtagtccaggaagttctgcatactccttttgtgaattcaggatgtgttgccatattaagtctccaggatttgcagtcaagaaagttaacttggtttaactgagcattttctgaaattacttggttaaggaaatacggtttttctttcttttattcttggtactagttctgaggatatgttaagggaaattttaggggattgttaaagatctgtggatccttgggtggaggcaggtttaaacaataattgtttgggaatcttaattttgaatgagagtgctggctcaagtcaaatcaaagtaccccttggaaaaaaaaaagttatattattccacttaggttgggcttcaggtttcaattgaaaggaagcaagaaaactgtccttgtctggctttcattaaataacaattcagtcaaatgatttcagtaatgaattttgtctaactcaaatgcatttgttatttaaataaaaattaagatgtgctgttttttaaaaatgtaattctctaaataaaaaaaattaacatagaatcctgccagcttaaacatcaaactgaaacttactttaaaataggtatatacagagaaatatgctcatgttgtaactcatgcctggtttactaaatttgggaatgactgaattgtgaggtgaagaggaattagtaaattttggaaagaaaaatacttatctttgttaggtcatttaaacaaacattaagatgcaattttgtgagatctgtcagtaacaccggttgttttctgtgaacttagattttaatctattaatagaatatattatctcccctcattcagttatatcataaagttttggtgacctttgtagcctttataaaagggaagtctaagggtggatagtagaatagcattttatttggaaggccctaaagatttttgtaa

SEQ ID NO: 398910 - DNA, 467 bp, Homo sapiens
cctatctgaaaatgttgagtaaatttctgctatgactagtagattcaggagattaaatttacttaatcgtcagtacaaatatacctcttcttatgtgctctttatgaaaataaacacatgaacaaaaactgagttgatcttcctaaaatggacacattcatacaaagctaaatcatcttctatcacatactgaaggcaaatgatcgcatacttagaaaaacagaggtgtatcttgatgtagtgtgtatacttagtattatgcctgacacttcttcacactgctcttcatgtgttcacaagcatataaatgtgcaactccatttctataaagtcaaattcatctaacgttacatagtctggttgatatttctatatcttttcctcctttaaatgtgactagctatttacgccataacaattctggtgtagcgctgatttagcatttttattggaatgtgaaagctctt

SEQ ID NO: 398911 - DNA, 106 bp, Homo sapiens
gaaaatatatataatcagcaacacctctgtgaaattgggcaaatgatttaacctccctgaattgagtttccttatctgaaaaatcaggataatcattcctgctctg

SEQ ID NO: 398912 - DNA, 423 bp, Homo sapiens
  misc_feature (421)..(421): n is a, c, g, or t
gccgaaaagcaactcacgattctgccaagtgacctgaaatgccaatgcagatgatctctgacttaccctggtttgaattaggatttttttacttttatgttggatttatcaggacataattccatcctcagtggaggaacatctggacttaaaatggttcaacttacaacttttcagttttacaatgggtttttcagggtattaaatgcattttcaacttaggatatttttgatttccagtggatttattgggacatagccacatcataagtctagaaacatctgtcttagaaactcacagcgtccgaaatcttcaaagacatcaacaagaaattttagcacccttgccccaacaacacaccagcgccaacctcaccggacaccccccgattttcccacggtattagacaaggagagccanag

SEQ ID NO: 398913 - DNA, 353 bp, Homo sapiens
tttgagatggagttttgctcttgttgcccaggctggagtgcaatggtgcgatctcagctcacagcaacctccgcctcccgggttcaaaccattctcctgcctcagcctccagaagtgagactgtctcaaacaaacaacaacaaaaaaaatcagtcaattctcctgactctaggatcaagacagctgtactcacggtaccttataaatggctggtgctcaacatatagtagttgaataaacaaactttcttttaatcagtagttcccaaacctggatgctcatcagaaccccctatggaatttgtaaaaatgaagctccctgaaaagcccactccattcacatctctcgaatca

SEQ ID NO: 398914 - DNA, 198 bp, Homo sapiens
acttcttagctttcctcagatcaggaagtgaatatcatcttagacactttattacaaaggatcaaaaatataaatagattcatattgtaatatttgtagttatctgggagacttttcttctctttttacctatagtggaataaatactataacagtttttgagtatctgatatgatagcacttgatataatatgatgt

SEQ ID NO: 398915 - DNA, 633 bp, Homo sapiens
gaaaaggatgttctttagcaacctcactcgtttgatccattcatcctgtccggggtaaggggtgttcccagtgtatcggtggggcataaaaaggggagtaaagcctggaggaagaaatgaaaggtgggagagcaatctggtgggagagaaggggagaacggagacatggagagaaagggggagttcttttatgtgtttagtatcccaaggaaaacaagggttctatatatgtaaattatttcagataactagtattcaactctttttcttcaaatctctctaagggattcctcgtgtgcctgcctttggggtctgaatggctcaggtcactcctgtggccaggcgtcctgccacactgcctctcgggacacgctccaggctgcaacaggctcagagctctctgccttatacagtatataagacagctctggtcttccgagctttttatagatgctctgtctcctcccttactgtcaggctgtcagctgtcacttctagatgttctcccagaacgtatacctagcagcctagtttgttgcttctaaatctagtgaactaaaaaagcagaaaaccaaacttgttagaaatgtggctaaagtaagagcacagaagctctacatggaagcccaagga

SEQ ID NO: 398916 - DNA, 340 bp, Homo sapiens
atatctacataaccatgatcacatcagcacttcttaaaatattatggtctgtacctcaagtgagttgaacagttaccatatgacgcagcaatttcactcctagttatataaccaaaaaggaacaatttgaaaaaaaaaaaacaagaaaccaatcccatttacaatagctatcaaaaacaacaacaacctaggaatcaatttaatcaagaaggtaaaagacctctgcaatgaaaattacaaaacactaataaaagagattgaagagaacacaaacaaaggcatcccatactcattgattagaagaattaatattgttaaaatgaccatactacccaaagca

SEQ ID NO: 398917 - DNA, 1128 bp, Homo sapiens
gacctttgtctctcgctgcatctggagctctaggtcgcctcttcgctactctgtgtcctctgctcctagaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcatgcctgtaatcccagcactttgggaggccaaggtgggaggatcacctgatgtcgggagtttgagatcagactgaccaaaacggagaaacccagtctctactgaaaatataaaattggccatgcatggtggcacatgcctgtaatcccagctactcaggaggcttgaaccctggaggcagaggttgtggtgagtcgagatcattgcactccagcctgggcaataagagtgaaactctgtctccaggaaaaaaaaaaatttatttgtgtataactttaaaagcagatttttggaagcattgtaattacattaaaagtatacttgttccagctgcgtg

SEQ ID NO: 398918 - DNA, 764 bp, Homo sapiens
gacctttgtctctcgctgcatctggagctctaggtcgcctcttcgctactctgtgtcctctgctcctagaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagttgtgtgttctcattttgcccaagaccttttatgctctgctctgggagctacgagtagccgccgagaggccgcggagccagcgacgaccgacccagccgagccgccgccgccgcgcgcccccatggcggccgccaaggacactcatgaggaccatgatacttccactgagaatacagacgagtccaaccatgaccctcagtttgagccaatagtttctcttcctgagcaagaaattaaaacactggaagaagatgaacgaggaactttttaaaatgcgggcaaaactgttccgatttgcctctgagaacgatctcccagaatggaaggagcgaggcactggtgacgtcaagctcctgaagcacaaggagaaaggggcatccgctcct

SEQ ID NO: 398919 - DNA, 659 bp, Homo sapiens
ttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtccctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaa

SEQ ID NO: 398920 - DNA, 443 bp, Homo sapiens
gccacagcacatccaggaatcagctacagccaaccaaccaatcagtcaagaagataaaggtggggaggtgctaggtagtaatgattagtaaatgatgcctgtaaacaggagtggcttctttgttgtaggagttgagtccttcactccattacgaagctaaccatatctaccttgttccagttccttcccttgagcactggccaggtttttaggctactgtagtgtatttcaaacttcagtacctcaaaagtttctccttagagagagaaattctcatgaactctcttgctaaagtaaatacgttttcttagagtgtggtttatgtagcaccaaaattaagatcatctgtacaccctttatgattataacacttacctaactatgaaacttttatatattttaaatataataaagcaataaaccaatgttcaaatggactaact

SEQ ID NO: 398921 - DNA, 659 bp, Homo sapiens
aagccatctgtgaagggaatcacttttcttttctggacttgtttccaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatctacctgttctccttgaacttcccagctgcctttccaacccatatcttcactccatttttctctccaatccaccctttggtttgtattgtatctctttcttctgcttccttccccctcctacccacctttgcccctatttattctctgtagctatagcttcagaagcatttttacttgcaagacgatggacacattccccttgggctttttgtaactgaaatgcaccacagaagacagggagtcatcgaagggctgctcggggaggtggcagggcggaggaactgcttgggaagaaactccaagaagattggaatgctttcgcgggaatctgtctcaatgtgggactcagtggtgcagcggaggaccttgagcagagttgcctgtgcgtggg

SEQ ID NO: 398922 - DNA, 3688 bp, Homo sapiens
tacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagtattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacgtgataaagctgttgctctggagcgggctatagatgaaaaattctctgctctagaagagaaagaaaaagaactgcgccagcttcgtcttgctgtgagagagcgagatcatgacctagagagactgcgcgatgtcctctcctccaatgaagctactatgcaaactatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacattgctctgcaaacttggaccagggcagagtgagatagcagaggagctgtgccagcgtctacagtgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcaccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagctttacccctcaaacatgggagaaaaagtttcagcattttaattcaaattggtaaaaggctgagcaacccttaaagctgccataatggaagaagactgtgagctagcttaaaaaagagagaatgaaggggaagaaacaaaacccctgtgtggcagagtgtcgagatgagatgagcatttatttgtctccgtcgaattccttacggagataaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatctacctgttctccttgaacttcccagctgcctttccaacccatatcttcactccatttttctctccaatccaccctttggtttgtattgtatctctttcttctgcttccttccccctcctacccacctttgcccctatttattctctgtagctatagcttcagaagcatttttacttgcaagacgatggacacattccccttgggctttttgtaactgaaatgcaccacagaagacagggagtcatcgaagggctgctcggggaggtggcagggcggaggaactgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagtactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagaaaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattatgagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataac

SEQ ID NO: 398923 - DNA, 2047 bp, Homo sapiens
aagccatctgtgaagggaatcacttttcttttctggacttgtttccaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatctacctgttctccttgaacttcccagctgcctttccaacccatatcttcactccatttttctctccaatccaccctttggtttgtattgtatctctttcttctgcttccttccccctcctacccacctttgcccctatttattctctgtagctatagcttcagaagcatttttacttgcaagacgatggacacattccccttgggctttttgtaactgaaatgcaccacagaagacagggagtcatcgaagggctgctcggggaggtggcagggcggaggaactgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagtactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagaaaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattatgagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataac

SEQ ID NO: 398924 - DNA, 684 bp, Homo sapiens
ctcacaagtccatgaggcactttctattattcctttttatagaggaggaaacagacttctgaagctaagtaacttgtccaagctaacatagctaataagtagcagatccagtatcaacctaggcagtatggctccattcctccaccatgtgccatcagttagtacagaaatagaaaccatcgctatgatagcaaatatagtgtttagtattcctttcagcttatcgttttatgcttccccctgttaagttacactggggagaaaacaaataaatgaactgagtgtccatttatcctcatctaacattaattgttacatgccctgaacaaataggaaaaagacttatttcagaaaacaatatgtatgtaagtggccaccagagatagttttctgtatggtttgtattcattcctgggacatgtatttagagacttctgtgtagcaggcctatgctagatctggtaaaacaaaaatgagtaaaacatgatacttattctcaagaatctcacacctccttcttctatgatagattcttataagccctttgatatttagcagaggcatttctttcctccagaagcttacagtgtcctttctgcattaggatcttagtgcaacattgctctgcaaacttggaccagggcagagtgagatagcagaggagctgtgccagcgtctacagtg

SEQ ID NO: 398925 - DNA, 3844 bp, Homo sapiens
tacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagtattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacgtgataaagctgttgctctggagcgggctatagatgaaaaattctctgctctagaagagaaagaaaaagaactgcgccagcttcgtcttgctgtgagagagcgagatcatgacctagagagactgcgcgatgtcctctcctccaatgaagctactatgcaaactatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacattgctctgcaaacttggaccagggcagagtgagatagcagaggagctgtgccagcgtctacagtgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcaccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatctacctgttctccttgaacttcccagctgcctttccaacccatatcttcactccatttttctctccaatccaccctttggtttgtattgtatctctttcttctgcttccttccccctcctacccacctttgcccctatttattctctgtagctatagcttcagaagcatttttacttgcaagacgatggacacattccccttgggctttttgtaactgaaatgcaccacagaagacagggagtcatcgaagggctgctcggggaggtggcagggcggaggaactgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagtactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagaaaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattatgagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataac

SEQ ID NO: 398926 - DNA, 169 bp, Homo sapiens
ggaacagggtttcttatcactcactattggtgaatgcatacttgtggcaaccactttgaaaaacaatttggtagtactaattaaaaatttaaatgtccttatcttttttttgagacaggatctcactctatcacccaggctggagggcagtggcacaatctcagctcac

SEQ ID NO: 398927 - DNA, 457 bp, Homo sapiens
acagagtctgttgcccaggctggagtacagtggcatgatcatggcctgccgtcacctcaaatttctgggctcaagcaatcctcctgtgtcatcctctggagtcgctgggattataggtgtgagccaccatgcccagctccgatctttaaaaagtgaatcagttgacaatgtttaaaatttaagatgttacacaggcacacaggcgtgcacacgtctagatttccatcttgttacaaaaaaactttctcagtacctggcctattccccgatctggcaactctcagctagaatggagtgtgggcttctgtccctaatgtttggggaaaggcttctcaattcatcatagcccccaaaccttgatgagcctgaaggtcaggaaacatttgagctgctgttttttttttctaataggcgttaaggggaaagtgaaagattgttgggctcaggattctatcaa

SEQ ID NO: 398928 - DNA, 241 bp, Homo sapiens
gtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactctgcctagcagtttcccctgacgtgggtccatgtatggcaggcatggaaagaggaatcctcactggctcagccatctgtct

SEQ ID NO: 398929 - DNA, 132 bp, Homo sapiens
agagattgacaaagagttactgtttatagttaatcttgttctcattaattttttgctgcttattcagtggttatttttattagtttttactttctggttttatgaaataaaatatttagattgagattggca

SEQ ID NO: 398930 - DNA, 409 bp, Homo sapiens
agtgtccacacctgtaagatgcccacagctagagcttggattgcaaccttcctgttaaatttcttaaggccaattaaacctatgttcactggatattgaattacagggggtcccaaagtcagcattgcctcatttatttccacacatctcccaaagctggttagcgtgatggtctttgagacccaactggtgggctcctgagtttccttctgcccctttctgtagggtaagcgtgagctgttatttgatgcttgctttactttttttaagtaaaagctgttcttaaagtgactgacgtgactttccacttagtcttttgcagcttaatagtgaacgccctcagaaggaccagtctctatttgaactgatttgggaataaatctgtttattcctagaactaactatgact

SEQ ID NO: 398931 - DNA, 600 bp, Homo sapiens
gtagtcccagctactggagaggctgaagcaggaggatcgcttgagcccaggagttcaaagttacagtgagctattatcatgtcattgcactcaagcctgggtgacagagtgagaccttgtctctatttttaaaagttgttgtgtttagtgcaagagaccagtgctgtagtaccagttcttgatttacgtatatgaatatataaaacctgtgaggacagaaaaacaagaactagagggagaactagcatacaaaaaaactgaataaagctttgtattcccaaactgaaagaaagaagtacaatttttaaaaattttgtgacattctaataaaatatcttccaagaatacactaagacaacagttcgtttatgttttgaacaggtcactcactaatcaagaaagacagtaagacgaggagttccctcaacacgtggtccctccccatccagatttctggtttctttagaccattccgggtctaggtgtatagacaagaaatggaaaacatgggaaactggaggccagtacctcagtcacttccacattacctacatacacaaagattcactgtgatggggattaaaaccattcagggctgac

SEQ ID NO: 398932 - DNA, 326 bp, Homo sapiens
tctactgccagacattatggagctccaatttatgttatttcttttctcttgttgcttttagaatgttttcataatcaaactcccaaatatcaaggataattaaatgtcttgaggtagttttatttgggttaaatctgcttggtgttctatgacttccttatacttgaatactgatatcttattctaggtttgagaggttctctgttactatcactttaaataaactttctacccctgctctctcactacctcccctttaaggccaatgattcttagatttgcctttttgaagctgttttctagatctttcaggcatgcttcactct

SEQ ID NO: 398933 - DNA, 393 bp, Homo sapiens
agccactgaccaccctgcctcagcctctcatttcctactccaccaagaacaaaactttgaagccgccacacactcctccctgctccctcatttctccattcctggatttgtcccagcctcaaggctctgaaatggaagcaaatgaagctgagagctcccgccgcctgcgcggcccagagcctcagcaggttttgaggttggaaagggccaccgggaagatgaggcctttcaccggcctctgcctgcagctgacaccaattgattgattgatttcctaattgtctgcttaatcctctacaagagggtgggtttattatttaagcaagtcaactcaaaaatagcaaaacaaagcagcctcccaagaaccagcagcagctgaggagtagaacaaaa

SEQ ID NO: 398934 - DNA, 478 bp, Homo sapiens
tggaacattaagtaaagaatccctcattataggatgcaattttgctcgaatgaaattcatttcaccagataattaatgtagtatgtaatcaccttaaattcttcttaatggtgatgaacctgtggttttaaaaaaattcctcttagttagtcactccctctaaatcccattagcttttgtattcttttatttggggacaataacaactttattgaggtatgattcacccatttaaaatgtacaattatgtggttgtcagaatattcagagagatataaccatcaccacagtcaattgtagaacattgtcatcactgcaaaaaaagaaaccctgtaccctttagctattgccttcctgttttcccattctcactattcctaaggagccactattctactttctgactatatagatttgcctattgccagcatctcatataaatggagtaaggtaatatgcggtctcttgtgactggctg

SEQ ID NO: 398935 - DNA, 623 bp, Homo sapiens
atcatttttatgtaaagtaaatcattacagttattgctgaagaccgcccccatgaaccccaccctgcccatctcttcctccatgccccaaagtaaacactgtcctgattttgattttattctcatatgtgttttgatatatgtgtatatattcacaaatgatatatgattttgttttgcatattttaaaactatataaatggcattagacatatcatttccccacttgcttttttttgcccaacttactattttctgagatttatgcatgttaatgcatgctgtgtgcacccattcattttcacctcagcagcatattccattgcacgaatgtgctgtcatttgtttattcattccactgtcaatggacgtgtaggttgtttccaaacttttgcttttataaatagcggatgcagggaacgtttttacatgggcaagaattcctctaatggatataagtattaatgctgtgttatgggtgatacacatctccagctaaggaaatgttgctaaatttcccccaacgtgcttgaactaacttctactgtcaccactagtctgaatttcagtgtggccgtgcccacactagattatcaacctgtttacttctgactctgatgggtg

SEQ ID NO: 398936 - DNA, 739 bp, Homo sapiens
ggggcgcgggcggcggcgaggctgcccccgcgaggaatgcgggatcctggggttccccgcacgtggctggtgcccaggcagttccgcggttgcttagagacgggactgtggctgccctcatccccattgcgtctttttttttttttttttttttttttatcccccccccggcctttctataattcctcacgcggaagggttgggggccatctccctcttgagaaaggtcctctggggagagggggggcccgggggataaccgcgccgagagggttctctgggggcgcgcctatggaggacctgccctgggcggcgccacaaaaacactttgtgcgcccgcccatttttttccccccaggggtccctctcttttgggctcgtgatagggcgccctcttcctacgcgccacccaatctcgagggttccccgttgttgcaaccgggagaacaacttattgccgcgcagagtgcgcttcgaaaacgtgggcgatctacgtcgaacaaaaattgtgtgtgccccgtggagcccccacacactttcttgctcctcccaaattgcgcgcgctactcaacttacggcgcagcactctcattgttgccccccccggcaacacggtttccatacagaggagaccccaaatataacaccgtggcaaaggaaggggcggggcaccccctttgggggcacattcctgtatcaaccctcccaccgtgttgaccccggtttaacacccagcttt

SEQ ID NO: 398937 - DNA, 399 bp, Homo sapiens
cagcagaaattattttcccatagttctggaggaaagaagtctgaaatcaaggggtcagcatggttgcgttctggtgagggctctcttcctagcttgcaggcaaccaacttctcatcgtctccttacatggcagagaatgtctcttcttataagggcacaaatcctatcatgaggattccacctcatgacctcatttaaaccaattatctcccaaagacctcctctccaaatgccctcacactgggggtttgggcttcaacatatgaatttaggaaggaaacagtccagtccataatagtcacattatgaggtactagaggttaggactaaagcacaggaattttgggggctatacaattcaacccataacagtctgcgttctggccccactgagataaa

SEQ ID NO: 398938 - DNA, 272 bp, Homo sapiens
ctctactttcttacctgggctttgccaatagtagagcttgtgacctatctctgggcccagcacctagatgttatgactctcccgcctggtccatgcacacaaaaaagagagtgacttatactaggatcaacacacaaatgattctattcttctgcattatcccagcccacatggcttattgtgacatctctaggttcatcatctagatgatatgactctccttcctgggaactgtccataatgaagattgtgacacatcacttggcccagca

SEQ ID NO: 398939 - DNA, 349 bp, Homo sapiens
aaagggtctgcaaccaactcaaatgatcgattgaaaccaactcatattactgatagcactgaatgtgtaccaaacctcaggccatgggtgcctgagtcctagtgttcctatgacatcccctgggagtggtggaactctacctttcaatgatgggaagtcttgggcaagagcaggtctcctccccttgtccagtatagacagcttttgtgtctaactctgcctcagcagctggcctatacctgggggcaagggttggacaggtttctagctccaacatcagtggtagatgccttttgttttatgtgagagaagcaaccacgttttgtgcctgtgctctggtggtgctcta

SEQ ID NO: 398940 - DNA, 361 bp, Homo sapiens
gcagacaaaatatttggcattgtttcaggagaatggtttcctaatcctagtacatccactaacttcctatcagtacatctatgctctcagtggcaaagggaagctgctaccacctaatctgttttttacaaagttgttctagcaagtgatatctttcttacaaatgcaagtgacacaacagcaacgctacaaacttaaacacctggtaactaattcaggtaaaacagctcctttaaagttaaaaactaaatatcattatattggtcttcattgaaaaatgttacaatgaaacactaatcaagcctaaaagagataactaagtataaaatgggtgttcgaagatttagctttaaattttgag

SEQ ID NO: 398941 - DNA, 527 bp, Homo sapiens
ccatgcctggctaatttttttatttttgttagagacgggtttcaccatgttggccaggctggtcttgaaatcctgacctcaggtaatccgcccgccttggcttcccaaagtgctgggattacaggtgtgagccaccgcgtgcagccatctcttcatatctttaccttccccctactgtttccagccttgagtattttctgttctactttctacttttcacttctatgaggtaaactgtttttagcttccacatatgagtgagaacatgcagcgtttaacttttctgttcatggcttatttcactgagtataatgtcttccagtccatccatgttgctgcaaataacagaatttaatcctttttgtggctgtatagtattccatggatatattctggatattaatcccccctaggatgtatagtttgtaaatattttctcccattctgtagattgcgaagaaatattttaaagatttataaagtacatcttttacatcttttatatttaccaaatgagtgaaaactga

SEQ ID NO: 398942 - DNA, 1779 bp, Homo sapiens
  misc_feature (1553)..(1553): n is a, c, g, or t
  misc_feature (1556)..(1556): n is a, c, g, or t
  misc_feature (1568)..(1569): n is a, c, g, or t
  misc_feature (1599)..(1599): n is a, c, g, or t
  misc_feature (1779)..(1779): n is a, c, g, or t
aatgttagcatcttgtgaggctttttctaacctgccttgtaaagtcacccgtttctattctctgtcgtcatctgatgtgatcataggatctccttatttacctctttcattagcatatgaaccccatgagggtagacacctttttttttttttttttggagacagtctcactctgttgcacaggatagactgtagtggcacgatctcggtttactgcaaccttcatcgcctccctggttcaagcgattctcttgtcttagtctcctgagtagctggaccacacccagctaattttttgtgtatttttagtagggatgaggtttcgctgtgttgatcaggctggtcttcttgaactcttggtcacaagtgatccgcctgccttggcctcccaaagtgctggcattacagctgtgagccactgcgcccagcacctttttttgtcttgtttactgcgaaatccccaacaactatagcatttccaggcacatagtagatgcttaagaattacttacttacaagagcacaaacatcggcgaataaaaagaattacctattgaatgaatgagagttagctggtgcaaaaaaaaaaaaaaaaaagccagtgcagattgagagacctggccatagaaaattacaacgctcagggataaggtatggcaaggaacgttttttgttttttgttttttttttcgctttattgccgaggctggagttcagtggtatgatctcggctcactgcaatctccacctcccaggttcaagcaattctcctgcgtcagcctcccgagtagctgggactataggcgcacaccaccatgccctggtaattttgtatttttagtagagacggggtttcgccatgtttgccaggctggtctcaaacacctgacctcaggtgatccgtccgccttagcctcccaaattgctgggattacaggtgtgagccactgtgcccagcctggcaaggaacttgaggagtgggtggagagaacgctgagatggagttgttttcagacgtttccatttgtcccagatagcgattcccttaaattgtggcttaggcttctgttttctaaaatattcttaggccaggtgcggtggctcacgcctgtaatgccagcactttgggaggccgaggcaggcagatcacctgaggtcaggagttcgaaaccagcctggccaacatagtgaaaccccgtctctactaaaaatacaaaagattagctgggtgtggtggtgtgtgtttgtaatcccagctacttgggaggctgaggcaggagaatcgcttgaacccgggaggcggaggttgcagtaagccgagatctcgccatccattgcactgaccttgggcaacaagagtgacactccatctcaaaaaaagtacattccttaaagtcatcttgaccttagtttatacttgtagttaaattctctcataagaaacaaatctgctgagattacaggcgtaagccaccacacccggccagaaatgctttttaaaaacggttccacccgggcgtggtagctcacgcctgtaatccttcaaggcaggnggntcacctgaggtnnggagttcgagaccagcctggccaacatggngaaaccccatctctactaacaatacaaaaattagctggatgtggtggtgcacgcctgtaatcccagctgcttgagaagctgaggcaggagaattgcttgaacctcggaggcagaggttgcagtgagacgagattgcgccattgcactttaagcctgggcaacagagcaagactctgtttn

SEQ ID NO: 398943 - DNA, 457 bp, Homo sapiens
  misc_feature (457)..(457): n is a, c, g, or t
aatgttagcatcttgtgaggctttttctaacctgccttgtaaagtcacccgtttctattctctgtcgtcatctgatgtgatcataggatctccttatttacctctttcattagcatatgaaccccatgagggtagacacctttttttttttttttttggagacagtctcactctgttgcacaggatagactgtagtggcacgatctcggtttactgcaaccttcatcgcctccctggttcaagcgattctcttgtcttagtctcctgagtagctggaccacacccatctctactaacaatacaaaaattagctggatgtggtggtgcacgcctgtaatcccagctgcttgagaagctgaggcaggagaattgcttgaacctcggaggcagaggttgcagtgagacgagattgcgccattgcactttaagcctgggcaacagagcaagactctgtttn

SEQ ID NO: 398944 - DNA, 577 bp, Homo sapiens
aaaaccactaggaactggaacaggagagtggagacagactgcaagccagaccagacaaggagggtgaccttcaaaggtgccaaatactgcccacaggttgacggagaggaagatttctcagcagacactggatgtggtgatggcaccatagcagagtgaagggcttgtcaggcacagtctatggtgtgggcttcaaagctggcgtttcagggaggaaggaagaagaggagtctagaagcatcaacaactacacaaagaggactcttaacccattccacaccctactgcacaagggcagggagaaaggaaggagcccccgtctgggggctgcaggagcaggcagtgcttaggggacagccaggtctcaagaataaagagatggatgaggggccaggggtggtggctcacgcctgtcatcccagccctttgggaggccaaggcgggcagatcactttgaggtcaggggttcgagaccagcctggccaacatggtgaaaccccatctctactaatacaaaaattagccaggcacagtggcacacacttgtagtcccagctactcaggaggctgaggcagg

SEQ ID NO: 398945 - DNA, 690 bp, Homo sapiens
acagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatgggtaagtgtcggggtgggttgcttgttccagtggaagaaaaccatttttgagatgttcttgcagccatggttgaagtgtggtgtccctgctgtccttctgttccctttggttactgtacataatgccagcctttcaaggagaattgagattaggatcatgtgatgaaatgaagatgggcacatttgggacttgtcttatactcaaatggttatttttaaactctgtgttaaagtattttcttagtggttgccctaggaattacaatgtatttcccaatttatccaaatctacttttgattaatactaacaattctagtcaaacacagaaatgtcactccagcgtacctccatttcctctcctgcttggtgctgtcattgttatattccatttatctgtgttgtcaactccaaaatagtgttataataatttgtgtctcttaaagaagctaaagga

SEQ ID NO: 398946 - DNA, 318 bp, Homo sapiens
acagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggt

SEQ ID NO: 398947 - DNA, 474 bp, Homo sapiens
ttatcaaaaagctgttcccacagcagataacagaaacataaaattgcaaataattatagttcatatatgtgatcatataaatattgcttgtaataattttataacaggcctccctgatatccctgaaattggttacactgaaagactcattaattctctcttccaaaaggattattgacttcctgagtctgaaaagtactccaaagtcaaggcaacaaaatggcccattacttcaaaagaggtggaagccacactaaggtaaaacataattccgagctgctaacttggcaatgttttgtttttttgtgtgtgtttctcttttacttctcgcacggtgtcttccactagaaattagatatcagagtagcaagtcgttcatttaaagcaaaaattatttatggcagtatgattttaaagccaattttaacttagtaacagcatttaacaacattatgaggactaatatatgtattt

SEQ ID NO: 398948 - DNA, 806 bp, Homo sapiens
cagtggtcatgtttatttgaatgtctaagtaaaagaaaagggtacagttattagcagtagaatattcgggaagtcctaaatttaaataccaaaatgtatgaaaatcccagcactttgggaggccaaggcaggtggatcacaaggtcaggagatccagaccatcctggctaacacggtgaaaccccatctctactaaaaatacaaaaaattagccgggcgtggtggcgggctcctgtagtcccagctactcgggaggctgaggcaagagaatggtctgaacccgggaggtggagcttgcagtgagccgagatggcgccattgcactccagcctgggcggcagagcgagactccgtcacaaaaaaaaaaaaagaaaaaaaaaaaaattcaagccaggcacagtggcttacgcctgtaatcccagcactttgggaggccgaggtgggtggatcacgaggtcaggagctcaagaccagcctgggcaagatggtgaaaccccgtctctgctaaaaatacaaaaagtagccgggcgtggtggcatgtgcctgtaatcccagctactggggaggctgaggcaggagaatggcgtgaacccgggaggtggagcttgcagtgagccgagatcgcgtcactgcactccagcctgggtgacagagtgagactccgtctaaaaaaaaaaaaagttatgaaaggaagtcattttctctctaaatgggtataattgaatcacatagaatatttatgtttgaaatgtttgtttttgggtgctgtaaagaaatagtacttgaacataaatttatttagtaag

SEQ ID NO: 398949 - DNA, 489 bp, Homo sapiens
ccaaatctaaattccttaataaggagaacacaattcctcatgatctggatcctgacaattcctccagcttcatctactttaccattcattcttgtcccagtgttccagctgcctaggcaacttgcatgtacataccatacgtatcctgtggccttggcatatgctgttaccctttcaagaaacacaccttcccttctacacttaaatttctatatatagttgttccttggtatccactgggttcattccaagagcctttgtggatatcaaaacccatagacacttgagtcccttatataaaatggtgtagtatttgcatataacctacagacatcctctggtaggctttattttctttttctttttttttcagacagggtctcactgtgttgcccaggctgaagtgcagtggcacgatcacagctcactgcagcctcaacctcctgggctcatgcgatcctctcatctcagcctcctgagtagctggca

SEQ ID NO: 398950 - DNA, 422 bp, Homo sapiens
aggggtcagggtgcaatgccgggaggggctcgtcgggtcccgggtccggcggctcgcgctggggagcgtggctgcccccgtcacccccaccgcggctgcccagcagcccgcgcgccccttcccctccggcctcgtccctgtcaggccgccaccatcgccaccctcgtatacataagtcagtaaaagcaagatgcttccacttttggatgacttaccgcgcggtcgcgacccttcccacgaagaggcttttcactttgctgtcatattaggtcagcttggaagaagtgatcaccaagagacacccaagatcttgtttaggcaataaatgaatgaagaccatggattaagaaccgttgctagatatgtagaatattaaaaggtggaaaaggaaggtgctcataactcctggttttctggaccaa

SEQ ID NO: 398951 - DNA, 115 bp, Homo sapiens
cagcatctgagtgtgacaatatgcagtatattggcaaccaggaaagctcaatcgagcttcagtgtctagcatttttagtaaggttttattatgtacggatgacagactgaatcat

SEQ ID NO: 398952 - DNA, 398 bp, Homo sapiens
tatcacataatcacgtaggggaaaaagagatcataagtgaaaagatggttgaaccatgtttagataccatgtgcatagcagattagaaaggtctgtaggaggaaatctggtttggggttaaaaaacaatttattaactccacattacctttcaatagatgtatctaattattaaaggaagagggatatttacagtgttgtggtggagagcccatggtgtggggtcagataggtctggacacaaaccccagctccacatcttactagtatgtgacactggacaacttgttgatgttctgagcctcggttttccttccatagtgcagaaataaaaatggcttcgtctcaaggtgcttatactttgttacaaggattgtagaaattaatgtatgcagagct

SEQ ID NO: 398953 - DNA, 282 bp, Homo sapiens
agaaaagaggccatttcagtgaaaatattcacctggttattgtgattgctatgttgaagcattgttattgcagacatttcttcattctactcaggaccaagggcccactgatttcctcctgccaacaaaggccaggatgctctggggactgaatgtgcaagcccaaaggttgtattgtcttgtttccatatatagtattaaattatgggctatccaacagttaaagaagctagacctcttggtagggaaaagaaataaaacattttctttggagagtaactt

SEQ ID NO: 398954 - DNA, 638 bp, Homo sapiens
gtcctctcggcggcctctccaggtgcaaaacttcctcgagtcagcctctccaggtccagctcctcctgcctcccagtggcctctttcagtccagcccagctcgtggctgtaggcagccttcccaggccctgcttttgacttttggcggcctcttcaggcccagaacttgatctccagtcagcttttgcaggcccggcatcctgcctcccgaaggcctctttcagcccagcccagctcgtggctgtaggcagccttcccaggccctgcttttgacttttggtggcctcttcaggcccagaacttgatctccagtcagcttttgtaggcccggcatcctgcctcccgaaggcctgcacgggcccggcctcggaatcacagcagactctccacgcccagctagctctcacctcactgtggcctccccagtccaaagctcctgcctttcggccgcttcggcaggcccagctcccgcctgccagtggcctctttaggcccagctcattcctcacaatggcctttccaggccccatttttcccttccggcagcctcttggcctctaattttttttatcttttgtgtataaatcccaaaatatggaattttggaatatttccaccattatataaatattttggta

SEQ ID NO: 398955 - DNA, 115 bp, Homo sapiens
ggatttaatttgctctactttttctggtttcttgtgatgcaaggtaatgtgattttaaacttttcttcttgttacttacttttttattttttattatactttaagttctagggta

SEQ ID NO: 398956 - DNA, 703 bp, Homo sapiens
  misc_feature (703)..(703): n is a, c, g, or t
gttccaattgagattacagagttgaaaaggcaaagtaataagagcaatttgggtggctatttacactgtgctttgctgtttgatagccttttctgtggaaccttggtttatttctaggggaaagattagtttttcctatcagtctacatatttatcaagaacagtttttagggacaaaatcatttgcatttgatttatgtaatctttgttaattttgtagaaatttggaagaaaatattatagtgagtaaagataatgacttcttttccagtttggtttttttgaggagatgagggaggtgttttttttttttcccccttaagggcaaatcctgaactgtaacttataaatatggagctcttccttgtcaggagtttcagcttacaaatagcttcctaccaccacagggagacagagtgttatcagtccacacacccaaagcaagaaaaaaaagaaagaaaaaaaaatttggggggcggccgcggccaaagaagagtgttctaaaaccctctcgtgggggcgcggggcccaagtgagggatggaacttgggacaaacggtgggaccaaaggaacccgccggcacgacaagcgcgggggtccccccaaaaaaaaaccgcgcggcaccggtctgcggacaatccaaggggtgcggggcacacgggtccaacggggcaaggagcagatacccgcgcgggggggggn

SEQ ID NO: 398957 - DNA, 569 bp, Homo sapiens
tagtcagcctcccttggttggggagagggtggattcgattaactgtcattccaaattactgaatgtgttttatttggagcagttaaaaagttttgcttgagaatgataactggagaaccataatatgtatagggtttgtacaagaccccaaaatagccttgtgcaaattactttgtcttgtctgatattttatgtgtaaaattggggttaggacaacgaatatttcaggtggttttgtgaattaatgagatgttatctaaagcatcaagtatagtgcccagcatgtagtagatactaagtaatctaattcatagtgatagggacagtagccagagccaggatttagggcaaggcaatcaggctcctagggcgaggaatttaatggggcactaattcccagcgatgaactctgtacttgcatgaatcagaggagcgcctcagatttttcacgatcagtgtcttgcttccctcactgtagttcctgccctagtattagcaacagatcagttttatcacctttctctgtttaagctttatgtatcattaaataaatatttaaaagcttgttt

SEQ ID NO: 398958 - DNA, 181 bp, Homo sapiens
taaagcaagggacctctgcagtacagaaatggacaggttcagagtaggagatggcactgtaccctggcagagtaaggagagaaaacaccttgagaaaatctatactgacacatgtcaagttccagaacactcaagaaccactttactcaaaagattcactaatgaagaagtaactacagat

SEQ ID NO: 398959 - DNA, 350 bp, Homo sapiens
ctgttcctcctgcctggttaaggaaggaattggaaaggattcctcaagcagtcaagggtttcccaaagccaccctaaccccagccagtgccttcttcaagaacttcagagtatggagaattacccaaggatctaataacgtgagcctgaggtctttctttcacaggacctaggataacatggaaagtgagctcaaaagacacaggctatgtgccgtcagtgctaatgccaccccgacctatagaacccatgctgccgttctgtgacccaaggggacatcgccaaaatgctgctggcaaccctagcgagttgtgtacattgttacttttaggtttccttccatctcagaaa

SEQ ID NO: 398960 - DNA, 426 bp, Homo sapiens
cggcgtggtggcaggcgcctgtagtcccagctactcgggaggctgaggcaggagaattgcttgaacccaggaggtggaggttgcagtgagccaagatcatgccactgcactccagcctgggtgacagagcaagactcccgtctcaaaaaaaaaaagaaaaaagtacatgaagagccattatactatgttctctcaacttttgtgctttattggaaatgtccataataaaaagttatctttaattattctccagtgagaagagtgagtctacaggactcagatatcactcgccctgtcccaacacattatcatggcgtctttatcttctataagaagacaatgagatttttctaggaaaaaaagctcaccacttcccatgtgttctggatcccaacaagtcaggtctcctgagacattttgcttctg

SEQ ID NO: 398961 - DNA, 654 bp, Homo sapiens
gcaggtttggtgaagagaagcctgaagaagcaagctgaggtcaagcctacattcctgcccactccactctgtcagttcacatccttcaaccagtgctctggatctgagtggtgcctcccaaactctgaacttcaaacccaatgcgggtatcacatgtttctcctgtcctttctgcactgctgaactttgaccccaaccacatgacctagcctaaaagactggacattggatcctgacagctcacctgtccatttgctttccagcagtctgcatatactcatcaactttccagactccgtgagccctagcaagcctgaggcctgatttgtctaaagcaagtgctgaacttccaccagaattgaaaatgccaaaagtttcatccccttgtgtgccattgagcaccacgcatggctgccagcaagggaactttggatctttacaaagagctcagttcaaagtctttagagagccgtcctttctggtggagaaatcataagtcctatactgcttattatggtctccaaattgttgattgtgacaaagcaagttttgtgtacaggaaacaacggcttcccttctcctttggaggatctaaaaaaaattgatcttagataacaagccataaataattacagaaacactcagcctttgcct

SEQ ID NO: 398962 - DNA, 491 bp, Homo sapiens
aatagttggagtgcatctaagagaagaaagtgagaagatgggaaatgtttttctcttccttcttgcaataaatgttcattaaacacctttattgagtgcattctatgtgccacacgctgttctaggtgcaaggagtacagtagagaaggtctttttcttcatgaactatgcattgcaataggggagtcagacaataaatgaataggctgggtgcggtggctcacgcctgtaatcccagcactttgggaggctgaggcaggcggatcgcctgaggtcaggagttcgaggccagcctggctaacatggtgaaaccccgtctctactaaaaatacaaaaagtagccaggcatggtggtgggcgcctgtaatcccagctactcgggaggctgaagcaggagaatcacttgaacctgggaggcagaggttgcagtgagccaaaattgtgccattgcactccagcctgggtgacaagagcaagactccgtctcaaga

SEQ ID NO: 398963 - DNA, 183 bp, Homo sapiens
tccagtttacacccccagctttatctttgccactttctttcatatccaatagacagaaaagcatagccagtatctaagaacagaaaacataaatcatcttagccttagagtccctgaatctttgcatctttgcagagatagcaagcacataaatggggatcaccatttgattgtctgtttttt

SEQ ID NO: 398964 - DNA, 430 bp, Homo sapiens
tcagcggggattcccagacgcacgcttctcctgagagagtccagcccctcctggcggccgtggtccctggatgcgggtgctcgaggcctgttcttctccctgtggcggtggtgagtgtaatgcctcagaagactctgccagggcattaaacaaagtcatacgcgaaccccccggtgcacggcaggggactttgtcacctgtgtgcttatgcgtgagcaacagcgcctgatgactcttgggaagagccacaacaaagcgagggcctgcaggcggcagtggccagggaaccctagcccacaggaactcaagcagcttcagagaaggtcttacttgtttccggggagaggccagaggctccgggaacccaattcaatatgtaatatatagcagtgtccacgctatggtctaagcaaaggcaagaggagaaata

SEQ ID NO: 398965 - DNA, 490 bp, Homo sapiens
agaaagatggtggaaacgtgaggtccaaaggccttagcttgggcatggtctatgtccctcctgttcctattccatttgctgaaaggagtcttatcgccaagtccaacagtaggatgggttgggagagaagggagtggattttttaacacgtcataccacacccttctgggcttggtcttgggtccaagctgccctggaatttggagttcggggtcttgtacttccactcgacacatccctgtgtctccatagcaactgtttactgaccccttcctctactccctctgagaccctggccatcctcctggggtcttcagtgggcaaagcttcggccctctggctcgaagcgtctctgtttcttgcatttctgcctgcatgctggggaggcctggaaacactcaccctggttcctcaatagaactgctgtgacaattagaattcttttgtcaaactgttctttatctaaattcagagagtaaatttaaaaaat

SEQ ID NO: 398966 - DNA, 544 bp, Homo sapiens
atatacaaaatggactattattcaggcataaaaaagaatgaactcctgttatttagagcaacatggatggaactggaggtcattacgttaagtgaaagaagtcaggcacagaaagacaaatgtcaagtgttctcactcatctgtgggagtcaaaaacatggatctcatggaggtagagggtacaatggtgattcccagaagctgagaagggaaggcagggcaggatgaggagaagttggttaatgggtacaaaaatacaattagaaggaataagttctagtatttgacagcaggaagattacagttagcaataatttatcgtatgttccaaaagagctagaagaattctaatgttctcaacaaaaagataaatgtttgaggtgatgaatatcccaaattccttgatttggtcatcacactttgtatacagatatcaaaataccatgtgtatcctaaaaatatgtacaactatatcaataaaaaatacaaaaaagacaatatacaataaccacgttgagtccactccagtaaagcagctcaccat

SEQ ID NO: 398967 - DNA, 329 bp, Homo sapiens
  misc_feature (109)..(109): n is a, c, g, or t
  misc_feature (112)..(112): n is a, c, g, or t
atgtggataatgatacctacttctttggattgttgaagggattgaataaggaagtgtgtgtaaagcaccctgacactgctctagcacttagtagatgtcctgtataggngcnccccccccccccccccccccccccccccccccccccccccccccccccccccccccccccccccccccccccccccccccccccccccccccccccccccccccccccctccccccccccccccccccccccccccctccccccccccccccccccccccccccccccccgcccccccccccccccccccccccccccccccccccccccccccccc

SEQ ID NO: 398968 - DNA, 446 bp, Homo sapiens
ccagtcatcagtactttgcctctcagctgcacacccacgcttctttgccctgctttgtgacagtaggagtctggtgggatgaaggggcttcccttcctctcttcctgggctcttccagtgcagactgccagcaggatatgagtgcactggcagcccagctcaaggattccagcttccagtcccagcttgagagtcccagcttacccacctcagcccagcctctgtggtccagctctggcccagggcagcctagagaacaggaagtcatcctccatccactggaccacagcctcggccctgggctgtgacccctccaagtcccatctttccttggtattctctctcagccttagggtgttctttagtgttctgtttagaacactaaagttagaagttaatcccttattaccagttaataatttttcatattaaatttgccctgttcc

SEQ ID NO: 398969 - DNA, 590 bp, Homo sapiens
tttctattcctgtgttttggtgactatgtggtatgctgagatcaaatgaaagtagcaattcccttcatagcagataaaacctgtgaattgtagcacgggacttttaaaaatattttttgtaaagcatttttagatctggtaccttgaaaagtactagaaaaatcaatatcattgccagtgcttatttccacctcagtccatagtttctcatatgtatgattttcagctattttttccatgggtaagttaagttgcattcagtataggttagcaatggtaatatattttacaaaatactaagtactttctagagacctagtattagttcacatttttaagtaataaaaagtttaactagaaaaagagcattctctttaaaattagggtataatttatatacagggaaatgtacagattaattattcagttcgatcagtgttgacaaacgtatacaaaagtgtaacccatattttggtctgatgtagaacatttctgtcaccccagaaggtaagttccttcatgccctttctcagttattccctctgtcttcaccagaagcaatcactgctgagttctattactatagattt

SEQ ID NO: 398970 - DNA, 579 bp, Homo sapiens
actttgggaggccgaggcgggcggatcacttgaggtcaggtgttttgagaccagcctggccaacatggtgaaaccctccctctactaaaaatacaaaaattagctgggcgtcgtggcacacatcggtagtctcagctactcaggaggctgaggcaagggaatcgcttcaacctgagaggcagagggaggctctgtctcataaaaaaaaaaaaaaagaaaaaaaaaatcatgaaattatttaataataacttctggtagcctcaacacatatatatgtaacacagacaactttaggattatttattttacaaaatttatttcacaaaacatatctgaaagatttattctgaggatgagttattcttcagaaggaagctacataaagaaactaagactggtggccaagagttgtgaaagcactcaaggaaaaaattctgaaatcctagtcaaaatattttacagactgatatggtttggatatctgccccttcaaatctcatgttgaaatgagtgatcccccatgttggagaggggcctaatggggaggtgttcgggtcatgggggcagatccctcaggaa

SEQ ID NO: 398971 - DNA, 394 bp, Homo sapiens
aaaaatgagttattgcttctttttctgtaaataatatttattaaattatgaatgtaaaaaaatgtggtgatatataacaactgagcttcatattaatggtatatttaagctttataggatagggtgaagtgattttaattattggggtttggtaaaggtttataccaaacatatttgtttcatagtgagccccttgttgtatagtaagtctgattttattaatttgtacagagaaattcctttgtaaaatatgactgacttttcttcctcttagggagacagattaataatatttcactattaattaggttccatctgctcatcctgcctttcattctaaaggttatacttattaccatattctcaaaccgacccaactgtgtaatcaaagttt

SEQ ID NO: 398972 - DNA, 458 bp, Homo sapiens
tgcccttgtactagcagtggtatgtgtaatatatttcgagaaacactgcactaacacctactgtttacatactatcaaaaaccccagttctgccactaattagttgtgccactatggacatttcactttctctttctgggtttttttctttaatttaggataagttatctaccatctctaaaatctctccctgctttaaaattttgttatttaaactctaaagtacaatctgtcttgctctacagaatgtacatctctctcttttatgaacattgtatggcgtagaggaattcagaactacaaaacattcatgtcctgtcattttacctctgtcctaaatttgcccctttttcaagtctcatgggatggtaggtatatctttcttttctttttttcttttctttttcttttcttttttttttgagatggagtctcgctctgtcgcccaggctggagtg

SEQ ID NO: 398973 - DNA, 1146 bp, Homo sapiens
cttggggccgatgccatttctaaaagtgattgagtaaatatcacaggtgggcaaatcaaagagaaggatattctggttgtttcaaggtccaggtaattcaggccatggcacaggtgatcctgagcttaggaagaactcacccatgcctcaggggcccagctgccctcctcccctcactgctggagcacctacaacagctgtgaagcatcttgtgcttttggagccttgacatgggaaggaacaggagaaagcaggactgatgtctccagaccaccccttaggcaaaccctctttggtagcatcttagacccaaatatttttttccttcacgtcacgttgcctgaattttttcaccttagtttgttgtactgccaaatattttatttggaataacaagtacctttgagaaaaaaaaaagcacatacaaacttcagctcccctttgaggcttagctccaacagcacctttcctttccttcttagaagtaagctttctgggtttgaattcctacagcacacattctgactcatagcatctgtgacttgttatttcacatttccatggatgcatctcatctgccttgctgcactgtaggcccttcggcttttatttttttttaattcttaatctttatgggtacatagcaggtatatatatttatggcatacgttagatgttttgacacaggtatgcaatgcctaataatcacatcatggaaaatggggtatccctcttctcatttatttgtgttacaaacaatccagttatacttttagttattttcaaacgtacaatgaaattattgactatagtcaccctgctgtgctgtcaaatacccggccttattcattcattataactatttttgtcacccattaactatccccacctccctcccaccctccctcactacctttcccagcctctggtaaccatccttctattctatatctctgtgggctcaattgttttgagttttagatcctgtggcccctttgaccatgcagatcatggcctattcatcttcacacctagataggagcctgcgcagtgcctggccaggagcaggcataagtgtgtgcaaatagaggaataaatagcagggcagcaactatgtctggaggtcattgtctttcctgtctcagt

SEQ ID NO: 398974 - DNA, 512 bp, Homo sapiens
gatccattgtcttttgggcaggtgattgtgatactataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgacagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaa

SEQ ID NO: 398975 - DNA, 156 bp, Homo sapiens
ccaagcaccgtcaactacacattgttattcaccacagagaaagtatcaaatgtctgttgcattaagtggcaaaatttggtaactaataaatttcaatccatttaaaaacactgtaaatatagtataaatgttgtcgattcaactaatgattccata

SEQ ID NO: 398976 - DNA, 955 bp, Homo sapiens
actatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatattt

SEQ ID NO: 398977 - DNA, 343 bp, Homo sapiens
atgtgttttacttttagtcattcaaataggtgataatagtatctcattgtggtgttagtttgcatttccctaatgactaatgatgttgaacatctttgtatgtgtttctttgccatccgtatattttctttggtgtagtatctgttcaaactttatgtcagttaaaaaaaaagacccaattgttttcttcttaatagatttggagagttctttatatatattctggatactagtcaagcctttgtgaaatatgtgatttgcaaatattttctcctgttctgtggcttgtctttttattctttcaataggtagactttaataacatcgttttgttttcttttta

SEQ ID NO: 398978 - DNA, 232 bp, Homo sapiens
tgctgggagttagacacacttggctggagctcccatgtagcctctaccaattttggtatcttaggcatgataccaatcagcctcctgagcctcagtttcttcacctgtcatatgcagaaaacaatacctccctaattcacttcaatcgcattgcagttatgagattacaaggagatgatactgggaaagagtcccaaaagaaaaattctatgcagatgaaagagattcttga

SEQ ID NO: 398979 - DNA, 461 bp, Homo sapiens
agtaaatgctcaataaataaatgtttacttaataagtattaaaaaatctgctggccttaacataatggccactgatctctttttcttttgtagagactgggtctcactacattggccaggccggatttgaattcctgggctcagcctcccgagtagctgggactacaagcatgtaccaccatgcccagttttctgcagcagtttttataaaccaaattttccaaattagaaagactgaccaaagaagcacttttatacgaggaataacttacgtatggagaatctcaacttggaccagtcaagaccaactccagcgatgaagccagaatgtaatatatctcaaaaggctaaagaagtccattttcccagatgtaaattataattaaaaaatagtgagccaaactctaatatcccaatgtgataatctttcaaataaaaatatgggctgtagttcaggaaaa

SEQ ID NO: 398980 - DNA, 475 bp, Homo sapiens
cattctcttacctgtgttcaggtccacacccacgagctgacctgattctgaatgttctgcttaaattttaactaatgtttcctgaaggtcaaaaccagaattctgagcaagaacctaaagtaaacaaatttaattcctgagaaaacaggaagaattgatatttaaaaaaaaaaaaaaaaaaaaaaggctgggcatagtggctcacacctgtaatcccagcactctgagaggccgaggcgggtggatcacaaggtcaagagatcgagactatcctggccaacatggtgaaaccctgtctctactacaaatacaaaaaattagctgggcattgtgacacgtgcctgtagtcccagctactcaggaggctgaggccggagaatcgcttgaaactgagaggtggaggttgccgtgagccgagatcatgccactgcactccagcctgggcgacaagagactgcatctcaaaaaaaaaaaa

SEQ ID NO: 398981 - DNA, 435 bp, Homo sapiens
aataagctgcaactggaattggagtattttcaaatgaatgacttcttagttaaaaaacacacacacacataaatagcgtttgatattttgtgacagtgtctaggtgagcaaggcaagaagtctaatagctacaaaagccacaagccacttataggtgtcttggtaaagaaataggggtttttaaatgtaaataagaaatacaaatttttttaaatggggagtgaatccatttgatctttgttcaatagcaaatgacttataaatgcttgtcacaccttaaactatttcaaatgacaagtgtcaaaaaatctctcttgcatgtagccttgtaagtctcttaaaattctggaatttttttaaaaaaagatgtctattggatataacactattgtattctggaaacaaaaaaccctttgtccatttggcagattaaaa

SEQ ID NO: 398982 - DNA, 606 bp, Homo sapiens
  misc_feature (40)..(40): n is a, c, g, or t
  misc_feature (157)..(157): n is a, c, g, or t
  misc_feature (428)..(428): n is a, c, g, or t
  misc_feature (457)..(457): n is a, c, g, or t
cgagaccagcctggcatacatggtgaaaccctatctctanttaaaaatagaaaaattagccaggcgtgatggcgggtacctgtaatcccagctacttgggagactgaggttgcagtgagttgagatcgcgccactgccctccagcttgggcaacacnagcgagaccccgtctcaggaaaagaaaaaagaaattgtctgatatttatagaattttcaaagtgtgagaaataaaacttcagacataattcgtgcttcatactatattgaattagatgattttaaagtctcccgtatttaccactgtatttttgtctgcgtatataagttccatgcacctatactatggctaacaatattttactttgactaaaatttgttacacaatacttaattattagtgttacttattattgaaagacattagttgnaaatttctttcagcctgatttcatccatntttctgccaagaggcaattgtaaattattggattgactcttctacatattgtttgtagttgttaagaaagtacttactggtagaagttgaattttttgttgcccttattctccattgtctgtttagcgaatttttctctgcgatggctc

SEQ ID NO: 398983 - DNA, 152 bp, Homo sapiens
tagatcgagctcggtaccgattacgctcctagacagaacaattaggcaagaaaaaaaaagcatctagattggaaagaagtaaaattatacctgtttgcagaatacactaacttatatatagaaaaccctagagattccacaaaaaaactgtt

SEQ ID NO: 398984 - DNA, 330 bp, Homo sapiens
gaatcgagctcggtaccagtgaaacgcagctgaaggggtggtggggaaatagtgcaaaggacaagagaaatgagtgttggacagatgagcgaggaggcaaaggtagtctcagcttatatccttcctgctttggagtatgaggagttcctgagaagcaaggacaccctggagcccagtgtttgaaagaatccagtttctctaagttcagcactcaaaacttcctcagggccagctgatcagacccaaatccttgctcatgtctgaccacaagaagtgtttcccaagcttcctcactggacagctacccaataagggtatgactttgagggg

SEQ ID NO: 398985 - DNA, 429 bp, Homo sapiens
aggaataaattctggcggtctattgcacagtaggatgactgtggttaacaacattgtttcaaaatggctagaaaagattttggttgttctcactacaaagaaatggtaaatacatgaggtgatggttttgctaaataacattaaaatatcaccatatcccataaataagtaaaattgttatgtgtcaaaaatgaaacaaaaatatataatgttggggggtattaagtgctatgatgacaagtaaagcaagtttggcataattttgggagttggcatattaggttaaggtaaagccagttacttttgttatgtttatgaattcctaggcctcttgacaaacactgaggttctcaaacattggcaaacacaagtcacattaggtaaacatacaaattcttggccttagttccatatattttattctgaaca

SEQ ID NO: 398986 - DNA, 227 bp, Homo sapiens
gatcagctatgggatgaccaaactccaggggaaagatcatcttcccactctgtcccctttccagctccgcatctctcaccgagagccatctccatcactcagtaaaatcctcacattcaccatccttcaagtctgggtgacctgattcttcctgaatgctggacaaagacttgggtaccaagagggcagggcttacagggctgtcacccttattctccgctgagctg

SEQ ID NO: 398987 - DNA, 241 bp, Homo sapiens
ggggttgctcatataatgggcagggaggctgaagaatcaggcttgggggagttgggaacgagcagataggatttagcagcaaaaatgatttcatggttttattcaattgcagtctctagatggaaaccatttttttcttctgaacttgtgtcctgctattcaagattcaaagtcacaggagagagaatccaactgtctgaatctaggttctgctattgacacatggttgccctggaacaga

SEQ ID NO: 398988 - DNA, 142 bp, Homo sapiens
ggttgttggcaggactcagtttcttactggctgttagctggaagtcactctgtcctttaccaggtagctctctccatcagaacaaacagagccagaaagagaatcggagcaagatggaagtctcagaattttgtaacctgat

SEQ ID NO: 398989 - DNA, 435 bp, Homo sapiens
tgggtcactgcagtgcatctttatgcaatgtggctcatattagcattttggaaatactctacacatttctgtctctgcaatgtaactgtaaactaaaatgatggagcatcgcatttgtcaataagatggataataatagaaacaagaggggtcccactcaattctataccctgagagagtcagagttctaacgaatatgcagataaagctgagacctcctttaagatatccaggagagctttgcctggccttctgagcagaggggctctgaacaatgtaactattaaatatacaatgcagaaagaattgcccttaatactgggcagggtgcacactgtgaggaattttttaaggagtcttttaaaatagaaaatggcctgtttgaaagaaaatggattataacaattgtgtccttctgggatccccagatatttc

SEQ ID NO: 398990 - DNA, 442 bp, Homo sapiens
agagattgcatcttgtgagtctgtagaaatggtcaaggccttgtcctctcttaggtccagagctcaggttaatgcagattttcccggccatctgtgctgaagtccctttggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagccttggcgacagagcaagactccgtctca

SEQ ID NO: 398991 - DNA, 555 bp, Homo sapiens
acagagaataaccccagaagtagatctctgcagcatcattggaatgaggacagtgatttttttttaagaatgtcttttttgaggaagaggcaatgtgcctggaccatagtggttctagttggggaagcccgggccttttcctccttacccctgggaaaccacatcgctagtgctgtccgtccacagggacccacccacttggcagggtagagcttctagaaccagagccaaggcaggcaggagactctttaaacagttcagagggaggaggcaggagcagggtctgagtggaagctgggtgctgcaggctgtggtcagaccagagaaggccgattccacaggactggggtcagagagcaggggtcagagagcaggagccagagcgggcctcggcctctccctgggaggccacggcacctccctgtgcctggggccttcatgactcgagggtgtctaccccaaagctgctgcaagcattcagagagagaagtgcccagggcccagcagagagcaagccctccacacgtgtttctctccctcttctttcagaagcaa

SEQ ID NO: 398992 - DNA, 440 bp, Homo sapiens
gaggtgatctgaggtccccggcagaatcacactcaaagtcaaagcagtatgcaattaagtgagaatccaggatacagacatcaagaacagcagaggctcagagaaggatgaggctagcatggccagagggtcaggctcccagtcctcatacatcaggccagaaacaaggcacctaatgcctctcctggtattgcaccaagagcacttgacattaggagaatctacaagatcatgctacactcctgcttagaaatcttccatggctgctcctctcaacctcagggtaaagttttaactgcttagcctggcattcaaggcctttcctaatctggctcagactgccaattttttttttttttttttttttttatttttttgggaaaaaaagcttggccggggatcccccgcgggggaaaacagagaaaaaccccccccacaaa

SEQ ID NO: 398993 - DNA, 441 bp, Homo sapiens
ctattatccattagagtttattaagcaatgaaagaaatgaaggcataaggataaaacgtctgctcaaatttctgagcagtcactttctcattagagctcttgtatttggggactctaatgtggaaataccgtgagaatttaaagaacaaatagtacatcctcctcccttagaaggtatcagaatttttaatttttatattatattgtattatattatattatattattattatattgtattatattatattatattatattattgtattatattattatattatattatattatattatattatattatattatattatattatattttaagacggactctagttctgtcacccaggctggagtgcagtggcgccatctgggctcactgcaagctccgcctcccaggttcacgccattctcctgcctcagcctcccatgta

SEQ ID NO: 398994 - DNA, 497 bp, Homo sapiens
atttcagaagggcaggtgtgaagcaagctgttcagcattagggatggtgatggctctgaggccccatcacaccctatgggggagagcgaatgttacaggaggctttctggtgcctcgtgcacatggactgtgcatgtgggattttgcctaaggtcagccttatatgcattgtggaactagggtatggaaaaccatgaaacatgattattttcttctagcatgcctgtctatgacttcaactggtggtattctttgtactttataatctacattatcattaatacctacatcttcaagtctgtctttctggccatggtgtacagcaattataggaagcattttcacatactgtgtgtgtgtgtgtgtgtgttttgtagtgatgaacagaacttgttatttacccaattctattatctatcataatagtaaattagctactataatagacaaaagtatgactctcagttaaataagagattttttaaaaatcttgttac

SEQ ID NO: 398995 - DNA, 437 bp, Homo sapiens
gtcctgatgagacagaaaggcactcactgggcacctgaggtcaccaaatcctctcagtgcggcctgagattcaaagaagggggacttttgggagtggcctacctgaaatctttacatcagaaactcaagcaagaaagagctggggaggacagctgcctgattcgccagccaaccaacatgtgccctgtctacgcaggcagacaccagtgctgcctagaggcgctcaccgtcctgtagagggagatcctcgtggaagttaagggcaaggtgctccgcatgctctgacaggtgtcctcgggttaggaacacagggaggactcgcgtctggccagggccaacctgtgtcttctcttggctctccagaatgacccagggtgacctgcagagccctctcagtacctgcagaggtcccttcctctgatcctctttgcctgctc

SEQ ID NO: 398996 - DNA, 368 bp, Homo sapiens
aggtggctattccaaggagaagggggaggagggagtcttgaacagtcccttagctctctcctactgtatcttgaaaaaagattagaattattccttagccataaggggtaagggtaggagaaacgcatacaagtaaaaggaaaatggattttacctcaacatgaggaaaaactgttgaacagccaaaactacttgaagatgaaatgtgatatttgaaagcagtaggtagacagtttctgatggtaatcaagcatagattagataaacacttggtgggaatgttgtggcagggtttcagatcatcaatggatgtttattcttcaatattaagaatctggttagagacttctgaggaaaacaaacaaaaa

SEQ ID NO: 398997 - DNA, 284 bp, Homo sapiens
atctcaaaaaaaataaaagcttcagaaagattcaagaagtactgtattcatgaaataagaataaagggttggccgggcacagtggcacacctgtaatcccagcactttgggaggccgaggcaggccaattgcttgagcccaggagtttgagaccagcctgggcaacatggtgaaactcccttgctacaaaatatagaaaaattagcctggcgttgtagtgcaggcctgtagtcccagctacttgggaagctgagatgggaggaccagaaggttgcatctgcagt

SEQ ID NO: 398998 - DNA, 594 bp, Homo sapiens
tgaaactggcttttcaggtttgacccagctagatgcctgggcagtcccaggctcggttctcctcacccctgtggagctaaccccaacctcctagccccgaccccaagggtgggcagaagctggggaccaagcagctggctggggctcaaggggtccctgaggcggagccccctgccaccaggggtcattctgggcaagccgggccccttttcctgagaatggggcaggggcaaatggagtgcatgggagtctggtggtgccagattgaaggggcctcagaccctttcccagcccttccaagtagctttcactggctgggtggcctccgttgcacaagcaggcccctcaaccagcacccctcatgagctggccggtccccaccttggggagctgactttctagggtgcgctcttggtttagggggagtcgtccaggtctcccctgcctttcagggaccatcaggccctcccctaggatcttcccagctacagtccctgcccagggcacccccagttgctcttggctgtgagggcctccgccacaccggctccagttcccccacctcagtgtctgtgccaggatcacattttgccc

SEQ ID NO: 398999 - DNA, 478 bp, Homo sapiens
caggctgtgaactcttgcctgcaagtatctgctaaggaaagccattttgtgtatctgcctccggtgtgctggaattacctgtggaccgcttatggatgtcattaagatgatcttcgtgaaatacttgaacatcatgtcaaggaccagaatgaaagctacggttattaatgacgaacgctataataggcatttgagatgccatttttgggctcatgaaatattgagcttattttgaagatctaggatatgcaggtccatgtttgttttggctataaacttgaagaccgaagaagcagaccattttttttgaagaaagttgattggatattgacttttcttgtaatgatgttattttataaagtgacccactatattaatttggattttgtgtttactctttagagaaatgctctattcagatccgattgggaagtttatgtttggatatttattctatttaaatttttatctcaatctc

SEQ ID NO: 399000 - DNA, 505 bp, Homo sapiens
acagatttcacataagaagcttacaagaagtacaccaaagattacatgacactaatcaaagggcaccttgaagaacagagaccagaaagagtaacctcttttatgccaggggctgcagaacaaatcaagcacatccttgctaatttcaaaaactaccagttctctcattggtgaaaacatctatccagatggcctggttgatctactcgactaccgtgaggatggtgtgacccctatatatgattttctataggtatggtttagatatgtaaaaacctagtttacttctctctctctgcccttgtttttcctgcatgttcaacatgtccctccccctcacccctttccccagcccccaccctctcaaaaaaaaaaaaaaaaaaacctgagattgtacttttgtacaggaggttcaaattacaaatggcaattttatgcacttcgccgtattaacgctgccgcccgggcagcgctcatgtgaccctccgtggattaacatcctgct

SEQ ID NO: 399001 - DNA, 401 bp, Homo sapiens
tccagcaactagccagagtccatgctctattttctaaaggcaaaatcaggtctgttttcacaagtgacagtgaggccagaagattttgaaatcgcttgtgaaaatacgagaagacaaactttcccaattctgaaaattgaccttgtagaaaagatatgcatctgtaatgcttgtgttttatgaatttaatttcaaaggaaatgtattcaaatggtccaaaaaaccagaaggtatagaaagctatgaaatgaacacatctgtcctctttctgatacccacaccaccagtatcactgctgctctttttatatatccttccagtttctttttgcatatccaagtaaataaaatttggatttttaccaccatcatcctccccctctttacataaagtatagtgta

SEQ ID NO: 399002 - DNA, 247 bp, Homo sapiens
gtgctgggattacaggcatgagccactgcacctggcctaggactggtgtcctaagaagaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgctgttgttgaagcca

SEQ ID NO: 399003 - DNA, 866 bp, Homo sapiens
ctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagaggaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaatccgggactctctcttcttccaagggtaccttctccagatcatccccttcaaatgcttctgctcctggcacattcgggtcactatctaagggcattaaagacactttcaagatcaagttcaagaagaacaaagatacagcagaacaggtggggaaggaaggcagaagtgggcagaggaacgtgatggaagtgttcagagaggaagaggaagactcgttctcaggggacttcaaagagaagctccagttgtcagcagaggaggacggcagtgtgcaccatgaatccattctcaatcgtccaggtctaggaagtattgtttttagaaggaacaggatatcgagtcctgaagacatctcagatagc

SEQ ID NO: 399004 - DNA, 687 bp, Homo sapiens
ctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagaggaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgctgttgttgaagcca

SEQ ID NO: 399005 - DNA, 573 bp, Homo sapiens
aagttattctgcatttccagaaccacaaccatgccaatgcttgacacagttaaataaaaattaactttcatttctctttacctctgctgacgtggtcaagattaaaagtaaactctcggtttccaggaatggtcaagaaattaaatgttatggacatagagaaacatacttcatgctgcatgctatttactcattttcaaagatccagaactaagatgtcagaaagaactgagtcactatacctggctcggcttccagccctaccaccactaaagaagcaacctccaagtgtcaactggctctatcctcatttcatcacttctcatcacttctctatcccctgcaagctggcttctgtccccctcactctaatgaaactgctcaggtcatgggactcataggaagttctcagtacttttttctttcttgcttctcagagtgttcgacactatgaaacactccctccttgaaaccccacgctgttactctgcactctactgcctctccccctgcctcttgagctattctttcttcatctgcttggcagctcctcttcctcctccagggagaact

SEQ ID NO: 399006 - DNA, 921 bp, Homo sapiens
aactccacagggtgacatgacgaaaatcttcatgcacccttcttcaggtattgtatagttggccttgagacaaaagccttcacacagtagaagttctggcactcatctgggtgcacaagcatgatgcagtaagtcctgtcatttggtgcctggggaagcaatgagtagtagtaggaagaatcagcttaggaaccagacacataggggatttgaatcttaggtctgctgtctatagctttctgatcttgagccaaatcacttaacctctctcacctgcagtttcttcattaataaaatcagctataatatctaccttatgtagttttgtgagaattaggaataatgtgtgggaagtgcctggcagagcaggcattcagtaaatggcaggcaatattattacttcagtgttgtacttgtgtcagttatcatactgtggtagccatgctgtagtaggtaactgtggctgtcacaagtcaagcaccacagactgaattggttgtggagaccagtcctacattcttccttcagatgctacccatgcgtatagtgcgtgtaattaacccacagtttcagaacatttcatgttgcaccatataaaatttaggaatggggctgtctgctctcttttttggccttgtgtgacaatatgtgcttcagaaacattaaggaatataccccattaaggctgtcctaaattgtttccatttcttacaaccatataaaacgggaaattttcctcatacttccatagtgtagataacctagttttcctataagtaaatctgcatagaaactaatatgtattcttattttgctttatttaaagtcttaattgttttccaaatgtgccaagcttgtgttttatcaaatccttgccattctaattttcccattatagaaaaaataaattaaatttcaaaa

SEQ ID NO: 399007 - DNA, 164 bp, Homo sapiens
agtgggtaaacgtgcatgcttccctaaactcttactaaagcaacatatccaagcttatctgatgtggaaaatggcaaatcactttttcaaatttgtattcccatttgaattataataaacatctttttattaagcttataagctacatttctttctttctcttg

SEQ ID NO: 399008 - DNA, 260 bp, Homo sapiens
tgtcaggattacaggtgtgagccactacacccagccaatgtttgtacctctattgggaggcacataatacctagtttctctttttaggatgtaaggaataattgacatttattgactgaagccatcgtttcatcgggggttgcaaaatagtgctattctaattctgtttccttctgtagttgccagcttgactacttctatgcctgtaaacttccagtaatcaagtacttagttatcctgagatacagtctgtataggag

SEQ ID NO: 399009 - DNA, 579 bp, Homo sapiens
agacagaaagatgagtaatataacccctacgtaaagaagctcatagactaatgaggaatctcatattttgtgggaacacttattacttaggtaaaccattagctttcatttcctcctctctaagtccagataataataataatacataactcagagggttatctatgggggaaaatgaaattgtgaaaagtactacaaaaatgctatagaatgttagatgacatattattgactgagggatttctggataagagattactaactcatgttttctgaatctcgtgatttaaaattttgtagtaaattagttatgtgttgtgtgataaaccatataaaatttagtgtcttaaaatcacaacactttattgtttctcattgttttactggttgactgagtgattttctccctggtcttgtttgggctcattcgatatctcctcactcacctgtctggtgcctcggtgatggctgttgtgtgagccgctttcatcatgcagtttcttcattaggtagtccagctggattttcttacatgacagcagaaacagtcaaagatgtaacaacagaatggcaaggcct

SEQ ID NO: 399010 - DNA, 353 bp, Homo sapiens
gaaaaggtcagggagccgaaggcctgtgggacgtgaccaactcagcattcctctggaggctatatgatcaaacagcaaactgtttatcaagaatgcaggatatgggcaaactcacacttccctgccaccaaaaggtttgctgagggacatgtctcccttgcaccgggctccttgaagttatctaatgagaaatctagcacctattattcaaaggatgcagtcttgcaagcctgctgtgaaccaaacggctgactgacaattacctgacaatcaccctgcctttctcgctctctcttttgcctaataaatatggagggctgtgtaaagctcagagcccttgtccactagaggca

SEQ ID NO: 399011 - DNA, 181 bp, Homo sapiens
gaaagtaaattctacttgaagctaaaatcatataaagagattttataaggaagaaacacaaagcagcaacctgtaaatttcagcctaaagaaattcaaatgcacaaccgtgaactttggtactgatagacataagagaggaaagtgacccacagagcctgcagcacaacttaaggaatctg

SEQ ID NO: 399012 - DNA, 624 bp, Homo sapiens
gtctgctatttgctcaggtttctgacacaaggtggtgatctaatactacataggaatgatgaaaaccttttaaatcataattgtttgctaatagatgaagcctgctaggaagttacacagagcatgagtgaactactagatgttgtaatttttataaaaatatgctaacaagtatggtaaccctacgcagaatcaaggaccagtcttcccaccacttcagtcttttcgagcatgtaactgtttaccctgaactgcactgggaaaaaagccctgagtatctcgcatagcacctcatacagttgtcattcagctcagcacaaaagctatgcatttgctctttggagagtttttaacaggttattcataactacagtggctcacagagttgatgggaaatagggaaaagagagagagaaactgatttacaataagtcctgtataatatggctatatgtagtaaactggaatccttaggaaagcattgtgtaaaagcatggatgcatatattttttgttattctatgataagcagtttaaatcatttattttggttttaataaacttcagtattttaaaaacccattcatgtgataaaatgattcttgatcctccagcaattccagat

SEQ ID NO: 399013 - DNA, 419 bp, Homo sapiens
caagaagagctcctcattgtcagctgcctgtgggtctaggggccctttgctccagcagaaggtgctgcagtgagccacaggactccaaatcaccaggtgctgagcagctaatattcccagacagcccttataaacagcagcacccaaacctggagtacttggtgctcaagtagtgtatttgtcttctccccgacaacacaggcaattaacaaggccaccttcccttgtttgtcaaataaggagagtatagtaataggggacacatttcctgccctaaaatcatttctccagcagcataccctggccctggatcacctctcctcaggaataatgagagatttcaggattgtgtatcttcttttcttgctgtgactcttgttttataaatttcctgaaaaaagttcattccttaacccatt

SEQ ID NO: 399014 - DNA, 436 bp, Homo sapiens
cagcattttgggaggctgaggcaggaggattgcttcagctcaggagtttgagaccagcctgggcaacacggtgagaccccatctctattaaaaaaaaaaaaaagtaaggttttcactggatgtgtgagcagctgcatggaccagggccgtgcatcacatgggtaacatccgtggagcaaggtcacacgtgactgcttctctcactagaaatgagtttaaattctcagccaggcagatggtggtgtgaggctcaacttgatcaaaagtcacaaactttttctgcaaagggctcaagaggagtaaatattttcagctttgtagttgagatggtctctgtcgccacgattggactctaccatgctagcatcaaagcagctggagagatacgtaaatgaaagaccgtgtctgtgtcccaataaactttattgatacaaaa

SEQ ID NO: 399015 - DNA, 276 bp, Homo sapiens
agcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagta

SEQ ID NO: 399016 - DNA, 529 bp, Homo sapiens
aacgcaatatggttcttcattagagctcagtgaggctgcggattattttccccattatgcagataacaaaacaaggcttagagaagtgaataacttgcccaactagtaaatctaagaggcattaccaaaatacagacacttctctgactccaggtccagcggtttccccgacctactaccctcagacactgatattttggctggtgctatcagggtctgcaagagggtataaaaagagagaaggtatgcatctaaggggcaactgtatagcgttgtctcaacttccatcttcactggtgttttgctttttgccttcagtgcaggtgaccgcagggtgttggtgcactcacagagctgacagccagttaattttattcatggctttgatccctgtgccccttctagcatcaggagtgaacatgagagttttcaaccccaaagaaaatggcctcttgagggaatagtggtttgggtgaataagagaaaatgatagtttgatgaaatacaacctctgaatggatgcctgccg

SEQ ID NO: 399017 - DNA, 420 bp, Homo sapiens
gtttgcttatttgctttttaacctgtcagcttactggctagtctctctccaataatcatctatttgttagccatggtaattctgatgccactggatttggataacaagaaacctagaaaattattattctgatataataggttttaaagtcttgtttttattaaagtttcttccttgtttagagtctcatctcattcacattagtttgatttgttttcaggtacagagtctaaaaatattcatcagttacaccagttgttcgcaaccttgattactcttgggaatttaaaaaataacaagctagctgggtgtggtggctcacaactgtaatcccagcactttgggaggccagggcaggaggatcacttgagcccaggagttcaagactagcctgggcaacccagaaagtcttcatctcta

SEQ ID NO: 399018 - DNA, 435 bp, Homo sapiens
agccaagagcgcttgagttgagtttgaggggaagatgtggagcgtgtggttctgtgtacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtctgagcctggaagaggctcgggtcccccccggcgtggttcccttcccgtgtctgagcctggaagaggctcgggtccggctccgagcgtggttcccttcccgtgtctgagcctggaagaggctcgggtccggctccgagcgtggttcccttcccgtgtc

SEQ ID NO: 399019 - DNA, 841 bp, Homo sapiens
gcgcagctgggatgaaagcttgccaggacatccccaactcctcgggaagacagggatcctctgctgagctatttagggacttctccagtctactcgcttaaagcaatagctcgtattcagggtgactattctctgaaaccaggttcccactttctgctttggccttgacttgcttcatgacctagggtgaatcactcctttcttcttgggcccttttctctcatgtgtttgataaaataaaaacacatgcttcaaagtattagtgcaaaagagaataaagcatagactcttgagaaacatttttgaaagccccatggaaataaatgtagagttaccatattcttcttgaatatagacatcaaatagggaacaaatgtgctaagaaacccctttaagcccaaaataacttcttgaaatgcaagatcccaatgaatccttttagcccagggttgggaaagtgagcaagtgatccagatttgcatcccccatcaatgactgaccaccactataagcatgtctctcagggacaccaagaaagcactttgggaacttcaatcaaataggctacatgaagatgaaggaaaaaattacagcctttaatacaaaggcgatatcaatttgaataataatagcataagaccccataaagtaggtatagttttaatctccattttccagatggaaagtctctctcagagattggaaaaccttgtccaaggtcattcagctaataagccaggattcaagctcaggtctcccacctctcttacctctacttctttcccacagtaagagacgtatagaccagaccagacagacgtataatccagacatacttctt

SEQ ID NO: 399020 - DNA, 456 bp, Homo sapiens
gaaaggttcattcatagctctttgaaaatttttattttaataacttgtgtgctatgtaagactttcaatagctgtcctgtatgtgtatcttaaaaatacttttggtggcgtattacacttttctgtttgggctcacatttcagaactgtcactaaagctgttttctttgtttctggccccattctcctacccaagtacagcatatttttctagatatacaattatcatattgccattcttctgactgtaagtacatggagtgaccacagcctacatatttatacttacgcctaatcagcagagtagtgactggccatgttttgaaaagggatcttaaggcagaaagttgcaacaggagataaaaagggaatttggcagcagcttcttctttcagtgttgaattcattaaactttgtaacattgtttcaccccaaattaaatatcttttttaacacc

SEQ ID NO: 399021 - DNA, 486 bp, Homo sapiens
gaaggcggctagagatagaaaaccacccagctctgcatcctgagacaaagaagcctttccctgggctcatatgatagaggtacgttgcctctgggcctcagttttgccatctgtaaaatagggtgaaggtcagattagattgggcatattcagtgtgggatccccctaatgacggcatcagcatcacctgggaaactgcaaattctcctttatgacagtggctctcaaactttaatgtgcattgaaaccatctggaggagaggagcgtttcccacttgagaaccacacagcgggatcagggaggggcgaactatagtccaccggccaaatctggccatggcctgctttttatggcccatgagctaagaatagttttttccatttttcagtagttggggaaaaaaatcaaagaatattttgtgacatatacaaattatatgaaattcaaatctcagtgtccataaataaggtttcgttggcaaaaaa

SEQ ID NO: 399022 - DNA, 841 bp, Homo sapiens
gaaggcggctagagatagaaaaccacccagctctgcatcctgagacaaagaagcctttccctgggctcatatgatagaggaggattgcaagctcttcgctgaaggatcacaacttatatccctccttctggtactactaggaaacttcgcagttcaataagaagcattgtctcaaactaaatcattgcttgttgaatgagcacagactccgagcaacatgcagccggggttccatgacagatgagacctagcctgtccccaggtagcaacgaaagactgaaatgatttaaaagcaaccaagaaagggtcacaaggcattaatacagccacctggcaaagagcatatctggagacagacgttgacagccccgggtggacattagttctataggatgttgtaagaggaatgaatccaggcagggtgaggaggcggtgggaagtgagcccggccctgaaggtgggcaagagccaggcaagaagaggagaaagattgttctcatggtgggaggaatgcaaggccacctatggaaatacaagtggagcagtttggctggagaaaggggttgtgtttgcttatggaggccttggatgccccgttgggagaatggacctcactttctggggctgactgtgttgcgattttttttctcttgagccatgcctggaacacggtttgtattcaacagcaacacacaaactgacagttccctgcaaggctgtcatatgccacttgcttcacagaaacacctcgcttattttaagcctgaaaacaaagccacaggatgagtattattctcattcctatgctacagataagaaaatcgaggtttcaaaagacgga

SEQ ID NO: 399023 - DNA, 393 bp, Homo sapiens
tcgtcccatcagtcagtctcagtttattccactcggggaagatcctctgcttggccatctcagcaatgaactcggcaagaaagcctgtcacccaagaagcactgatgccgtcttgctcccatcagccagtctcctcccaaagtgctgagattacaagcttgagccaccatgccggttgaacttatttttatctgtgttggccatttgtagtttttctattatgctggttccatttttctgactttgaagagccttttgtggaaacgaagcctaaagtatatgtgagtactgctttgtttcgtcagtttttgttttaaagagacttttcagtgtaatgcaagcattttcccttgaaggctgtgtttcctgtcaatcctaagctttcctccagca

SEQ ID NO: 399024 - DNA, 303 bp, Homo sapiens
cagacgatacaaatgcttagaagagtcactgccaattcagttttgttgatagagattattgtagcctctataacattaaaaacatcaggtttttgactggttccaccaagtacaagacttcaacttttctctgatatccttttacagaaaacttagcgtagagatagtcaattgagtctgtgatacactcaggacaaaagaatgtcctttacacataaacaatgctcaagtgtaagtctgggaattgttcctgtgctgtcttaatttctccactttaacagtgaagtgttcaagagatggccc

SEQ ID NO: 399025 - DNA, 583 bp, Homo sapiens
tagttcaaaactcctcctttctttaattgctaggtttaacgaagttgaaaaaccctaacttgggaaagtctctttgttctccccagctgctaatcacttcctactctttgttgtggaagagaacacataaagtcttattatttagaggcccctaacagaataggatactggtcctggggacagatccccaactatctgaatttaatcatgatgctcagggatgtgtgaaagtgtcttaggtgttcatgtctttgacgtttgacctaggttatagatgtctgtgaaattctgtcaccataattagatatagatactactgatttccttttcccagtcttccaacccagcctatgaccctgagtaaaaccttcttaaattcttttacttcagtagcacacaaaaaatcataattttggatcctgttccttgctctgtcacctgcttgctgcagttaagtctgctctgtggcagttttccatttgcaagcagggcacccttccagttaagttgtaaaattttatgtttaagtaagcccctgtgcccttgaagaataggagctacaggaatgtagagtccaaagaga

SEQ ID NO: 399026 - DNA, 185 bp, Homo sapiens
gactatttattatttttatgtacaggtatcaagtcctctagttactttgaaatatatataatattcttactagtacagtcaccctattctgctatcaaccattggaatttatctattctacctaactatacatttgtacccataaccaacctctattcatggtccctttcccccaccctcccaac

SEQ ID NO: 399027 - DNA, 555 bp, Homo sapiens
ccacccaatacactgaaacatctttatcccatccctgttccccagccatttggttctccacccccaaggcaaacagtattttcaatttcttatatatctttcaagatattttatgcatatataagtaaataagaccattctcctctttgcctgcttccttttttcatgtaatatatcttggagcttattccatgtctcaatatataaagagctttcttgtttttatggatacatagtcatcctgctgtttagacgtgccacaatttatttaagcagtcgcctattgatcaacatttgggttgtttctaatcctgtgctgttaatagtgatactgcaatgaataaccttgtgtatatatagaaatcactttgcatatgtgttattctcatcttgaataaattcctagaagtaggattgctagtcaaagagtatgtgcatttgtaattttgataagcattactagattgtcatggagagtaccactttgaactcccagaagtaatacatgaaaatggctgtttctctataccctcaacctttatcaattctacagtg

SEQ ID NO: 399028 - DNA, 468 bp, Homo sapiens
taaaagtttaaccacagttaagaccacgctgctagcaatgcaatatgagacagtgtctttccagaggagtaatcccttaaaaaccaaccaatcaaatgcagagatatgccccatccagctttgctaaatagaagcaaatagctcactttattgtacaaagactcaagaggaagacttagaagcccaccccctcccccattaaagagaaagtacagaaacaaattagaatcgaaaaaatcatggcctgattactaaatcaaaacgttaaatgtgacagttgtttttagaagcatcttacatttatacattttgatgacttttgtattaatgttagaaaattgaaagaaggcttcactggatgtcagtcgttacagaaattgaaatatccaaaagtatatgtataaccaattgagtaatttccgctttccttacacacttgaaataaattttcttttgcttttacaaata

SEQ ID NO: 399029 - DNA, 547 bp, Homo sapiens
gcccagcctcagtcctgaaatgcttatgaatatatgaaaagcaagtgtatcaatggaagatatatacgtaatgtttacaatgaaatagcactatcatattcaatttttatcgtacccatttgaaactttcaaatggattttatacagacatttagattgcttccccaaatatcaaattttaaaaaactcttaaattcagtccacagatttacacaaaatgtatcatcctttcaaatctcaagagagttatgactaaactgggccctacaaattagtttatatgaatccagataacagtaacaaataaatcttcaccccaaaaaaataaactatatttaagaagtatttgattatcttttacattagagagtcctcagtagacaggcaaatcaaagaatcactgcaggcctgtgataacattcgtttaaatttgctaaattatccatgctgttcccctcctttagccaaaaaaaaaactgaagtttttttagtttgctaattattctatacaacagagattcacctactttaaaggatcttcatacaa

SEQ ID NO: 399030 - DNA, 159 bp, Homo sapiens
tttttttctatttatagagttacaggaagttgtcttagctgctgatttgctggaaggtgacatgatagctgggaagaacttggaagactttctaagaaatgttgggattaagtcacctaaagaagaggtagagaaaattcttcaatcagattttgtttc

SEQ ID NO: 399031 - DNA, 272 bp, Homo sapiens
aaaagtttcattgtccatcctactgcctcagtagagattttatctaaactcaattagataaaaacaaataccacaggaaccctaggaaagcaagtcgcgccttcttgtgatgaaacggtccaatgctcagcatccttttcctttaggcagaagatatttctatgtggcctgttcatactaatatgagaagtcttatccttatgtccttaactttaaaaggtcagaaaatagattgtaaaatctatagaataaaactatgtttctgttgaata

SEQ ID NO: 399032 - DNA, 377 bp, Homo sapiens
tctggtggctgaggcaggagaatcacttgaatccaggaggcacaggttgcactgggccgagatcgtgccactgcactccagacagagtgggtgacagagcgagactccgtctaaaaccaaaccaaaccaaaccaaaaacaaaaacacttccatccccgaatgctctgctcagggagactgatttgagtaataattaagctccaatctcccgcacagctggctctgtgtgaattgctctttcccctgtcttgataaatggggtctgtctaggcagcgggcaaggtgagccctttaggtggttacaccttcacgtgggaacatggaattgagcagaaactgattccatgcctcccccaccctcaccccctgactctctt

SEQ ID NO: 399033 - DNA, 532 bp, Homo sapiens
gcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcaccttggacaggagcagatgtgtggtggggttggactctcttctggagacccagacaattcagtctccagatttctggcagtggctgtcttttgagggccccagccacaaaggccacatgcctctgataggagctgcctacatcaggctttgtctgacttgcacgctcagcttcccaccctaacccacttcccttgttgcacatagcttatgttttagggactttcctggaagcaaaggcagtcacatctggcataatcataataaagaaaacaactatcatttgg

SEQ ID NO: 399034 - DNA, 381 bp, Homo sapiens
tcttagtctagagatggagtgggcttcccagagtccaggaacgaaaagggattaatgctgggctctcgcaaaaacaaaaaacaaacaaacaaactaaacaaaaccaggaactgggctttgtactttacaaagtactagggcatctattatgccaccagtagggttccagcctctttacaaccgccaggtttccattttatagccccagaaactgaggccagagggggtaaatgccttgctaagaatcaataactgttaagaaggtccaggggtggtggttcatgcctgtaatcccaacattttgggaggccgaggtgggagagtcacttgaccccagagttccatctagcctgggtgacagaggcagagacctgtctcaaa

SEQ ID NO: 399035 - DNA, 126 bp, Homo sapiens
caggctggtcttgaactcctgccctcaagtaacccacctgcctcagcctcccagagtgttgggattacagacatgatccaccgtgctgggccagtttctccactttatgatgactttttttttttt

SEQ ID NO: 399036 - DNA, 536 bp, Homo sapiens
gcacaatgtctactataaagtagatgcccctattacttccctctttacatttcttcataatccttataacgacctcatgttgtaaggattattaactctagtttacagatgaagaagctgaatcacaggaaggttaaggagtaagcctacagtcacatacctggtaactgtcagtacccagatctgctgtgccctaaaacttgacatggacatgttacctcactggatattttactctgtcatattatgaagttcagaactttgtttgaattatgcccattatgctttaaattttaatacaagaacaattattttcaaaaaccagaatcacccataatttccactcataattttagaggacaaagacctgtaaatagcctacctatctagaaattcagtaacagaggacacactccagatctcaaaatgaactagccaaattactcattacaagctctcatttacacagagaatgatttctaaatgcatatcaataagaatgagtggggagcaaatgaaccaaacataccacagaa

SEQ ID NO: 399037 - DNA, 408 bp, Homo sapiens
tgtatttaaaatactataaggttattattgcttatatatctaaaaatgctccaactgtccaaacaaagcttatgctgttgatgatatttatcagtggctctgaacacttgcatatcataaaattctccctcaaaatttaaccttaaactctttcaggcttgtcttggtcacagtgggaactgaggacagctgctcatgtttttttatagaacagctcttaacatgcttttgctcttgcctcccactgcccaacaccagctgcatacacacagtctacttgctgtgtgcatgctctggctcctgtctccttttccttcagcctagttagcctggttttgtttggtttcatcatacaatgtatctattagtaaaacttttatgaactctgattatagtactaaactcata

SEQ ID NO: 399038 - DNA, 478 bp, Homo sapiens
ggccaggggcccacagtgtccacaggcatggctcgcggggaaacgcagtgcagcgcacacagaggtctgggtgcaggtagaagccatttgctgcccagccgggtcccagccagccagcccagtcacctgagccaccctggggccatgctcagatggtctctgggtccacctgtgcctgccttgctgcttccaggcaccttggccgagggcagtgccctaccacccctacacacacattagccgtgtgtgcacacatgtgcccacatgcacatgcacacatatgggatgggaaaacagaaagcagctctttgcccccacaggaagggggtcactgcttggcctggtcttgtcagctgcagcccctgggcctctggggggccatgtcctctggccatctacctagggccacccctcagtaaagaaccccgggcagggatcctgtttgtgaaaatgcctgaatacaaggtcatctcagcca

SEQ ID NO: 399039 - DNA, 437 bp, Homo sapiens
agcatttagaaaatctgcatacttcagtggaccaatgttttttaaatgaccagtgtctgacattgcaaaataatttgtgggtaatagtttcattcaaaatatatacaacaaaagatttgaatgtaacagtatacataaagtatatgtttacataaagtatacataaagtatatgttgataaggtttcagatttcacaatgcaactagcccttcagaaactaccactcattgagttttgatgtggtatcaaagaagaataattatttgaaaaggtcattataatactccccttttccaactacataaatgtgtgagtccatactttcttcaaatatgtcaaccaaaataatactttgcagcagattaaatgcagaaacagatatgagaatccagctgtcttctctcaaaccagacattaaagagatttttaaaatgcc

SEQ ID NO: 399040 - DNA, 195 bp, Homo sapiens
tttgcagatgtgctgcctatctttttggaaggagcagagaaaccaaaggaatatttcatttaaagtcagacaacagtcacatctctgaaaaacatttgttttacttgagaagaaaaaacattaagtgctgggacaacaggatttataatactatcacaggatttttggagtattagccattgcaacacccactaa

SEQ ID NO: 399041 - DNA, 208 bp, Homo sapiens
ccagatggggaggactgctctgctcttccaatggtcagcctggtaggatggctccctgtgaggaagggggtacgactggggttgccagcgccccctgaggctggatggatttaactcagagtcagggttagggagccctgccctccaggccagttctcacaagctcgagaggttttcctgcccatcggtttgactcctggggctgcag

SEQ ID NO: 399042 - DNA, 554 bp, Homo sapiens
agtgtactgcacgtcctttgtgtcacctctcctaatcctcctagtacggtgtcgtgaatgtgtcccatttacctgtgttcatccttcatgacctctggtacctggttgatgcttgtatgatttaataattttttgggttgcagaataaaaaaacttggctcaagctgtctgtgacaaagactgtgtgatttatcaaggtctgtctcatttttcttttggtagacacataggacagatgcatttcctagtctcctttatgggtagcttgggactgtgtgactagtttgggccagtgggttgaaagtagaggtaatgagtgttatgctagactgaggcataggagagtggggatgagttttctgggttcttgctcccctgccatggtgattctggaagctttgtgttccatgatgcatagctagaaaatgatactgacctggatccctgagtcactgcttggaggagagtttctctggtgggtggctggatccactatagactttctaagagccagaattgcatgggatctattcaacttgtttttacccctgagt

SEQ ID NO: 399043 - DNA, 339 bp, Homo sapiens
aaccaaaatccacaacatacaatatatgcttacaccaaacactgtcacagaagccaaaaatactatcccagtacaatgaaatgaaaggctcacaagaggataggattcacagagaataatcagcagttaggattacttaggattttacaaaataattaaaatgaagtaatccatacagttgatgttgaactgtacatctaaaaactgaaaccttaatttttttttggtcatgaatctccattctcggtcagtactttaaacaaaatttcactcgtaagttattaacggggccttttctaaaatggatgtggctggcaaatggcatacaagtagctaagg

SEQ ID NO: 399044 - DNA, 229 bp, Homo sapiens
ccataagccctaaagagaaaacaagaaagaagtaccttttgttgaaagaatcagcaactacataccaatcatcaaaaggcaggtgaaggcatgtgtagtatattcaggtggtagtcttgtttctaaactgcttgtagtctgtaagctgtggctgtttgcgaagcaaatgctttccagatggaaaacttgactaagcagaaaacaagaacttatgccacacacagttagc

SEQ ID NO: 399045 - DNA, 410 bp, Homo sapiens
gaaggaaggcaggccagccattcaaattgattcgaacatcagattctttgaacttgcacatgtgatgtggtttgactcccttataaatacatcgaatttggtggcttaaagctttagagtggatcatgaagaatctcacaggggtcaaatgagactctggccccaaattatggatctgtacttggggtacattttctttcctggcccctacaaaggtgagcagaagacacatttcctttggtgtcagaagtggcttcatctttgtggtcctgcagggtaaagtgtgacacaagagaagacttaggtccagaagatgctatacataaagtggggaaagcaccttgcccctaaatgaaggcccctgagacatgcactcttttctgcccttcacatgatgaagtctcactttg

SEQ ID NO: 399046 - DNA, 776 bp, Homo sapiens
ttgtccaagctctcccagtgagctgatgccagagccaggactagaactcaggtctcccaattctcagcacagtgtgattttccttgcagaatgttgatgctcaaagaacaggaaccccagaaccccagggaggtaaggaagaagagcacagccaggatcagaagagtgaagaaacaatgatgtcccacaggtcacagggagtaagtagctgctctaggggtgaacccaagagtggtgattcactgtccaaactactggctggaggagagctcgtggtggtcatgtacgtgtgtgcatgtgtgtgtgtctatatttgagtggggcaagggaggggattggggaccgggggagaccagccttctaaacacatgatacaaatactatggctatgacacaacaggtgtttgtcaacctgttccagctcttcccaactatggcagtggctatggcctaacagctggaggcaggaacagggcagtgacaagaatcagcaactgcataggggcctcatcaatttccagtcctccatccagaagaggacaggacatgctcaagctgccccaaagagaaaggacaaaggagaggaattctgagatgcaagtccctatggaagaggggacagagttaaattccagcagtccaacagactatggctagagccatagtcttctcttacctgtatctttaacgttcagcttactattggttccttattatctcctgttagtgaggttcctttcaaaaacaataaaacaaaacaatattttcccgctcaa

SEQ ID NO: 399047 - DNA, 716 bp, Homo sapiens
gaaaaaggggcacagtgatgacagtacactttgatacaaccattctcccaagagacgcgatgacgagtatgtgcgtgactctggagggaaagggtctacatctgtctctgcttgtgcctcggatgggttttacagtagacgtaccactgaccccgcctcttcaccagaatgttgatgctcaaagaacaggaaccccagaaccccagggaggtaaggaagaagagcacagccaggatcagaagagtgaagaaacaatgatgtcccacaggtcacagggagtaagtagctgctctaggggtgaacccaagagtggtgattcactgtccaaactactggctggaggagagctcgtggtggtcatctcttcccaactatggcagtggctatggcctaacagctggaggcaggaacagggcagtgacaagaatcagcaactgcataggggcctcatcaatttccagtcctccatccagaagaggacaggacatgctcaagctgccccaaagagaaaggacaaaggagaggaattctgagatgcaagtccctatggaagaggggacagagttaaattccagcagtccaacagactatggctagagccatagtcttctcttacctgtatctttaacgttcagcttactattggttccttattatctcctgttagtgaggttcctttcaaaaacaataaaacaaaacaatattttcccgctcaa

SEQ ID NO: 399048 - DNA, 737 bp, Homo sapiens
gaaaaaggggcacagtgatgacagtacactttgatacaaccattctcccaagagacgcgatgacgagtatgtgcgtgactctggagggaaagggtctacatctgtctctgcttgtgcctcggatgggttttacagtagacgtaccactgaccccgcctcttcaccagaatgttgatgctcaaagaacaggaaccccagaaccccagggaggtaaggaagaagagcacagccaggatcagaagagtgaagaaacaatgatgtcccacaggtcacagggagtaagtagctgctctaggggtgaacccaagagtggtgattcactgtccaaactactggctggaggagagctcgtggtggtcatgtgtttgtcaacctgttccagctcttcccaactatggcagtggctatggcctaacagctggaggcaggaacagggcagtgacaagaatcagcaactgcataggggcctcatcaatttccagtcctccatccagaagaggacaggacatgctcaagctgccccaaagagaaaggacaaaggagaggaattctgagatgcaagtccctatggaagaggggacagagttaaattccagcagtccaacagactatggctagagccatagtcttctcttacctgtatctttaacgttcagcttactattggttccttattatctcctgttagtgaggttcctttcaaaaacaataaaacaaaacaatattttcccgctcaa

SEQ ID NO: 399049 - DNA, 324 bp, Homo sapiens
aagactcaggattgattccctggagagggtaggtagttctttgtctagttaaggatgggatgccataacaaacatgccaattcagtgaaagtacctactttcaagactcctgcttaactcccctaaatcagcagccaatgttagaagccaagtgttaaagtttttcagataattttgctataagcctatggagaaatttcattaccatctcatagcaaggcctatagtataagagcaggcctatagtagcatatgggggaaagtctaaaagactttgaaatggaccaaaagattattgagaaatggaaaactgcattgttttaa

SEQ ID NO: 399050 - DNA, 467 bp, Homo sapiens
agaccaggctggccaacatggtgaaatcctgtctctattaaaaatacaaaacttagccaggtgtggtagcaggtgcctgtagtcccagctactcaggaggctgaggcttgaaaatcgcttgaacctgggcagcaaaggttgcaatgagctgagatcatgccactgcactccagcctgggtgtcagagcaagattgtatctcaaacaaaacaaaacaaaacaaagagttaaagacataaaagactcaaaatgggaacaactcaaatacgcatccataggtgactggataagcaaattgtggcacattccatccatactgtaggatattgttctgcaataaagaatggactgctgggaagaaaaaaaagaaacagaattaaactaaattcccctagagttaaatatagaaaagcaaattattttgctttatttttaaatttttaattaattcaaagtgatttgctgtta

SEQ ID NO: 399051 - DNA, 184 bp, Homo sapiens
ccgttttagttaaaggtttccagtcacctcatataggccattgtaaatagaattgtattggtttttctgtcctctggtctttctcccttatggtcttctcttctgccattccagcccccctgataatagcaatgttgaactatttgtagttccctaaacttgctgtgctcttgaatgcctttgt

SEQ ID NO: 399052 - DNA, 531 bp, Homo sapiens
caatgagccatagcagggaatggaccgaactgtacatacaagatgaggaggggcctcgaacaacagggaagccccgtggagcacgcaggggagcctggacgcggggaatcgcctccgtttctcaccctgacagcagggagggcttcccggagctgacagtgaggcagacatcccggatcccagttatcacaggtgcagccacgcaacttttgggttaccttcccgccacgaaatggaaatgatttcctgagggccggaaagatcatttgcatcgggcctcaggtctggggctgggaaagcaggccccggccggaaaggaagactggaggccgccgccccagaggccggaccctcgcgtcccggccgcgtcccctcccggctggggatgcgcttcgggcgcggggctccctcgcgaggctggactgggtggagcccgagagcccctccggggagctggctgccggggaggcgccggggctgcggggccgcggggcgggccgggcctggagctccgcgctagaggcggccgca

SEQ ID NO: 399053 - DNA, 527 bp, Homo sapiens
taccagtgccctcacccacacccccacttccggcctctgttccttcctcacctctggggaaggctgcagggctccctagggaatgtcccctggttcctccactggctctctgcccagtgcttaacccttcttcccacacctacccattcagccagggcagtctcccacaaaactttctctccctggaccatggggcagtgcaaggaggacaggaagctgggtggaaggactgcaaaggagactgcttttcctgctaccctcaggtactgaagcccaagtaagagttttcagtagagagggagtagactgagtgttgggccctaggactgggcttccctgggtactatcccaacccctgagcctcgggagaggtggaaatgaccttcctctgcaccggcatgcccagagaagagagcctggagctgagacttgcaacttctagaaaacaaacacaaaactgaggccaagagagtgctgactactattaccaacaaaattcattaaacacaattttaaaaaatcaaaaa

SEQ ID NO: 399054 - DNA, 463 bp, Homo sapiens
cagaacacagggctggtaaatttgggtgccatggactttgattttgaggcaactgagtaccatgcagacattagaccagcagtttgtcaggaatgctcttggtgattattgccattgcttcttcattcactcaaccactattcaataaatcaaaagtcctatgcatactgctctgttttctcccatctgtcatttaccttccacttctaacatcactactatagtttagacagatccttttcatctcagatgcagattataataaacttctcacagttcccacagcctcatatctcttcctacccacaccttggtttccattgccaccaatttaacctttcctaacctcctcccacaccttttctcagcacaaaacccaaaaatgttgacagcaaactttgccatcgtcaggaagatagataggcaccttccactttccccaatcaaaagccagtaatgctct

SEQ ID NO: 399055 - DNA, 451 bp, Homo sapiens
agcaggaaaagagcgctttagagatcctcccttcagtatttggtagctaaaccctgagatggactggcaattacacctgcatttccacccaccctccagggatctagggcatcccagcctgcacactcctatcattcatccctgccccgccccccacatacacacaccccagtaaatgcagtgaagagtcatacaggatagggtcacacccagcaaacataaacattgtgatatgcaggtcatgtttgatgactgaacatttcctcctgtactacaattccctattgtttttaaaaggtgaatcactttattgacagcagcttgaaacttagagtagcaagactcttaatttgggggctggtggtaaggatatctatggtgggatgtacagaaaggataggagaagataaaccttttattaaatacttgagaattagttgaatgttaaaat

SEQ ID NO: 399056 - DNA, 796 bp, Homo sapiens
cccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatattttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtga

SEQ ID NO: 399057 - DNA, 363 bp, Homo sapiens
catggtgactcggcacgaggaggaggtgggctactacagggacatgagctgcctaactgccatcctcctcctgtatctgccagaggaagacaacttctgggcactggatcagcggatggctgaggagaggcactccctgcagggcaaatctggagattttctcaagcctctttatgaaaatggagagacctcacaagagatgctaatggacagctgaccctgctcactgctccatcacaggtgcgtagtatacaaacctctactaacttcttgggcttctgaataaaggaaaggactacctaatgacagtaatagcttgactgctgaagaattatgtcaattaataaaaattgcttcatagga

SEQ ID NO: 399058 - DNA, 330 bp, Homo sapiens
gttgtttgttttgatttactatctcaatagagtaagcagttggagtgatttctcccttattcagattatacagctctgttcttgactgattccaccataaagcctcattctatgggcacagcacaaaaccagagtcacaatctaaatctggcctttccaggacacacaatagaacacgatcggggtgacccaagctgtaagaagttagagtcctcaccagcagtgggtcaattcactaggctgctgggggaaatacttgctacagggagggacaactagagataattacaataaactcaatccatgccgcaagaacctgaatacttccca

SEQ ID NO: 399059 - DNA, 493 bp, Homo sapiens
tggtagttatcagtggtcatctcctttgtgggatacccttggcttcctcccctagccctcctcctccttcctctggcagccttgagagcatcaggtggatgcatgagccggagcccgcatgtgtaagaacaggccttgctgctcctactgtaagtggactgagtgacaaggaggctttttcaaggtttcctcttgactgaaacattctcagattctaagatggcaatgatggtgtcattccaaagccaagcagctactgtttgatatcactggtccttctttaagtcaggccactgctaccacagcacctccattttaacccaaatgaatatgatattacaaccttactctgtagctctcactgatttgctgtcttaccacgggggcaaatctctgcacttgtagctttccccaaaatgcagggcgttcttctgcccaccataaaagatactataagaaactgtacgtctttggccacttaacagtacaaggc

SEQ ID NO: 399060 - DNA, 454 bp, Homo sapiens
tcccaaacaccagccccactcccgcccggactggcaacagcagacgccaaaggataaagggggtatatttaataaagtgagtagatttcctagagtagggcacagcactgtcacctgctgcaagagacaagcctcccagtcgcccagccctgagtcacttcccctcccagcactcttgaggctcaatgcctgcggggggcaaaagacctggggcctccggagcacgccttccgaagcccacactcccctgcaaagacgcgcgcggggcctccctccagggcgcgtccccgcggctgccaaccagctctttgcgcccaagcccgcgccgccgctaccttggctaatggcagcactgaatgaaaggaaccgatgcaggctccggatttatgaatgtgcaggggaggaggggagggatatcatgtgacaataaaggagcgcgtcttattcacaaaaa

SEQ ID NO: 399061 - DNA, 418 bp, Homo sapiens
attataagtaatctagagatgatctaaaggataatcatgtactacataatcacattttggtcaacaatggactgcatatatgacagtggtcccataagattataatggagctaaaaaattactgtcatctaatgaggtcatagccactgtaatggctaaatttcatatttttagtacagacagcatttcgccatattgcccaggataattttaaactcctgggttacagcacaatgcattactcacacatttgtggtgacactactgtaaacaaatctactgttctacagtcttataaaaaagtctagcacacacaattatgtatagtacataatactggataatgataagtaacttactggtttatatatttactatactttttttatcattattttagaagttactccttctactt

SEQ ID NO: 399062 - DNA, 458 bp, Homo sapiens
ggcggagctcacacagtaatgctctgacatggggtggagctcacacagtaatctctggcagggggtggagctcacagtaatgctctgacagggggcggagctcacacagtaatactctgacggggcggagctcacacagtaatgctctggcagggggcggagctcacacagtaatgctctggcagggggcggagctcacacagtaatgctctggcagggggcggagctcacacagtaatgctctggcagggggcggagctcacacagtaatgctctggcagggggtggagctcacacagtaatgctctggcagggggccgagctcacacagtaatgctcactggccggctgctcacctcctactgtgtggcctggttcctaacaggccatggactggtaacgatctgtggcctggggactggggaccctgatttaaagaatcgaggacacactcacct

SEQ ID NO: 399063 - DNA, 206 bp, Homo sapiens
ctacaacagtatctaccaataatcacatacatgaccaaatagctttcacttctagctgccgttaagaagaaagaaaaggatgaaaagaaaaaaaatcctataaaccccagttcttgaaagcattagtctgtgctatgtgccttaggtacagattaaggaaacacaatttgttgatttattgataattgtgacagcaatcttccctc

SEQ ID NO: 399064 - DNA, 531 bp, Homo sapiens
cttgtccaggaatcatactttgagagtcagccattgctttagacatagagaaatgtgtgaatatatgaagtaggaagcatatatataagattgctcataacagtattattcatattaaccccaagatagaaaaaaagttcaagtatcctcagtagtgcagtagatatcattgtgtgtttacttatggaacaaaaaactagttcaaatagctaaggaaaaaaaccacactacaaacagctcctgcctgcatcaatatgtatgaatctcacaaatacattagtcataccttagaaccaagtcacaaaagattaagtgcaacatgattctattcgtaaacagtttaaaaacaaatgcagttaactgtattgtttaggaatacaaatataggtactagaattataagtagagatactagaattataagaaaaatcaagggaataatgatgataaaagtgagtgatagtgactacctcagggaggagagaaagtggatgtgattaaggacaaatgggagacttttaagataattgg

SEQ ID NO: 399065 - DNA, 252 bp, Homo sapiens
tatagctgaaaaaaagaagaaaaatttccctactatcaaatcttctcttcaacctgagcccaatgttcatctccctcactgttcctatcaccttccacttacctgtcttcttcatatgcgctgaggtccttgaaaccagaaagagtggagcttaatttaaattcatctcaatatcttcagctttaatctcactccccagcccaaatgagatgctcagtaaggtctgatgggtgattgaatggatggatattg

SEQ ID NO: 399066 - DNA, 1230 bp, Homo sapiens
  misc_feature (687)..(687): n is a, c, g, or t
cgtggtggctcatgcctgtaatcccagcactttgggaggccgaggtgggcagatcacctgaggtcaggagtttgagaccagcctggccaacatgatgaaaccccacctctactaaaaatacaaagttagccgggcgtggtggattgtgcctgtaattctagctatttgggaggcagaggcatgaggatcacttgagcccagaagttcgaaacaagcctcggcaacacagtgagatcctcttctctacaaaaaaaattaaaaaaaaattagctgggcgtggtggtgcatatgtttggtgtcagctacttggaaggctgaagtgagaggatcacttgagcctgggaggtcaaggctgccatgactgcgctgctgcactccagcctgggtgatagagcaagaccctgtctcccaaaaaggaaaagaaaacaaaaagaccaccaaaggggaaagatctaagttaccctaatcctaccacccaaagtagctttgctaacgttttggtttctatcgtatatgcaaatgtatcttcaagatatttaaaaaacaaatatttaggccgggcgcggtggcacatgcctgtaatcccagcactttgggaggccgaggcgggtggatcacttgaggtcaagagtttgagaccagtctggccaacatggtgaaaccccatctctgctaaaaaaaaaaaangttaccaatcaatgggccgcgttttaacacgtctggaccgtaaaacccttgcgttcccaatttaaagcctttgagcaaatccccctttggccaactggccgaatacgcaggggccccgaccggaggcttttccaaaggtgggcacctcgaaggcaagtggaattgtaggcttaaatttgtaaaaaatcgggtaatatgtgtaaacaggttattttaaccagggcgggattgggcaaaccctcttaataaaaaatctccccctcatgagtctctagggttcacattgaaaggccccctttaaggaggggtctcaccgcagggggcaaacccgtttttaagcgggcgcctctggacaatctcccacataaatttttggcggggggccctatctttatgtgcctcaaggggccccctttaaactttcggcgaacccctccgctgcagtaggtacatagagggctcttctgtcgtcctcacgcgggccgtcgttctacacacgctcttcctcccattcatgggctccctaccccgtctgtcttgtcc

SEQ ID NO: 399067 - DNA, 1410 bp, Homo sapiens
  misc_feature (867)..(867): n is a, c, g, or t
cgtggtggctcatgcctgtaatcccagcactttgggaggccgaggtgggcagatcacctgaggtcaggagtttgagaccagcctggccaacatgatgaaaccccacctctactaaaaatacaaagttagccgggcgtggtggattgtgcctgtaattctagctactcaagaggctgagacaggagaatcgtttgaacccaggaggcggaagttgcagtgagccgaaattgtgccattgcgctccagtctggacaacaagcctgggcaacaaaagcaaacccccccccccccgcaaaaaaaaagaaaagggttaggcatggtggctggccccaggctcccagcactttgggaggcagaggcatgaggatcacttgagcccagaagttcgaaacaagcctcggcaacacagtgagatcctcttctctacaaaaaaaattaaaaaaaaattagctgggcgtggtggtgcatatgtttggtgtcagctacttggaaggctgaagtgagaggatcacttgagcctgggaggtcaaggctgccatgactgcgctgctgcactccagcctgggtgatagagcaagaccctgtctcccaaaaaggaaaagaaaacaaaaagaccaccaaaggggaaagatctaagttaccctaatcctaccacccaaagtagctttgctaacgttttggtttctatcgtatatgcaaatgtatcttcaagatatttaaaaaacaaatatttaggccgggcgcggtggcacatgcctgtaatcccagcactttgggaggccgaggcgggtggatcacttgaggtcaagagtttgagaccagtctggccaacatggtgaaaccccatctctgctaaaaaaaaaaaangttaccaatcaatgggccgcgttttaacacgtctggaccgtaaaacccttgcgttcccaatttaaagcctttgagcaaatccccctttggccaactggccgaatacgcaggggccccgaccggaggcttttccaaaggtgggcacctcgaaggcaagtggaattgtaggcttaaatttgtaaaaaatcgggtaatatgtgtaaacaggttattttaaccagggcgggattgggcaaaccctcttaataaaaaatctccccctcatgagtctctagggttcacattgaaaggccccctttaaggaggggtctcaccgcagggggcaaacccgtttttaagcgggcgcctctggacaatctcccacataaatttttggcggggggccctatctttatgtgcctcaaggggccccctttaaactttcggcgaacccctccgctgcagtaggtacatagagggctcttctgtcgtcctcacgcgggccgtcgttctacacacgctcttcctcccattcatgggctccctaccccgtctgtcttgtcc

SEQ ID NO: 399068 - DNA, 136 bp, Homo sapiens
cagaaacctcatcagcagctgtgagactttctctggctggctgccaaccaaagacttcccacaatggttctaatttcaaactgcctgaccattatccttaaaaactattggagtgtgctaaaaggtctgatatttt

SEQ ID NO: 399069 - DNA, 525 bp, Homo sapiens
tggtgttctagaggatcccttccgggttggtgcatcccccaggtccctgccctagccccgcgggtgactaaacagatacatgttgctgcccactccacacagggctttgctgggcatggctggggcccatggccaaagcacagcatgccaggcagagaagggaggcaggcagctgggcagggtactcagggctgaatacaagagtcaggggcaatggcctttgagccaggcctccagcattggtgtgggaaggagggaggacatttctgaggcagggaagagccagggactcatgagtggcccaggctggccggaggactataggaaggagccatgcctggaggcactgaatgccaggcttaacctatcccggagccaggtgtgtgctcagggcctgcagaatgaagatacaaacgacatggagtccagacctgccatgctcagggagcccttgaaggtgcggaacagggctgagagtggtgagagctggctctaaagtgattgcctggttactgagtacaggat

SEQ ID NO: 399070 - DNA, 469 bp, Homo sapiens
atggcaggaaacaaggatcatgtagcatggctatcctattacacatatacgataaatcctcatataaaccatgaggtttagatacaatcactcttatttctcttattttgcggttgaaggagccaaggtcttacagttaaaggtgagggagcagaaattgacaatttttgtcttatatacaggtggcatagtcaaattatacacatatacacaaatttgcatatgtatacatgtagatatatatgtatttgatcaatttcattaatttcaatgatctatatatatgcattactttgggaacttacaaaattgctttgaaaaattataaaattcaatgtgctaaaagaggaataataaataacactgggagagttggaggaggataaaggaaatgaatcatttgaatatataaaatatctggaaatggcatgggtatcctgtatgttagcacattaaacagacctataaa

SEQ ID NO: 399071 - DNA, 385 bp, Homo sapiens
ggtaactccctgaggcttcaggcatgttgcagggagtggccttgcggtaccctctgtatctctctcccctttccctttcccccctgggctggcagaggcagatgaacagcggtttgggttttgcaatgggagtgcacctgggacacgaggatggtatgacttgagccttccctgtgggcgctcctgaggcagaggacccacgccgtgcctggtcgcctcaactccccctattctcttctacccctggttcttcttatgggggtgtggactgggcagggaggctgtggaggagatagggttacagaaatcccaggaagtggaaagttctctgagactcttctcctgagtggagggcagacaccgggaccccaggacggcagagcca

SEQ ID NO: 399072 - DNA, 507 bp, Homo sapiens
tcttttgtatcaaatgcttcaatttaacatactcccacttagagatctcatgaataatctttgttaccagtagatggtagaagatagttattagaatacttttggtgaaagaatctcagagttaacttgttttgaggcattaaaaaatttaagggtcatcagtgaattgatgcatacctgtgaggcttatagggtagagctgggaggtgatgcaaattgacagggcatatatcccaagatcaggtacagaataattgagttgatatgatgttagaccacacttggctcaatatttagaagtaagggaggaatttacatagtgcagtggagaagtatgaaattctttttacaggcttaataattttttttttctatgctattagctgtcatacctggggcttattaagagtcatgctattatacagagttaggtttgggagtagagaacttgaccaagagctgcaaagttatggctgggctttgggtaggaagaaaaaaaaggaagga

SEQ ID NO: 399073 - DNA, 256 bp, Homo sapiens
tgttcccattgaaattatttaaagcaaaaagtagaaaaaattgtgattaatttcatcaaggtacttattcctattagtttagtctatcacaagataaccagaagtcaaaactagttaatatgttttaaattttgcaaaggatcatagaaagtgtcatattttccctaaaaatttctgtatgatacattttaaaaaatacaactgattggtttttgaaactgaatgatacttatgtagcatgttataaagtatattt

SEQ ID NO: 399074 - DNA, 423 bp, Homo sapiens
tggtgaggggactctgttagctaaactgaggaaccacaggcagggtggccttgaatttcaggctgaaggacccatcacccaagagtcttggcagcttcctcagcaaagatgaatgggcttgttaggtggtttttgttacctgatcagtaattgtttcaacactagagtttgtcgttactgttgtcctgttatgaagaattctctttaacaaaactcatgggaaaagggactgactcatgtgcagtttggcctgaagcatttgcgtcagtattctgctcctggaagagtatactttgacttatgcattgcttgcttaatagaccacaaaagtcaacatccctctggaagaacagctcgtgcttggaggcgtcacaagctccaaaagatcctgttaaggcaggatgtagtgtgaaacccacaagc

SEQ ID NO: 399075 - DNA, 464 bp, Homo sapiens
agacgaccttgctttgtgaataatcatcactctgtcactgactttacctctcttatattaaaaaaatgaatttattgtgtttccggctgggttctaaatacaacaaatcacatgtaaaaatacactgccttcaagagagacttcaagagaagttcaaatctaactaaacttcagaatatttcgaaatatgagaaagtggccatggaaacacaaactcacacagcttatacaacattcccggagcaatcctgggtgatgctattcccaaaacatgaaatcacagacctgggagagacgaccacggccataccgcatcccagccccgacaggcacagaggtacaccctgaggagacccaggctccccgcggtctgagagcaggaaccctttgctttattctgatggtcatgagcaggcccttggctcaactccctaagtcgtctcacgggtaacctctaggtcagc

SEQ ID NO: 399076 - DNA, 201 bp, Homo sapiens
gtccgtcgtacatctctggttggtgagtgagtctatgaagacagaagtaccagttctcagcatgggccatggactcatcttgtccacctcatgatatgatctgagggtgtcataatcagctataaaggtaattgcatactcaaagatgagacggaccattctcagttgatgaccacattaagcatagtcatggccatctgt

SEQ ID NO: 399077 - DNA, 303 bp, Homo sapiens
agctaattttttgtatttttttttttagtagagacaagttttcaccgtgttagccagaatggtctcaatctcctgaccttgtgatccgcccgcctcagcctccgaaaatgctgggattacaggcgtgagccaccgcctccagccacaaatactttttagtcgccataagcataatcaagaaatcattttgcaaatggtaagcttttcatgttgtgtattctttcccatgattagagaggtaaaaagtggcctgggatgcataaagatgtcgtagacctctgcaatctgccacattatttcttt

SEQ ID NO: 399078 - DNA, 495 bp, Homo sapiens
ccactgttgagttttgagagttcttcatgcattccagatactggccctctgtcagatatgtggtctgcgaatatttcctccctgttgtagcttgtcattttccttctcttatagagtctttcacagagcataagttgtaatttgatgaggtccaatgtatccatttttccttgatggtaattgtgttttaaaaaataaagcttaaaattttgttttttgttttgtaattttgcactttttttgttttgtaattttgttttgggggctttgttttgtgttttgtgattttgtttttgtttttgttttgctttgtactttcgtataaaaaaatgaataagggactgctgccgccatctcttccttaggattcatcctctcctagcctgactgcaaagtggagtgcaaccctgcagaaaccccttcctctctggtccctgaatattcatgtgggggctgttcctgttttaagtgaaataaaatggagacagaataaga

SEQ ID NO: 399079 - DNA, 563 bp, Homo sapiens
tctttgaatcagtaaaggtatcaggaatggtcaagtcacttatccagtattattcatcaaccatctaatcatttcttgcagaaatagtaattgagaacctactgtgtaccaggcattcttctagacattggggatagagtgattagtaaaagacacaaactgctgtccttgtcacacttgatctcattatgttcacattctagtgaagacagacaatcaagaagaaaaatattaaaaataggtagtgctaagtgccaattagaaaataaagcagggaaaggggacagagatattgggaagcaaaaattgctgttgaaaatgaggtggctagggagggcctcgctgagaaggtgacatttccagaagcccttggggaagggagggaatcagtatgccagtatctgggggaagaacctagcagaagaggaaacagagcaaaggcccgaggtaggagcctgcctgtggtgccctcctggaggaagggaccatgccattctgctggagcacagtcgtgaggggaaactgaagtctttgagcagaacgtagtgatataatttatgttt

SEQ ID NO: 399080 - DNA, 243 bp, Homo sapiens
cagcttcccagtagctgggactacaggcgcccgccaccatgcccagctaattttttgtatttttagtagagacggggtttcaccgtgttagccaggatggtctccatctcctgacctcgtgatccgctcaccttggcctcccaaagtgctggagttacaggtgtgagccaccgcaccaggcccaacaaagcactcttaaacttagtggcttaaaaccattaatctcacaattctgcaatcaag

SEQ ID NO: 399081 - DNA, 643 bp, Homo sapiens
tagggccggccaattgttaggttaaacaaaaagcactgtggcaaaacttgactcacttcactacggctaataattacaaaaggttgtgctggtccatccctcactctacttacctgccaaagtttcaggcaaagtctcaacaattgggatctaacctttaaaatcatttctttaatgttgacactccaaattgtccataatgaccctacattctgctcctactgttaataatcaccaactacttaatagtttattaaaaagttagcaacagacaaatacaaagaacaatgtttccactgtgtaccatacggattacagctcttggacctttgcttgagaacacagctttccaaggcccaaagcacagcccctgtcatcttcatacttcaaatgcagacatgcaagatcaataactcaaggttaacttttcttagatgatagataagatagctaaacttttttaaaagcctaggtaaaaaagagatgttttaaacatacccttggctacagctcaacttttaggtagctgatcctttctccattcctgccttctttccttcaagcttttctacaatatagccttatggttggattttatgttaaaatgtacgaatgtggccgggcgtggtggctcacacctgta

SEQ ID NO: 399082 - DNA, 436 bp, Homo sapiens
ttttggctatgaataacaatgctgtgaacataggtgtacaaattcttatgtggagatgtgtttcagtcctcttgggtagaactgcttgatcacatggtaactattttttaatttattttgtttcttattaaaaaaatttttttttttttttttttttgagacagggactcactctgttgcccaggctggagctatggtgtgattatggctcactgtagcctcaacctcccaggctcaagtaatcctcccacctcagcctcctgagtagctgggaccacaggcacgtgccaccatgcctgattaattttttgtttgtttgttttttgagacagagtctcgctctgtctcccaggctggagtgcagtggcgtgatctccactcactgcaagctctgcctcccgggttcacgccattctcctgcctcagccgtcgacgc

SEQ ID NO: 399083 - DNA, 453 bp, Homo sapiens
gaaggtgaggtaggaagacaatagatgaggtttctgagagccgggttgatatactccaccatggggccaggctttgtagggaagtaatgaaaaccgggaggagctgatgggtccagaaaaaaagacaagaattgaggagctggggacctcaatggagtagaaaagctggtgttgagttaatggagtgagaaagcccaaagggtggaatgttgggatcagaaagcaggaatcctggaagtgaagatgttagccgcagaggggcttggggtgctgagaagattaaaggtgtagccctgggagcatcgctggagtgcaggtggagggtgctggagccggggacatcaaggctgtgtaaagttagggcattgatgggtcatgctcctgagcaaggagattttccacagtgatgcaggacagaatgaagaggaggactaacatcaaaacccttagact

SEQ ID NO: 399084 - DNA, 380 bp, Homo sapiens
gagcgctcaccatgccagattctgtgccaggtgctaaaggtggtaggaagaaaaagcaatgttccttgacaccagacatcagtgcttactaaacttcagtaagtcatggattagaggtgttgaatagtattcactacaaaagtttgaagtccatccgcaagagtaattggaccacaggttctaaattactgaccatttgtggacttcttagatttatattaatttgtatggtatattagcatttctctctctttcatgcaatacatatttgtaggtgtttttttgtttgtttgttttatgagataggttcgcactcctgtcacccaggctggactgcagtgagccaagatcgcaccactactccagcagcctgtctcaaa

SEQ ID NO: 399085 - DNA, 545 bp, Homo sapiens
gcagcgtgcttccgagggcttgggtgtagaggaaggggaacccgtctttcgcctgtgacagccttgcccttgggtctgggagcaatgaggactcggaacgtgagcctcctgctacaggtacaggccctgggggagtgagggcgctggcggacagcagtcttggcacttcacgttagcagattcggagtttctgcagcggctgaacccctgcactgggctggaagggggggacacccggaggcctgttaaccacactctgcctggactacaccatgaacatagatctttgtgcttttgaaatacaaaaaacgagctcacctggatacgaagtgtggttccggaagcagtatctggctgtggatggaggttatgtattccaccaacgatatcttcattattgttattttcctttggtagctgatctttcagagagatctgcagattcctcactttgctaagaagactctctgaaaacaggaagctaaggaactcctcactcccaagttgattacagcctcatggaagtgtggaattcttattaggaa

SEQ ID NO: 399086 - DNA, 218 bp, Homo sapiens
ttcattcgtgtgagggaggtaaagagcaaggtgtttaggagataatatcaagggaataccattttaacttggaggtaaggaaaggcctgaggaagtgatcttgatcttgggctgagacctgaaagataagaatgaactatctgggcacataatcaaggagacagcattccaggcaggaggaatagcatgtgtaggcccttcagtggaaaaaaaaaaaa

SEQ ID NO: 399087 - DNA, 473 bp, Homo sapiens
tcttgttttaaaatgatttaaaaataaatttctaattatggagaaccattggatcttgattaatatctaattaatcttaacctggaaaataacaaggaattggtatcttgccagtgtttagatttgtcattgaggaacatggcgtgtctttcaattactcattcaatggagttttgtaattatccctaaataggcaatctctagatcattcctgtgtgttttgtttgttgtttttattgtaattggcttattttttctttggtaaattttttccctttggtattgatttttagattttttcccttggaaacttccttttcttcagtgtttcccttcctacttgtcagtgtctctcttgaaaggcacaaacatccgtttccatcacttctgttttttttgtttttgtttttgtttttgtttttttgagatcaagtctcactctgtcgtgcaggctgaagtgagacttgatctca

SEQ ID NO: 399088 - DNA, 289 bp, Homo sapiens
caagagtgggagaggggcgtcctgtgacacattagtggggcttgctgtgacacccttaagaaagatagaacattcagtgtgatacaagtagatgagaaattatttgtgtcacatgggtggaggctccatgtgacatatgagtggaggaggtgtcgaacatgacacaaggatggaggaggaggggctccatgggacacctgggagggaggaggagctgaggatgacacatggaaggagaaatggctccatggaacaggaggtggaaggaggtgctgagtatgacacatag

SEQ ID NO: 399089 - DNA, 346 bp, Homo sapiens
tgcatgcctatactcccagctactcaggaagccgaggcaggaggaataacttgaccctgggaggtcgaggctgcagtgagctttgattgcatcattgcattccatcctgggcaacagagcaagaaaaagagttggagatagagataccactttgagaaatttcctcagataaacctggttgcaaagtgccaccctttgctcctcacccttcaataactgagagagcgagcagggagcaggcaggcagaaggaccattcccacaaaccagatgaggaaactgaagcttggggaggggaagtcagtgactgaaccaggagccgccttcagccttaggacagccaggcc

SEQ ID NO: 399090 - DNA, 169 bp, Homo sapiens
tcaagcagtcctcatctctctttgaagacagtggagttgattgtgccattaggaaaggaaatcctatttgaattaatttgcactcacaaaaatagggaatgttgcagagtgtaaaatacatctgatggtcagtggattttcgttcattcacccacttttcatttgggag

SEQ ID NO: 399091 - DNA, 430 bp, Homo sapiens
ttgttctggagctaaaattcacaatgcgagacttgctgctctgtccacccgagttggagttgcatccagtcctgcctcctgtctgccatgatctgttatgtttctttagtatctttcagtctagaccctcctgccccctctcccaatcacactgcctttttagagagaccagatttgtgttcttacaaaatactccatagtctgaattcttctgagcattcttacgtgccatttctttttcttttctttttctctttctctctttttccttccttccttccttgcttccttcctctgtttttctttctttctttcccctctctctcttctattccttccgtctttcttttctttttcttttgagacaggatctcactctattgcccaggctggagtgcagtggtgccatctcaactcactataactctga

SEQ ID NO: 399092 - DNA, 817 bp, Homo sapiens
aggggttgaggatgtgggcaggcaaagtagttctctactggacactccaggagaggaggggcacacgcagaccccagtgccatctctcctaggtctgcctaggcctccctgggagaggtgagtgtcatcagagcaatttaggcagcacttgttagcagctgtttctgagttttctggaaaaatcggttgtttctgggtgcgtgtgtttgctgtgggcaaagcttatatgctgtggacactggcagagtgagaatcagacagagaggggaaggagcagccgcctagcctccagcctgcccagccctcctccactctggcctcctggtactgttatggaaatgagtcagcaacaggctttctggaaaaggattctgcctgttggtcccagtggtcctccccaaccctcccaagtggagcatcttatctaggtctctaggtggtggcaaaagttctcaggagaacaaattccagggagagacacgagtagaaagaggcagagaaaaaggaggagatgcaattcggaaaatttttttcttcctcaatcatatcgcttgtatctctccccaaaagtggcattccaggcaaaggacaaacatgaaataactatgcttcaggggaaaaaagtttagaagatcttgcttcttgttaggagctctggcctgatttttcctgcctaggccccttctcctgcatgctggagaggagagggaccaggatattacatgctcccagatctcatccctcctccacgggctgtgtcacagaggagaaggggttattggcaccaaacttgatactggggctagagtcctggctg

SEQ ID NO: 399093 - DNA, 219 bp, Homo sapiens
tgtaaatcctaacgtgctgagattcaatgaaaataacttctcctatgtggaaaataacaattagaccctctcttgggtaggcaattttggcagttagaataatgtcatgctaaattagacagtgagaaagccatcacacaaaagggctataaaaatagccaaatcattttacatagcttaggttaaactgaagacagccgggtataatggctcatgcca

SEQ ID NO: 399094 - DNA, 387 bp, Homo sapiens
cttatgtgatcgttgtaagagttggtacttcctcaaccttttcagtattttctgggcctccgattttgtaaaataacatagcattaattcatgatggctttgtgaatataagaggattcaagagagttcgtggaagtttagggaaacttcataaacgaaaaactggaagtagctcaagtcagcctcagtaagggcaaaataaattgatatacctattcagcgaaatactgcacagctctgagaaccagtgagtcaattttgtatgccctgttaaagagtcgtgcctaagatatatttttacgttacaaaaatgtaaaactgcaaatagtatgagagcgtttacgtaaagatctttaaagctatatggatatataaacaacaaacgtg

SEQ ID NO: 399095 - DNA, 750 bp, Homo sapiens
gaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggaga

SEQ ID NO: 399096 - DNA, 401 bp, Homo sapiens
ccacttaggctcactataaatatctttctgaagccttccttgaatatactactctggcctcctacctttgctcaagctgttttcttttttctgtttcaccttcagctttatcttactcatgctaggtcagacttatcactgacttcactgcatttttgttggctgatttccagttagtcaaaataaaagaaagtggatagttttggcctttgaagcaaaaagagacacagggacctctctttccagcttccaactccggatatagcagttgatggtcgacatctcacagtaattattaggcactataattttgctaaatttacttaagctaaactaaagaccaccaagagcaccttctacggactgatgttatgtccctctctaaaagccatatatgttga

SEQ ID NO: 399097 - DNA, 347 bp, Homo sapiens
ttaaaatggtctattttggttactttttggaccattgtaatttcttattctcttcatagctaaaaaatatttgctcactgactatttgggtgaagaatgagaaaatgaaaagcatgtggattacaagtgacccggtgacaaggccattattttgaacccagggaggactacatgagtactcataagaactgctgccaatggaaggttttcattaaactcagaaaagcaggttgcttaaaagacagcccccaaatttctattcgattaagaccttgctgatcactgactacatgccactttccaagtcctctacaggcatcatcttatttaaccctcactaccttaag

SEQ ID NO: 399098 - DNA, 340 bp, Homo sapiens
catgaatagggcaaaggatgaacacagaggagtgacaaaaatataaaggtttttattcacttagtaaacattttattaaacatatgtgtatatttcccaggcattacgaggaatacagtaataagaaaaacagtgttgggggcagtttgggtagaggttattgtggaaaaccttgacttccaagcttaggagtttaaagattacttggtaaactatgagattctgtcaaaggtttgtggaaaagagaataacatgttgaaaattttattttaggaagcttaatatgacttttatattgaagtaagaatgaaatagagacatttcaatttaaatatctaaa

SEQ ID NO: 399099 - DNA, 644 bp, Homo sapiens
ggtgatgctgtttgtggccagtccctattaccttctagcactagaccactatacatctcccctctgtctccagagatttgccttttctggacatgccttgccagtggaatcacagaatggggtcatttgctgctgctttctttctgtcagcttaatgtgtttgagttccattccttttgtaatgtgtattattactttattttgattgacaaaaaatataataaagatataccacccatgtttttcctttcattccttgagatgtattcaggtagttttcatcatgaatagtgctgcagtgaatcttgttgtgcacgtagactttcatagcttataggcgcataactgggagtggaattgctgggtcaaaacaatagttccttcttaaacattttgagaaattgcctcattgtgttttaactggctgcactattttacactcccaccagcaatgtgaggttttcctatttttctcattcatgacaacactttttgttgttgttggattacaaggtgtaaagtggtatctctctgaggttttgattataatttccctaatggactaatattgaatatatttatacatactatttaaaatttgtatatattttggcaacggtaaaaatttctattaaaatctcatt

SEQ ID NO: 399100 - DNA, 252 bp, Homo sapiens
tacctctatctctgtaactcccatcaccctctgccctttagggacacaaagaacaaatagaatttctattccgtctgacagctggccattcaattatttattcatttattcaacagacctttattgagtaacaaccatatgtaggcgctgaggactcaaaggtcaaaaataccaaaccatgtccttaggaatgtcacggtctattacgtcatccccttgtaatagctcttttacagggcaaacactccttgt

SEQ ID NO: 399101 - DNA, 408 bp, Homo sapiens
cgcacccggccagtcttcccatttttaaaagccagaaaactgaggcactgggagctagggtggcacaagagcacatggatgagaggagtccaagccaattctgccagcctccaaagcccaggccctctatggcatcgctttccaggtgcagggtctccaggcacagcaacttagtggagaggggcacctgctgcctgccccatccagggtctccccctccaggcccaccttttcatcagcactgccttccccacgcccccggctgacacccctgagcgagtcacctttgccgctgccttgggtgtggaaccctgtgcctttcctgagtagtcattcattccctcactctggaacccacccattggctcctcattctttctctcactcctttatttattcaacaaacac

SEQ ID NO: 399102 - DNA, 516 bp, Homo sapiens
ctggggttagggaaattgcctctttccgtctctatctcttttaacttcgcagcgagagctggaagcagtgactgttcccatcacctagtgtccttctgtcaggggccgcttcggtagctacagaagcctagccgctggaagcttccttccccgacactccatacctccatgccacaccttttaggcaataaccaaatgtcattttgttctttccccttctcctgggcattatactgggaaactgtttacgcgcatcgaccccgcacacctccaaaaatctccactttccgggctccaagcagctctccgctactcagacagcccaggctaacacctcggatttccccatgcagtttcctctgcagcgtctcaatcacaaggctgtacgggcggcacatgccaacggaaccaccaccccttctgctccctcggggactcaagcctgctctcggtcaaagcacagaagcggctttcagctccgggcaggcggccggggcgtcgggggtactggaagtg

SEQ ID NO: 399103 - DNA, 438 bp, Homo sapiens
tcgctagaaacatttggatacatgacagttcgcttgctctgaccaaggaggaacagctgcccatactcagttccctgggtctaagagacactcagacaacatctttgttaaattcattatttgcaaaggcctgggcagaagaccaaaacagaaaaagaggagaaccaaatgacaactcggaggaaatgatcaggactgagaaggagaggagaaaatccaagaggccagaccctcacgtggaccctattgtctcttccttccaacctcccagcctataaacacctgtgctaagcccagctgcccagcccaggccccatctgtgggtgaggcctgagacttttcgaccttgccttggctgagcaccgttattaccacatgcctaagacccgtgctccaatgcatctatcaggaataaagctgatgtcttaagccccctgt

SEQ ID NO: 399104 - DNA, 239 bp, Homo sapiens
cctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttc

SEQ ID NO: 399105 - DNA, 206 bp, Homo sapiens
attaattgtttcagttacataggagccataggcagtaatagaaacatcacaagtattgtttccaaaaatatacccaactagagataagaccactaagatgttccctttattacctttcagcatttaatgataccagcttgtagcttccaaggtgatagagtgtgctgtgtacatacaaggcatagtaaacgtgtatttaaaacttg

SEQ ID NO: 399106 - DNA, 385 bp, Homo sapiens
catgaccctaaaacctgggtatgctaggaatctaggagaagagattcaaatgtattttcgcttggatataaaaatggggaggaaaagccacagtggtgacatgtcattttgcatacctcagaattccagagatccctagcttttgattctgtgcaggctctctgtggtactggctgtatcagctgctcttaaccatgaaccagaacatcttggagaggagctgctaagtgcctactgagtctgtagcatggaaaacatgtctgcaacgttaatggagagctccggtttctggggctgagagatttcaatcactgatattgtcagtgagtgagggtggcgggggccatggtgtatgcttgtctggaataaagaacatcagttttga

SEQ ID NO: 399107 - DNA, 264 bp, Homo sapiens
ggatttgagtaaaaatatccaacacaccatttgctgagcaaattgaataccgaatatactattgtaggaaattctggagtttccagtggctaaactggcaactcagtagagcctttgtggctaggaagagacaaaacaactggattttgttgaagagcattcccatttttttttttagaaaagtattgaaggagagagggaagcaacaaatctgatttagtgaagacgttttccttgacagcaggatttactcctgagttataa

SEQ ID NO: 399108 - DNA, 569 bp, Homo sapiens
ggtggcgcgtgtctgtaatcccagttacttgggaggctgaggcaggaggatcacttgaacctgggaggtggaggttgcagtgtgctaagattgcaccattgaactcaagcctgggcgacaagagcaagactctgtctcaaaaaaaaaaaaaaaataactttggggagctgagatgggaggatcacttgaaacgaggcgtttaatgccagactggctaaaatagagagaccaaatctctacaaaaaaattaaaaattagccaggcatggtggcatgttcctctatccctaactacttgggacgctgaggtgggaggatcacttgaacccaggagttagagcccacactgacctatgatgatggcaccactggcactgcagccagggcaacagagcaagacgtcatctcaaaaaagaacaaaaatgtaaagctagaaaatttgagacttttctagattgtccttttgacaagtagtttttatttacccacatttcttcaccatatttagctaagtctttgctgaacttactgatagctaactattaagtctgcagcagaatacatttttga

SEQ ID NO: 399109 - DNA, 525 bp, Homo sapiens
ataataatgacaatgacagtgagcactgattgagcgcctcctaggagccggggccctgcgtgcgtgcctcccggacatcatctaatttaataaacacggtgaaaggtaggtctaatgatcaccaccactcaaagtctatgaacgaggctcaaaaaaagggaagtcgctccccccaaggtcacagagggagtgtgcagggccagatttcatcctggggccacgctgaaatctgtgccgtccacaaccagcccggggatgctgcgcccgcccgatcgatgcatcactgggtccatgtaaacatttcagcccgaagtcgggcacaaaagaagcgcgcaaaagggacgagccgcgccgccgccagcgtcacccttgacggaggacccggctgcgaggcgctcctagatgcgccatttggggacccgggggtccgcctggcgtggccccgcagggtccggggcctggaggcctttgtctgtctgtccgcgggaaggggtccggggtggggtccgcgcgcggggcggccgc

SEQ ID NO: 399110 - DNA, 419 bp, Homo sapiens
agggctctatgtcatattgtatctctcctactgtggtagattgttgttcaaaactattctttatgtccacaggagaagtattcttccccaatccttgatttgatcttggctgtgtgacattttttggccaatggacattggtagatatgacacaaaaaggagctttaaatgtggttttgcatttggacaccccctttcttgattttgcattattacgaaaatggcttcccctgggtcactgttggttgttcatcctgggaatcagagtaaacacatgtggggtggacctgagtccaacccacaagaggcctagctgtacctgctgctagaagcagaaccactaagctaaacatatcctagatcagctgacacccagttgacttgcagacacccatgaaaaataaaaccttattattata

SEQ ID NO: 399111 - DNA, 642 bp, Homo sapiens
agaccctgccttgtatgcctagcaacatgtgaagatttctatttctaaatccagtcattccagttgtacttattactgtcattatgcagtctcattaaatattattaaaagcaattattatggatatgaagaacaaaagatctacttcctctacaaaaaccaaatcaaatgcattgaaaagagacaataaagtcaggtcaccttaaaaataaatactgtcatcttaagtttgaccaagacaaccataaaagattgaggaaggaaatcagatcatttaaaaatgggaagaatagtggtcttagattgctttgtaagtttctgtaagttcctccttcacctaagaaactgaagcttcacatggccaatgatgctgtgtaggtgtcacttgtctgtgagagccaatgaagaacattaatcagaagaaccaaactcaagaacaaggtcatttcctgcttcacaagggccatctttactttgaaagatacagaaagactgtgtatatccttgcttgtgatcttcccaatcagtagcatctgtttctaggtcagatggcatacaagttcctcctctgctaagagttactgcttttgtgcctccccaaaaagatataataaaaataagattgaatatggtcttttaatc

SEQ ID NO: 399112 - DNA, 478 bp, Homo sapiens
ctcctgaggtttcctttcccctcttctcacctgccccactcccagctccatcctgtgggtagaactcagtgtgctcacagctgaggtgtcttagcctcaattgtaatcttgtattatagtcatatattcataaatggtatgtgtttccatatatggaactaaccctaagtttttaaaagtaaccctaacttggctgggcacggtggctcatgcctgtaatcccagcactttgggaggccgaggcaggtggatcaccttaggttaggagttcgagaccggcctggccaacatagtgaaaccccatctctactgaaaatacaaaaaattagccaggcgtggtggcaggtgcctatagtcccagctactcgggaggctgaggcaggcgaatcgcttgaacccaggaggtggaggttgcaatgagccaagatcatgccattgcactccagcctgggcaacaagagtgaaactctgtgtcaaa

SEQ ID NO: 399113 - DNA, 510 bp, Homo sapiens
actctctccttcttactccctgaacaccagccaaaatgcccttctttcagttcttgctatgttcattctcacaggagggcctttgcatatgctgttctccttgcctcagattcacttgcctactctgtctacccagttaattcatctccattttgttttagagcacagctcaattgctacttcctcagataacacttctttttgagtctcccagactgggacatttccccctgacaaaaccctacttctaaaccaactcaactaccttcattcctgtatctcagctgccaagtgtggctgaaggaagtcaccaatgtgttccatcatcctcaagtgcacccttcaaaaaaaagtcccgccatctttttacaaacagccgtagcactatatgcctctacttcatagcactgaccataattctaatttaacacttatctctgtgacagctgcctggtgcctgcctcctccattttatatcagaagctccatgaagacagtctgctttctcct

SEQ ID NO: 399114 - DNA, 723 bp, Homo sapiens
ttgctgggaacagtacccgtgacagtccaggctgagacttgcggctgttgggatcatacccaaggttccagtggaatctcacacaaatcctgtctggttcattttctttctgtttgcacctcaggtcctcagttccctctgaggtccccaccatgcctttcctggcctgtctctccttcgctgacctccttttcaagtccctcccagagaatgctcataccttagtcttttctttccttcttccttcatctctctatttcttcatcaggtatgtatttcctgagggcctattatatgcctgttgtagttgctggggatacagcagtatccaagacaaacactgcctgccctccttgcagtccagaaagcaagcaatgaccactcaatgggatgagtgctactagacagtaagggacctgcggggggcagtttaggtgccctccctcaaccctgcagtttacagactttgtgaccatctcactctttctctaggacttgcccattctgcaagtctcaagacaccatttcttcccagtcctgactccctaccccacaccccatcatcattgtccgtagcacccactcccagccagtgctgcttccacagccttgccatctgaaactgccctttcacttttgccatctgctcagctccaagccgctcctgcctgtttctccaagtcttccatctaccactcccaggtttcgtcacttcattcccac

SEQ ID NO: 399115 - DNA, 181 bp, Homo sapiens
ctctcacgttcgtgccgtggggccagggtaactctcacgttcatgctagccgtggggccagcgtaagctccaccatcagcaggttcagggtttaacatggcaagtctgcagaggtgatccagtctctagaatctgtatgctgtctgactaacatggccaagtcggctgctcatcactgact

SEQ ID NO: 399116 - DNA, 298 bp, Homo sapiens
tgcccaggccagtcttgaactcctgagttcaagtgatccacccatctcggcctcccaaagttctgggattacaggtgtgtgccaccgcgcccagccaggaagctttttttatgggaacaattggcgtgttttcccgtctctgtggaattgtccctggaagttgacaggttttaccctgtgcagcatcagcaactgctgctgccctagtcaggggctctgggaagcagtaggagagtctgtgggctgatgttctaggtgccagcaggggacaggtagctgggggcagggggaatgatgc

SEQ ID NO: 399117 - DNA, 396 bp, Homo sapiens
agtcttccttttaaatattttatggacttcctagtacgttatccacagcagtgccccaaatccactctttgtgctcagctctatttccaactgtcagcaaaagtgcttgcatttcactttaaagggaagaatgcttaatctgtgtttataatcctaatccctttcttttccttggctttgcttatcagttgttccctgtctttctatctccttttactctgacttttagccaatcaaaatactgcctggatctcctgttttgtaagatcatatacaccctcctaatccctgttacatgtctcaggcagccagcctcctttgccttccctcactgcccactgccatgaaacaggagtcaccttttactgcctctacctgccacctacaaccacttta

SEQ ID NO: 399118 - DNA, 153 bp, Homo sapiens
ttctcttagctgcttgcctttggggacattttgctgcacattttaagaggactggaaagaaaaatacagttaaaacaaactagtctattttaggttctgttgatagtttagtgatgtactaggggaatgctggggtgtgtggtaggaaatgga

SEQ ID NO: 399119 - DNA, 630 bp, Homo sapiens
cttcttttggttctgacctctcattttggagaggtaggttctcaaagggagctgcatactggcatcgtctggaaacctttacgagaaaggaagccctgaggtttgattcaactagcctgggaagggtccagacattggttacttattgtactgttattatgagtttcttttggtttttgaaagaggttcttattctgttgcccaggctggagtgcaatggcatgagcatgatcacagctcactgcatccttgacctcccggtctcaagccattctcctgcctcagcctcctgagtagctgggatcataagtgcacaccaccacttctggctaatttttaaaattttctgtagagatggggtctccctatgttgcccaggatggtctcaaactccagtttccagcaatcctccagccccagcctcccaaagtgttaggattacaggcatgagccaccatgcctgggctgttattatgtcttcaatggtctccagaattttccagcgaggagctaaggcagaggacctttggtctagcaaagagggcagggtctatcactcaccagcaactcaacaaacacttctctgaggctcatttcctcatctgtaacaactcaaatgaggttgttgta

SEQ ID NO: 399120 - DNA, 326 bp, Homo sapiens
ggaggttgcagtgagctgagatcgtgccattgcactccggcctgggcaacaaaggtgaaactccatctcaaaaaaagaaaagtcaaagccaaagagatacattctaaaagcaactagagaaaaagagagaccttcaaagaaggtagaattagcctgacagctgacttatagactgaaacaatgagaggcaaaaataatatataataaaatttactgaaaaaatttgccaaactagaattctatacccaatgaaaatatcctttacaaatgaaagtgaaatcgacattttaaaatagataagaatggagagaatttgtcaccagaaa

SEQ ID NO: 399121 - DNA, 850 bp, Homo sapiens
ggaaactgatacaatgacacttgtttcttaagagaagctgattgaatccggtagcacattactgcacaattaatggctttaaacgagttacaagtcgtaagttcttatgttttggatcatgttgtggaatgtattccaaatgaaaaatggaggagaaagtgcacaacatcatatgcttcatggtatggcatatacatgtcaattatttttacatataactgtgatgaatgatacaattaaaagctatactacataatgcatacagttattattataaaaagttaaatattatgccacagtactaaaaataaaatatattcttctcaaatagtgaaaataagatatccttcatgttttttatgtcacatatgcttcctcgtttgaccatacctgtttttcttttttaatgaaataatttaatgatttattaaacaataatgacagagtatgggcaatttcctgaccattaatggcctacaaaaagtgataagacgattaccttgtcgtgaatttgctgaaataccctcctgttgcgttcaatgcatggtaaaaatattagaataaaagacaaataaatataaatacctcctcagttattgaacaatcaaaagtccagccgaatggatatacatggttgctgttccctgagtaggtacagcagctaaccttgtatcacaggtgtcccccctagcccactccccgcactccacctaattgtgaaacaccagctgtgactatttgctagatcaggaagacactgagggattttggggggtctgccgcatggcagcgatttcatcataaccaagtggcgctctcccacacccacgtgcagcagtccctggtcgcg

SEQ ID NO: 399122 - DNA, 494 bp, Homo sapiens
tgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgata

SEQ ID NO: 399123 - DNA, 220 bp, Homo sapiens
aataagaggaaaagtttgttgttgataattcctcaaccactttcctcagctttcatcatgggcatccaaacgaaaatgtatttactcaaagtttttggtgtgaagctgtaactagcaacattcctgataatttcatgcctccttactagaaagcagagaagggcttttaaatgcacataaaacagaaaattgcaaacaataaaatgtgcaacttactgca

SEQ ID NO: 399124 - DNA, 335 bp, Homo sapiens
cggagcttcactcttgttgcccaggctagagtacagtggtgccatctcggctcactgcaacctctgcttcctgggttcaagcaattctcctgcctcagcctttcgagtagctgggattaacaggtgcatgccaccatgccccgctaatttttgtatttttagtagagacagggtttcaccatgttggccaagctggtcttgagctcctgacctcaggtgatccttggcctcccatagagctgggattacagtgtgagccactgctcctgacctttttttgttcttttaaaaaataggtccaggtatattcaggttgaaagaactgattagagttt

SEQ ID NO: 399125 - DNA, 426 bp, Homo sapiens
agattataaaaatcataattaaaattaaagggatatattaacaaattctatttatagttgtagttccatatttaaattaatctattaagaatcattaatacttttcactgataaaaataagtaaatattaataaagatccatatttgatgacttcttttgggactagattataaattccttgaagacaactatgttttgttcatctttgtcttccccaaaagggccagatatgatataatggctttcatataattgataatttataaaaaagttgactttttattcttattttcattgaaagcaaccaacgtattagtcttcaaatctattgccatcttttaaatttacacttttggtttttgtatcttgggagcatgattaagatctatgtagttttcccttattcttcatacaattgttttaag

SEQ ID NO: 399126 - DNA, 375 bp, Homo sapiens
ctaattttgtagcttcagaacaggtgtgactcaggcagaggaagggctacacaggtgtcactgtgcccacccctagggagactgctacagacagacttcccggtgggacccggcccccacccatgcatggtggccacgggcatgaggagggtgataatgacaaggggagccacgatgaccacagggtttatagagatctcgccatttgctgagcaatgtggaggaacgttacacacaccatgtcgcctcccccgatgcctgcagggcaggtatcattgccctgcattctattgaggaggaaattgagttggaagtgcccaagatcacgtcgttaataaatggcagggcctaaacaagcccttagccgctacaaca

SEQ ID NO: 399127 - DNA, 128 bp, Homo sapiens
aatactccaagttcctgcaagcaacagaggctgaaagctgttactgctgtaactgacctgtgcaaatataactggccagggcccttatgttcactggtgactacaactaaggccaaggctgaatgaca

SEQ ID NO: 399128 - DNA, 407 bp, Homo sapiens
cccaaaccccacccctcttctggtctaatagcttcaatttatttctctctactggattatgtcttttttaaaaatcacatttcctttaagcctgcctccctttttaaaaatagacaatataactgtttattaaaataaaggaagagaaagaaaataacctgaaaaggaaactcataaaagaaattaaaatggttgataaacatatgtaacaaaaaaaatttgataacagaatgaaattaattcaagagaaagatacatttttaacctcttcagagaacaaagatttgaaatgtttattatatatgaggtgaaggtactgtcaaaattcactgttgggcatatatatcattacaatcttgagagtagtgtggcaaattttattaaattccttccatttctcttgtgtg

SEQ ID NO: 399129 - DNA, 303 bp, Homo sapiens
ccaacattaaatcagaaatcaagcaaatgcttacccaacaaatatttgagccctcatagctgggtttaagatgactcagtgtgcaaaattattaattccctttttatttctctacctgttgaccactgttgagacaccaaatttggagtgacaggcatcagaggattacaacagggttggaactgacttctttaagcaaaagcaaagggtcttctgtgaccacaatatcatcatccatatgccttttcacataggatgatgtgttttttgtcactccatggggcctggtctgccattttcccc

SEQ ID NO: 399130 - DNA, 904 bp, Homo sapiens
accaccatccagtcacctcccacaaggccccaccttcaatattgggaattacaattcgacatgagatttgggtggagattcaaatccaaaccatgtccttttgcttttttctgttttgtttgtggagtagatttttctccatccctttactttgagcctaagggtgccattgcatgtgagatgggtctcttgaagacagcataccattggatcttgcttttttatccaagtcaccactgtgccttttaattggggcatttagcctgcttacattcaaggactcagtgacctttgaggatgtggctgtgaacttcacccaggaggagtgggctttgctgggtccttcccagaagaatctctacagagatgtgatgtgggaaaccttcaggaacctgatgtctgtagaagtcatatggtagagagagtctgaaggtaaggaagatggtcaatgtgaagagatcttcagccttgttccaaatggtatagtgaagacgacttttactggagtcaaatcatgtgaaagcagtgtgtgtgaagaaggcaatatggatcattcatctcttaattgctgcatcagagctgacactggacacaaatcagatgagtgtcagcaacatagaagccacataagcagtgtgtgaaaaccttcagctattgccactcctttcaaacacatgaaaggcctcacactggaaagaaactccatgtaagaaatgtggaaaaaccttcatttctgttcaaaccttttgaagatacatggtaatgcacagtgaagatgaaccttataaatgtaagttttgtgggaaggcctttgataatctacatttatatcttacacatgaaagaactcacactggagagaaaccctatgaatgtaataaatgtgggaaagccttcagttgtt

SEQ ID NO: 399131 - DNA, 749 bp, Homo sapiens
aaaaactgttggaactttgtatgggaaaccaggtaaaatgtatttgagtttgtaaccctgttgttcttatgatacatcctgccatcctatgattctcagaaatactgtaaaatgctttcctaaaagcctgctctgggcctcccttacatcctgtgaggcgcggaggaaagactaaataaatgtaaatcatggtttgcatcctttcagaacacatggcctggttaaagaaaaagccatatttgaagcattgtaattaggtgctacaggaattgagaatcctaatatttattcatccttttatatacatatcactttgtagttgttttttgcttgtttcttgtgtaaattttatccggtctagtgtcccattcgataaatagtatattttgctggacaaattacttcagaaagttatctgacatctttgtagaatagtttaatttactgtgcggggtattgtgcttaacattatttctcaaatttatcagactgaagaaggtactgtccccattttacaaataaggaactaaattcagagattatttagattgctcagtttctttaaaattgtagagtcagtatacagatttccctgagtccatatctttgttctttcaactctaccatactgcttcccaatccagtgttttgtctttgaatctaattaagtcattactttgccttcagctaatcaaatatagaagtacctttctatcttccctcttttaggcatagcatatcccttcata

SEQ ID NO: 399132 - DNA, 141 bp, Homo sapiens
ccacacagtgttgcccaggcaactatcgcttctgatggaagacaccatctgagcggcacttccaaaggcattttctgcagactatttgtacttcaaaatgctatggaaggacaaaaaattttatagacaaataactcaggg

SEQ ID NO: 399133 - DNA, 163 bp, Homo sapiens
gaaaaatagactcatctcttgataagaggagttgcccagacacattgcagagagcatggaaatagggaaaatataaatttgggccaccatttctgtcaatcttccccattgtccaatgatttttttctttcttccctatagtatcttagctactctcattctt

SEQ ID NO: 399134 - DNA, 159 bp, Homo sapiens
gggaagaggagacccacctgaggctcagccctagcccctcagcccacccacgggagagtttactgactggggaccgcacttgcccatgcctccagctacaaaacaattcaattgcttttttttttggtccaaaataaaacctcagctagctttaacaca

SEQ ID NO: 399135 - DNA, 631 bp, Homo sapiens
ggttttccctcttgtacaattgattcttttagacccagtgttattgtttgaaccatgtttcccaaaaagatgttgaagtcctaaccctcaataccgatgaccgtgaccaaccatattttgaaatagaatctttacagctgatcaaattaggataaggttattaggatgggacctaatcctgacagtgtctttataatgaggggaaatttgtacatcatgacaagcatgcatagagggaagatactgtgaagacatagggagaacactatctgcaagctattgaacagactagactaccagaagctaaatgagaagaatggaatggattctccctcatagtcatcagaaggaaccaactctgctggtgctttgattttggacttctagcttccagacaatagatttctgttgtttaaaccattctgtgtagttttgttatggcagccccaggaatctaatatactcagctacaatttaaaaatactttttaggataattataaatttataggatgttgcgaggataatacagagaggtctcatgtatccttcattcagttcccgccagtggttatatcttacagaattgtaatacaatataaaaaccagtaatatagcattcatccaatata

SEQ ID NO: 399136 - DNA, 522 bp, Homo sapiens
gcaagtatttggtagaaccctacagaggtaggaagtggctgttactagctgtttccactggtattctctggccatctcagagctgtttagggaccattccagctacaggggagggcaagatttagagtagactctcaaatgagtctatctgattctttggaagcacgagctctagtaagatagtttgaacaaagatgtgaccatgaggggttttgttttattttttaactagattttgatatgttgtgtgccgcttctccactgcacagattgaccaagagttagctgcagattgtggctcagtaagaaggtcttgtggtacgtgctcctgcggcccccacctcaaactcttgcctctggtgttcttgaaagaaatgaggggacctttgcccgagccaagggaaaatgcaagattttggaggcttagcccctttattgtttttttcctctgttgcttatattgatttctgcggcaaagagcagttgactgggattgaaagctactctgctggtcttggatgt

SEQ ID NO: 399137 - DNA, 240 bp, Homo sapiens
ttttaattaccaacataatttttagagttgtcactttcaacaaaatcatccctgaaaaaacttcacaagtaaaaatagttaaatacaacaacaaagaattgcaggggatagaaagaatcgatattgttaaaatcgccatactgcccaaagcaattagcgggttcagtgctattgctctcaaaataccaatgacattcatcacagaattagaaaaaaactattttaaaattcatatagaat

SEQ ID NO: 399138 - DNA, 651 bp, Homo sapiens
tttcctcgtgtctcatggccaagatcccattataatgcccagtttcattacttttgttgggcctatccttttatatgggtgtgcagaggggagatttacctatgggctgaagtctgtgacttccaacattcaattactaacattattgttgtgttgatttagtcattaacaatttatttatttagatatgacatattaagtcataaatatttactgtaaattatttattaaaatttctgagagtttttgaattccttgtcaaagaagatgaagaactgaacaaaggaaagggcaattttagaaaaaaaatagcactaaagagggtagggggagaaataaagcaagattgggtcctccttctctgctgggctcaataaggacctgatcattgtcccacaagcctcaatgagggctactatcaaacatgaaaatagattgatgtgctttaatcctttctgattaacttgctctgagccaatgaactctttacttttcttactttttattatagagaagttacggttgaagtgagccaaagattccaagaactggtcgacagaagtcttgcctaaccttggtccacaaagagaagttaatatagtttgtctttggaactgttgtacatctttccaattaccatcatctccttgc

SEQ ID NO: 399139 - DNA, 547 bp, Homo sapiens
tagtgtcactgtgggttgggtaggtggctttgctgatttttcgctggacttccacatttgaggacagttggttgtcatcagctctagaaagggtgtggctgttttacattggctgttttcctcacattcctcaagcaggtactgtaataaagaactggagaaatacagtcagatgggaagtagcccctgctgtcaaggagcttgccatctaatgggggagacaggcaagtaaaccaaagactacacagtgcagtatggtaagtgccatgattttgatgtgaatctctatgtgtgtttgtgtctgtgtgttttatgggggtcattatctctgtgtgtgtctgtgtgtctctgtgaatctctctgaatctctatatatgtgtctgtctcttgtgtttctatgtgtgtgtgtacacaccttcatcttacagaggaggtcccagcacagatggtgcaagcagccagccagacctcctgcacactgtgacgaagctggagcaagacaccagggctcaccaggtgaacatgtgacctggaccggtctaactcc

SEQ ID NO: 399140 - DNA, 2873 bp, Homo sapiens
tgagtattatcttcacatagatttctaaagaagaattgaaaaatattcttgctgcatcagaaatatgttgacaaaccaccttttgggtctgaaccaacaacaagcaaagttaaattatggatatccaagggagtctatagaaggtccatgcaagacattttgactacttgtctgaactagatatcccttgaatgtgcacacaaaaagtgaatgggtcatttgataagggaaaactaggttccaagatggctgaataggaagagctccaatctgcagatcccagtgtgagcaacgtggaagacgggtgatttctgcatttccaactgagcatggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataaggagctcttagatgagacctgttcttgtatccttgtgtccatcttcattcactcatagtctccaaatgactttgtatttacatcactcccaacaaatgttgattcttaatatttagttgaccattacttttgttaataagacctacttcaaaaattttattcagtgtattttcagttgttgagtcttaatgagggatacaggaggaaaaatccctactagagtcctgtgggctgaaatatcagactgggaaaaaatgcaaagcacattggatcctacttttcttcagatattgaaccagatctctggcccatcaggctttctaaattcttcaaaagagccacaacttccccagcttctccagctcccctgtcctcttcaatcccttgagatatagcaactaacgacgctactggaagccccagagcagaaaagaagcacatcctaagattcagggaaagactaactgtgaaaaggaaggctgtcctataacaaagcagcatcaagtcccaagtaaggacagtgagagaaaagggggagaaggattggagcaaaagagaactggcaataagtaggggaaggaagaatttcattttgcattgggagagaggttctaacacactgaaggcaaccctatttctactgtttctctcttgccagggtattaggaaggacaggaaaagtaggaggaggatctggggcattgccctaggaaatgaaagaattgtgtatagaatggaagggggatcatcaaggacatgtatctcaaattttctttgagatgcaggttagttgaccttgctgcagttctccttcccattaattcattgggatggaagccaaaaataaaagaggtgcctctgaggattagggttgagcactcaagggaaagatggagtagagggcaaatagcaaaagttgttgcactcctgaaattctattaacatttccgcagaagatgagtagggagatgctgccttcccttttgagatagtgtagaaaaacactagatagtgtgagaggttcctttctgtccattgaaacaaggctaaggatactaccaactactatcaccatgaccattgtactgacaacaattgaatgcagtctccctgcagggcagattatgccaggcactttacatttgttgatcccatttgacattcacaccaaagctctgagttccattttacagctgaagaaattgaagcttagagaaattaagaagcttgtttaagtttacacagctagtaagagttttaaaaatctctgtgcagaagtgttggctgggtgctctccccaccactacccttgtaaacttccaggaagattggttgaaagtctgaataaaagctgtcctttcctaccaatttcctccccctcctcactctcacaagaaaaccaaaagtttctcttcagagttgttgactcatagtacagtaaagggtggaggtgatatggcattctgaaagtagggagggactaagtcagtcgtcatactaaac

SEQ ID NO: 399141 - DNA, 2807 bp, Homo sapiens
aagttctctaagtttgaagcgtcagcttcaaccaaacaaattaatggctattctacattcaaaaatcaggaaatttaaatttattatgaaatgtaatgcagcatgtagtaaagacttaaccagtgttttaaaactcaactttcaaagaaaagatagtattgctccctgtttcattaaaacctagagagatgtaatcagtaagcaagaaggaaaaagggaaattcacaaagtaactttttgtgtctgtttctttttaacccagcatggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataaggagctcttagatgagacctgttcttgtatccttgtgtccatcttcattcactcatagtctccaaatgactttgtatttacatcactcccaacaaatgttgattcttaatatttagttgaccattacttttgttaataagacctacttcaaaaattttattcagtgtattttcagttgttgagtcttaatgagggatacaggaggaaaaatccctactagagtcctgtgggctgaaatatcagactgggaaaaaatgcaaagcacattggatcctacttttcttcagatattgaaccagatctctggcccatcaggctttctaaattcttcaaaagagccacaacttccccagcttctccagctcccctgtcctcttcaatcccttgagatatagcaactaacgacgctactggaagccccagagcagaaaagaagcacatcctaagattcagggaaagactaactgtgaaaaggaaggctgtcctataacaaagcagcatcaagtcccaagtaaggacagtgagagaaaagggggagaaggattggagcaaaagagaactggcaataagtaggggaaggaagaatttcattttgcattgggagagaggttctaacacactgaaggcaaccctatttctactgtttctctcttgccagggtattaggaaggacaggaaaagtaggaggaggatctggggcattgccctaggaaatgaaagaattgtgtatagaatggaagggggatcatcaaggacatgtatctcaaattttctttgagatgcaggttagttgaccttgctgcagttctccttcccattaattcattgggatggaagccaaaaataaaagaggtgcctctgaggattagggttgagcactcaagggaaagatggagtagagggcaaatagcaaaagttgttgcactcctgaaattctattaacatttccgcagaagatgagtagggagatgctgccttcccttttgagatagtgtagaaaaacactagatagtgtgagaggttcctttctgtccattgaaacaaggctaaggatactaccaactactatcaccatgaccattgtactgacaacaattgaatgcagtctccctgcagggcagattatgccaggcactttacatttgttgatcccatttgacattcacaccaaagctctgagttccattttacagctgaagaaattgaagcttagagaaattaagaagcttgtttaagtttacacagctagtaagagttttaaaaatctctgtgcagaagtgttggctgggtgctctccccaccactacccttgtaaacttccaggaagattggttgaaagtctgaataaaagctgtcctttcctaccaatttcctccccctcctcactctcacaagaaaaccaaaagtttctcttcagagttgttgactcatagtacagtaaagggtggaggtgatatggcattctgaaagtagggagggactaagtcagtcgtcatactaaac

SEQ ID NO: 399142 - DNA, 485 bp, Homo sapiens
tcttgtatatctgatgcttcacaaatccaaaatggagctctttatctccacccttctgttctgttccgctgtcttgtttcccatctcaagaaacactcccaccatctcagtggcttaaaaagaaacctaagacctgtacttgattctttccttttcctcattcctgcattgaattcctaagtaagtctggttccttctttgtctaaaacagaggtaaacaaactttctatgaagggccagttagtcaatattttcagcattgtgggccacatggtttttgttgaaactgtcaagtctgccattgtgtcaagacaacagccataggcgacatgtaaatgaattgtcatgttgagatctggcctgaggctgcttggatttggccatagtttgcagacctctggcttaaaatatttcacatctgtccaattccctccatctctactgctaacctgcaagttcaagccatattgcttgaccagactact

SEQ ID NO: 399143 - DNA, 526 bp, Homo sapiens
gcatacgtcaaaattttattacagtcttgaccgggcgtggtggctcacacctgtaaccctggcactttgggaggccaagatgggaggattgcttgaggccaggagttcaagaccatcctggtcaacacagtgaaagcccatatcttaaaaaaaaaaaatcacagtcttgctgcaagtgtaaacccactgggaattcaaagatttatacttggtagggacattttctaaaaatttattttttattacagtctgcctatgtagattaaactgcacgctcttaagtatacaggttgatgaatttttacatttgtacacatctgtgtcttaacaacccaattcaagatattagaacatttgcaggcctacagaagcccccctggaccccttcccaggcaatacaccctctctccaccccgaaaaatgttggccactcttctgacctctatcttgatagagacattttctaggagaagaaaatgattagataatcactgttagacaaaatagaaaagaaaagaatgttccg

SEQ ID NO: 399144 - DNA, 454 bp, Homo sapiens
tcaggaaagcaaagacttacagtgacaaagaaaacccaagttatctgtttcttttattaccaccttggcctcatttcctcctaataattattatctctctgatccaagcacacagacgtctctgctactccttgaacacaataagcattcttcttccttagggcatttgctgtagtttttccctctgccttaaatgttttaccccaagaaaacagcttggctaactccctcacatccttcaagttagatataatttcttaatgaagtctatcctgattattctatatagctctttaatattgtgacattcatcccatctctcacagatttctgattctcttaatctgttctactctttcattatgccaaagcacattttatcttcaccttaatgaatataatttcatgccactgcacttcagcctgggcgacagagcaagactctgtctcaaaa

SEQ ID NO: 399145 - DNA, 443 bp, Homo sapiens
actatgaattttttaatcatattatgaacacaagataactgacccattaacagaatatgaaaaaaataagcaatgataactagattcagtcacctttagtactttgctaaattttagtcataaaaatcttatagtttaatgaatattttacaaattgttatgatgaatgcttatttgtcagcataggaaagaatacatttcagtcaacagtgagtctgattgataactttagctctttacgtgtatggaatatggtctccatttgcagtcctgcctcaggccccacaattggatggagtaattctgctattaataataatattttcttacaagattaatactttaaagtatctcttccctaaccagaatatagttagtatgagaacaaggaccatacctattttttaatactgtattctcagtgaccattatagtatttgaaa

SEQ ID NO: 399146 - DNA, 195 bp, Homo sapiens
gagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagag

SEQ ID NO: 399147 - DNA, 219 bp, Homo sapiens
taataaggccataccactcagacaccccagggtagaaaggggctttggtaggttgttctgccagctatttttaataatggaagaatagagcacagaatttaaaagggaaaccatatataataaatattatccaataagctctcagtacatcagctggtccttacctggcaatgctgaagctcaatcagagcagccctcagtggagatgaaagcatactt

SEQ ID NO: 399148 - DNA, 1447 bp, Homo sapiens
ctgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttcagcagttgtc

SEQ ID NO: 399149 - DNA, 112 bp, Homo sapiens
aaacacagaaaggcatagccgtgttcaaatgaactcagatggggagagataaccagttaaacactcttaaaagcactgaaggcaggcccattctcttttgcagctcgtacat

SEQ ID NO: 399150 - DNA, 382 bp, Homo sapiens
tggggaggttgggctgggtgttttggtctcattgcctcctcagaaggggggtgaagatgtgagcggcctcccccaagtccctggcctggaagccactcacagagctgagtttgagtcctggagctcagcagcaggttcaaaactcagttctcgcactgctaactgtgggagcaactaacaatctctctctgcctctgtttctccatctgcaaaatggatcagggtaggtcaactactgcagcaaacaaagcctggagctaaataccatccagctatgggccccacctcaatgagccacacagagtgctcagaacagcgcctagcacaaatctgtgcccactgcaggttcgcgaggatggaaggctgtgccatccacaagaga

SEQ ID NO: 399151 - DNA, 486 bp, Homo sapiens
ccagcctccctctctgtagcagatttttgttgagtctccatgaggcttgatgttcagggagagtcatctgggaatgaagcctacatggtgttctcaggtacctctcagtccccttggggagatggatgggataataagataagggctgggagagagaggctggcatagggtgtagagaggccatcgttcttctgcagagaagtgtgagcattgctgtaatcctcagtcaccagctctcagtgtgaagaaaagggaagctatcccacctccttcaaacagaggccccatctgaggttatcaatattgtcatttatttagtggcccagaaccttccattttaaagcacagtataaaactagaaggaggctagatttgcagtggctcacacttgtaatcccaacattttggaaggccaagatgggcagattgcttgagctcaggactttgagaccagcctgggcaacatggtgaaaccccgtctctata

SEQ ID NO: 399152 - DNA, 390 bp, Homo sapiens
cgtaggctaaataatggctcccaaagatgtgtctacatcctaatctccagaatctgtgaatgttactttatgtggcaagtacgtggcagatgtaattaagtcaaggatctttggatggttatcctgaattatctgggtgggccctaaatacaatcacaagtgtccttataggagagaggctgaaggagatttggtaccaacagaagaggaggaggaaattgtgatcatgcagaaactggagtgatggagtcacaagccaaggaatgccagcagccaccagaagccgaaagaggccctgccaacaccttgatttaggcctaatgaaactgagtttagatttctggaccccagaactgtgaaagaataaatttctgttgtgttaagccccta

SEQ ID NO: 399153 - DNA, 297 bp, Homo sapiens
cgtaggctaaataatggctcccaaagatgtgtctacatcctaatctccagaatctgtgaatgttactttatgtggcaagagagaggctgaaggagatttggtaccaacagaagaggaggaggaaattgtgatcatgcagaaactggagtgatggagtcacaagccaaggaatgccagcagccaccagaagccgaaagaggccctgccaacaccttgatttaggcctaatgaaactgagtttagatttctggaccccagaactgtgaaagaataaatttctgttgtgttaagccccta

SEQ ID NO: 399154 - DNA, 346 bp, Homo sapiens
tagaaaccgctaagttacagaaatcctttctccatcttcacagttgtcagaaaaaataaataaaaaggcttatacaagagcatgaaaatacagaacaaacatcgaacaggaagccaaagccctgaactttagtctatactttattagtcttataccactgggcaaagtaataagcataaaatgatgggtcaaaggtgggttaaattgcaaatattacccacaaaagaatgaacgtaattgtattgatttgactgttagattctgtattatttttaaattctgaatttaacattatacatatgaatctttcacttgatgactttaaaataaacctattttgctgctt

SEQ ID NO: 399155 - DNA, 606 bp, Homo sapiens
gccaaatcggcttgctttttatcctcaagcgagagtgagggtggcggctgtgcggacgccaatcgggatcaccgaataagtgcagtggaaagaaagcacacagccacttaaccaattggccgacatcaaggacttggccttccgagcgggttcttgtgaatatgctaactttgtaaagcgggcgcaccacgctgtgcttgctattcacgcacttccaggagtctcccgcgaggctccacgtcctttcggggccgggggctcccagggcttgcctttcagggcagggagtggcaccagacaagtcaatcccagtcggtttgttcctttatcccttgcgtcaatcagtgttgactgagggcctgcaatgtgcatggctgttgggtggggagctgggtaggacctaggacctaggacccagtgaatctcaaagagggagggtcacatgggtccccatatgcttcactcccagaatctggaatctgcccaaagcagtagagagactttaagtctaccccagcccccacgcctttttaaaaactccctgtgttcggagagcaagtgttttaatattcgttttacagacgtactttcaagcaaaaaaaaaaa

SEQ ID NO: 399156 - DNA, 507 bp, Homo sapiens
gaaaaatatgtagagaaaactgcgtaactcttgggaaaaaatttttttttaaatttgttccaaatttgagttacctttaagggaactcatgttctcctttgacaagtcttcctgatgactaatgtattttcctccctcatgaaatttattcattaagaaaccattttggaatttgcaggggtgaaatgggtgaatcgtctgtgaggctcaatactagctccactaaagtaaacatagttattaaagtgtcatgactgtgtgagaaatagctgagtgttctgtaatttgtaatggagggatagcatggggcactttcttaaagtcattaagcaatttctccaagttagagaaaacacatttgctgcatctgagattcaaagtaggaactttgtgttacaaaactcataaatacttgttgaattacaaataaataattgttgaattacagatggcacctatcatgtctaaaatcctcttccatgcttcccattggtttcaaaacaaaat

SEQ ID NO: 399157 - DNA, 315 bp, Homo sapiens
tagactcagctcggtacctggcgatgtcgcgtgcatgtgggccataggggatgggacatggtgtcggctccttctctggggaaagcacagctatgtggactccaggcagctccctcagctgggtttaagttcctatgaggactgcattggcctgagtgttgaggccttcaactgtccagggtgttaatgtgtgttcctgggatcctttagcttaactccttactgttgggataagtcgctctgtcgcccaggctggagtgcagtggcacaatctcactctgttacccaggctggagtgtggtggcgcaatcttgg

SEQ ID NO: 399158 - DNA, 903 bp, Homo sapiens
atcgccatgtcaggaagtggcattggcaccttcatcctggctcctgtggttcagctccttattgaacagttttcctggcggggagccttactcattcttgggggctttgtcttgaatctctgtgtatgtggtgccttgatgaggccaattactcttaaagaggaccacacaactccagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaaggtgtctgaagaattagcagcatttttagaaaatcagtaagaaaaatgtacatcttaaggtctactattttacatttctacacagaattttagtgttaatgttccatgtgtctatactgtttatttcaaaactgagaaattcatgggaatgatgtattttgtggaatcaagaacaaaattatagtgggataattttacatcttaaatatttctttctactactgtaagctctactttggaattatctgagtagaaaatcagaagacattatctaactttgtagatacactgtatgattgggctttttgttcagattgtaatttcattaatagatgaaatatttatgctaatattttcttatttcaaaagcaaaataaaatgaatttattgtcctgtgaatggaaaga

SEQ ID NO: 399159 - DNA, 1225 bp, Homo sapiens
agagagcttgcctataccttgattatttcataaaatcacatgttaatacattgctttcagaatgaaatactgacttgatctgataggagaaaatggtaatatttcatagttgttttccaaagacaaatttaaatgttgtctgttatctccttacttagtttaagaatttagttttgaaccccattgactttgtcatttgcaattttaaaaatatttgggactgggcatggtcgctcacgcctgtaatcccagcactttgggaggctgaggcgggtggatcatgaggtcaggagatcaagaccatcctggctaacatcgtgaaactccgtctctactaaaaatgcaaaaaattagccaggcgtggtggcgggcgcctgtagtcccagctactcatgaggctgaggccggacaatcgcttgaacccaggaggtggaggttgcagtgagccaaaatcatgccactgcactccaccctgggcgacagagcaagactccatctcaaaaaaaaaaattggaaggtatctgtaaaatgtcaaagttaagatgaagttatatctgtttggaatagcactttgccctaaatatcatttcttgaattttcaagcctaaagatgtttaaaaatatgaatagttacaaatattcttatacatattttttatcatgatcacaacaaaattttgtttatgtggttctgcaatataatttctgtgaagtattacaagtatttatgaaaaataagcatagtgatcagaaattttaaagattttgtataaaaacatttgggagatttgactttatacatgcatagatttgcattttactttcccttttgaggcagcatttttagaaaatcagtaagaaaaatgtacatcttaaggtctactattttacatttctacacagaattttagtgttaatgttccatgtgtctatactgtttatttcaaaactgagaaattcatgggaatgatgtattttgtggaatcaagaacaaaattatagtgggataattttacatcttaaatatttctttctactactgtaagctctactttggaattatctgagtagaaaatcagaagacattatctaactttgtagatacactgtatgattgggctttttgttcagattgtaatttcattaatagatgaaatatttatgctaatattttcttatttcaaaagcaaaataaaatgaatttattgtcctgtgaatggaaaga

SEQ ID NO: 399160 - DNA, 788 bp, Homo sapiens
atcgccatgtcaggaagtggcattggcaccttcatcctggctcctgtggttcagctccttattgaacagttttcctggcggggagccttactcattcttgggggctttgtcttgaatctctgtgtatgtggtgccttgatgaggccaattactcttaaagaggaccacacaactccagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaaggtgtctgaagaattagtgtctgaagaattaccagtatgtttgctacctctttgccgtgggaatggatgggctctgctatctctgcctcccaatgcttcaaagtctccctctgctcgtgcctttctcttgtacctttggctactttgatggtgcctatgtgactttgatcccagtagtgaccacagagatagtggggaccacctctttgtcatcagcgcttggtgtggtatacttccttcacgcagtgccatacttggtgagcccacccatcgcaggtaagtttccagagag

SEQ ID NO: 399161 - DNA, 391 bp, Homo sapiens
caggaggggttagggaagttagacgagtgacctttggtaagattcatagtttctctgaagctgtttttctcatctgtgaagtgggacgatgtcttcacagggtcaccatatagcatttaggaagatgccctgcagccagtatattttagtttacttttttctcttgcctcccagccaagatgtgtctgtcctatataacttttcccgcaggattcttctcttttagttgataatgaggtgataatttcgtcggttttgctatctcgttaatatgtttcctttattcagcaaatattgagctgggggctaggcataccacagagaacaagacagatttctgctttcagggagcttacctttctctctgttttcattttaactccctaaacct

SEQ ID NO: 399162 - DNA, 388 bp, Homo sapiens
catggtcataagatgtttatagttgaggaaacaacctaaagattacctgcaaggacagacttctacaaaaacagaaaagcccagatgtcccaatacccataacaagatttgctttcaagataattatgcttttttttaaagatagttatgctttgatgtactcacacagtagaatgtcaaggataggtttctttaaatcaataccataataaatttggtcatgctgtctgcccatccgcatgtaggcacagcttagtttagtctttgtatagacaaagatccctatagaagaaaaacttaaagactatgtgttcctccacttgctttccaaggacactctattctataatggagtagctttcaataaactatctcttctcactgcact

SEQ ID NO: 399163 - DNA, 481 bp, Homo sapiens
tgttttgttgacttcagtatccccagcccttagaacaatgcctggtacataatagagactcatgaatttgttgaatgaagaaattcgttttaaaaatttattttctttgcttccttcattgtctggccttcctactttggttaatgcttatgttttcctgagccttactaacacgaggccgctcttaaaaaagagagagcgctgggtgctgtggtcacgcctgtaatcccagtactttgggaggccgaggtgggcagatcacctgaggtcaggagttcgagaccagcctgaccaccatggtgaaaccccatctctagtaaaaatgcaaaattagccaggtgtggtggcgcatgcctgtaatcccagctactcgggaggctgaggcaggagaatcacttgaacccgggaggtggaggttgcagttagctgagatcgcagcattgcattccagcctggacaacaaaagcgaaactccatctca

SEQ ID NO: 399164 - DNA, 743 bp, Homo sapiens
agtctatattgccctgactggtctcaaacttctaggctcaagtgatcctctcatcttggcctcccagagtgctggaattacaggcgtgagccaccataactggccgtgaaggcatttaggttacaattttatatttccatggcctttttacacacacacatacgtgcgcgtgcacacaaacaaaaaaacacctcacagtttgtctttgccattggtagtgagatcaccagattccgagggagggcaaaaacacactcctaaagaggctccacaggttctttcccagagtagacatgctggatgcaattcatgcagccactcagtgaggaggagcaaacatttatgtagggcctactctgagccagacacagggctcgggactacaggtaccaagataagtggttgctgctcttgagtttgcagcccagagcagaaacacaaggcattgaagtgactcagatacaggtttaaaagggctgcctgctctgaaatcatggatctttgaccaaatctgaagtccgcgcttcctgcacgaaagcagctgcatttaatacattcctacgtgccaagtgccatgcaaagctgtgggatatacacaggtcctgctccctaaggctcagtgccaagtggggaaataaaacaagggcattattttggatataattaaggaaatgagagaaggtcatggggcgtacaactaaccaccaggaacccaagaaaatgtagttctggcctccacctgc

SEQ ID NO: 399165 - DNA, 466 bp, Homo sapiens
atgtaaacatggaaaataatgttcttggaaaatggctcatgaaatgggaaatgcagatatacattattgattcatcacttcaaagttgaaggctattccttgcagcaaaaatcttctggacaaaaatagagggaaaaatcaaccaatagtttgagagaatgcagacacaatctactaaggactgaacagtgtccccccggttcatatgttgaagccctcatccacaacgtaatggtatttgggaggtgattcagtatagatgaggtcatgaggatgggactctcatgctgggattagtgtccataaaagaagagacaccaggaagctctatgcccttctctctgccacatgaagacctggcaagaaggcagccctccacaagccgggaagagcaccatcaccagacccaaccatgcacagcctccaaaactctaagaaataaacatctgttgttgaagccaaacag

SEQ ID NO: 399166 - DNA, 135 bp, Homo sapiens
gaactgaggcatagagaaataaccttacatatttaaataaatgggcctagtagtgaagaatgcagtcattggagctgggctggccagattagagctctggtttcccactcgtaagctgtgtaccttgggaaattt

SEQ ID NO: 399167 - DNA, 123 bp, Homo sapiens
cccacagcatccgaacaaggatgaaaccaattaatatcattcattgtaatcatggcatgccatgtcctacccacagctgataaaatccgacagaaagcattagactcccacaggatgggtaat

SEQ ID NO: 399168 - DNA, 446 bp, Homo sapiens
tatgttaagtgaaggaaaacagacccaaaacagtacataccttacaattccacttatataccattcctgaaaatgtaaaaatatagggacagaaatcatctcctggggctgggagcaatgccaggagaaggggactgactctaaacaggaatgagagaacttttgggaatgaaagaaatgttctacatcttggtggcagtagtggttacatgatacatacatctgtcaaaagatatcaaactgtacatttaaaagcgtgacatttactgtttgtaaattatatctcaaaaaacctaatctttgaaaagtatgcagatattgccaaattcccttccactaactttcttataccatttaatttacattcccaaagggcattctaaaagtgctggtacctttatcagcctcaatattatcagactattattttagacctctccaatttg

SEQ ID NO: 399169 - DNA, 840 bp, Homo sapiens
tgtgatacagcacataaacagaattaaaaacaaaagtcacatgattggagtgttggcaagatggctgaataggaacggctctggtctgcagctcccagcaagaccaatgcagaaggtggatgatttctgcatttccagctgaggtacctggctcatcacactgagactggttagacagtgggtgcagcctatggagagcaagtagaagcagggtagggcgttgcctcacccaggaagtacaagggggtggggaactccctcccctagtcaagggaagccatgagggactgtgctgtgagggactgtgttatctggcccagatactatgcttttcctacagttttcacaacccacagaccagaagattcccttgggtgcctacaccatgagggccctgggtttcaagcacaaaactgggcggccatttgggcagacaccgaggtagctgcaggagttatttttcttacctcagtggcgcctggaaccacagcaagacaaaaccgctcacttccctggaaagggggctgaagccagggatctaagttgtctaactcagtggatcctacttccatggagcccagcaagctaagatccactgggttgaaattcttgctgccagcacagcagtctgaagtcaacctgggatgctccagcttggtggggggaggggcatttgccattactgaggcttgagtaggcgttttcccctcacaatgtaaagaaagccatgtgggaagttcgaactgggcagaacccactgtggtgcggcaaagccactgtagccagtctgcctttctagattcgtcctctctgggcaggcatcataaaggtacataaatc

SEQ ID NO: 399170 - DNA, 106 bp, Homo sapiens
attttgcaaagaattttttctgccttaacagaagacacaggattcaattgtatatatgtaattctatgtatcttacaggctcagcaaagctctactcattgtctac

SEQ ID NO: 399171 - DNA, 165 bp, Homo sapiens
acccacaagcatggctaatttctgaatacctctcatactgccttgctttaaaatgaacttggaataaaatttcaaatgcccggtgacaataatgagacacgcagaggcagcttcaaagtttggaaacccaccaggacagcacaagggttcagaaagatgatcaat

SEQ ID NO: 399172 - DNA, 573 bp, Homo sapiens
tgcaattttaccatgtacttatggccaagcactacatagtcaacagacctcattaagttgtcaaaaagcattctcaggctgaggacgttaggcaacctggctttagttggcagaggtgcgtggacactgccaaggctcctatttctggttccagtggatgaggtggaggaggattatttgtaataatagcaaacagccaggtgcggtggctcacacctgataatctcaacgctttgggaggtggaggtgggaggatcacgagcccaggagtttgaggccagcctagacaacatggtgagactccatctctatgaaaaaattaaaaatcagctgggtgtggttgcgcgtgcctgtagtcccagctactcaggagactgaggcggaaggaacccttgagcccaggagttcaaggttacagtgagctatgatcgcaccactgtaccccagcctgggcaacagagtgagaccctatttctaaaaagagataataatagcaaacacacattgagttctaaccaggtgccaggcagtatactgagggcttaaatgcagcatcatgtctgtttctcacag

SEQ ID NO: 399173 - DNA, 623 bp, Homo sapiens
tgcatttcccttagcctactggctgacaggaaattgttggaattggagtatttcctagtttaggcagaatcctgattatagaatttcttgtctcttacaaggcgtgttacctcttttttttcttcttttttctttattctttctttttcttcctgttcactcctgagatcttactccattttaagacagttctaagtaagacttagctgcaataatctacaacatatggcttgtgaggaagatggaggaatgatttccattatttgtctgttaaagtcctttggaagagtttactgaagggccacgtaagaaataagttaatataatgaaccttgaatgtagtggtagaaggtaccctgaagagtagccggttttggtgggtggtctgggtgatcttcccaggtcagctgctgtaccttgtgagtgtcaaggatgagaagtgagtcaacaggaggaatggctctctaggccagcgctgtccaacagatatataaatatgagccacacatgtgagctctatttgttattttaaattatcatataactacgttaaaaaactaaaaagaaacattaattgtaatttttaaatttgacttatatccaaattattatatcatttcaac

SEQ ID NO: 399174 - DNA, 167 bp, Homo sapiens
caagagcaaaactccatctcaaaaaacaaacaaaaaaaatgttgcattcatcattgcatctgaacattttaagaataatctttcataaaaagttggcagttgcacatgaagttcaacatacacttagcatatgacccagtgattccactcctttatgcttatcttag

SEQ ID NO: 399175 - DNA, 300 bp, Homo sapiens
aggtgggggcaaagggaaattacccttgaagattgcacacagagaaaggtgttcaagagtcatttagaaccacaattaaaacaaattgttgaatggaaaagggaccattttcctaagttttccctgatgagtgaaagtgttatgtgacttattattaatacatttctcaaaaatggcttatttccaaatcagatgcagttctcttcatcatggatgagagttaggttgtcttttatgatatagcattttctatacatacacagtcaaaaaatgtgggccattttcttctttacctctcta

SEQ ID NO: 399176 - DNA, 451 bp, Homo sapiens
cctggggttatttttagcagggatgcagggaaggcacagttctccttgactttaactagggacaacccccacccctcagccaagactcactggaggaggccgggtacggaaacccccctcccagaaaggggaaatggtgtgttttctgttccttcaattcactagaatgggagttgcagtcaagcttggggttgaactgatgggaaattctaggttccaaagcctgtgggctctgccccatccctggtctctgtgtttccatgaatccgggaagcaagaggcacatggtgtctggagtcgaggtgccctgtctgtgggtgttggtgtccctgggaaactgcttggttatagccaggctctgtggactacacaggggcaccaggcattgtgggtggtgtttcacaggcgctggctaaataattcattaaactgagcatgtccgttccgtgta

SEQ ID NO: 399177 - DNA, 432 bp, Homo sapiens
acagtctgaggtgcgcggactctcaacatcaggttccctcggagaggctaagaccccaccgcccgaaccccacagtcttggcgggagaaagacgccccccaggagcacctggagggagggaagaaagccccccgcccctggacacggtgaagggcagaaaccacggacctccaaatcttggagctggaggctcagactcccctctctggaacacgagggcgctgggagcgcgacccctgagaactgcccgaatccagttccgcctggaacagggctcgggtccccaggggcccggcgtgagctccgtcgccgccgggcggctgcgcctcggagatcggggaagctgactgggggtcaccccgactcctctgcgccccccacccggccatattgtgctcgtggggagggggcgcgctgtagtccagcggccgc

SEQ ID NO: 399178 - DNA, 472 bp, Homo sapiens
acgcgtccttccgtgcctccatcgttcgcgcctcgctccaggagcaagaggggcagccccggccacagtccccgcggtcgcaagtgcgcccggaggccgacccgggcccctcaccactaaccaaaatgagcgcagaaaacgagtaccgcccgccgtcgccaccgaagctggctgcggagcgcgacaagccctcgccgcggctccggccccgaggggtccccgtgcgcccggcatagcccaggacagttcccagcgcgcgccgcggactcgggggacagcgcgctcgggggccggcagcctccagcgtccgcccggcccccaccgcccagtgccccggcccgagggacccgcgcgccccaacaaagttggcgcaggctctccggggaccgccccccacacggccgggtgcccgccggcgcgcaggcgtgggacgcggggaagggcacggggccgccgtcggggctcgcggccg

SEQ ID NO: 399179 - DNA, 394 bp, Homo sapiens
ctttcctctgtatggctcagaccaacgtttgtcttctggtcataggaaattatttccataaataaaatggaaccataaatgtattaagaagatggcttcactttttcctcctgccacatttatccctccatcctttctggcttatgctaacgtctccttcctgggagtgaggaatgatacagcaaaccctgtccattttctccttcctgggagtgaggaatgatatggcaaaccctgtcagttttgtttgtgatcacattgttacacatttatggttttggagcaccctaagcaacctcatctgcttctcacagataggagattcacttcctcagggaagcattcccaccttctctgactatgggagaataatattttccttttgattcaaggt

SEQ ID NO: 399180 - DNA, 394 bp, Homo sapiens
aatggaaaaccagttaacatggtttattcacccaggcctgagatccataatgaaggccatttttaaagttgagtcaccacaggcttgaagactggttaggattggggaactgagggttagagagtaaagtagaagggatggcacttttcttgataggagataattattgcagatattagtgttaagacctattctttttagtatttttttaaacacaaagtaacacctccatgttaccagcaatatttcacatttcaccagtgttcactaagcacctattgtgtgccagttcctatctgctggaagtgcacgattccgtgggctgtagcgagcacagtagcagtccattgggcccaattactgctgacctgagcaatctgttaaaacccggaaa

SEQ ID NO: 399181 - DNA, 364 bp, Homo sapiens
gagtgacaccatcagctctcccggttcttagaccttcagactcagactgagttacaccactggcttcatgggttctccagcttgcagatagcatatggtgggacatctcagcctctatcattatgtgagccaattcccataatgaccccccttttatctatctatctatctatctatctatctatctatctatctatctatctatctcatattggttctgtttctcaggagaaccctgactaatacacagacatatccaggagtaatgtttcacctgttgtctgggtatcccttaattcagtcaagttgatatctaaaattaaccatcacactaaataaaccaggtagtctcatttaacatttt

SEQ ID NO: 399182 - DNA, 471 bp, Homo sapiens
gctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggc

SEQ ID NO: 399183 - DNA, 310 bp, Homo sapiens
acgagggtgctacttcttaatggagacagagaggagtatgttgagaatccaaaagatttattgggttgtcttttaatagttccacattttgtgataaaagttaatgggagactagctatagcaacccaaaaacacaagaccgcacatcgcttcaggaataaagggctcttcaggaataaaagttgaggtcactagtatagagtcttgaatgtcaagagttggagaagctgagactttactgcaagttaacaagttagcctgtcacagtttaatgaatgttgccaaatggcatgagattcttgggataggc

SEQ ID NO: 399184 - DNA, 539 bp, Homo sapiens
tgaataaagaaattgaagcacagagctggtaagtaacttgcccaagctacacggctgataggtggttaaactacaatttaaaagaaagccacatgtctccagaacctgtgctatcagcctttaagctgatagcaacctgtcacagacacacagtcattgtccccagactttcacaccgtgctctaatttgttaaattgagttgggtttgaaatcatgcacacatttcctctgacctttttcaatggtctatttcttcttactgagttccctgtttccctatctgctacaacccattgtcttctttttggagaaagtcttcttttaagtctgtgtctttttctgtcctttggtctccatttgagcgacccatgcccatcaagtgtaaaacctgcttgactgaagagagaagaacccacagctatgggattgtgcaggagtttgagttataagatcgttgaatatagtcagacgtttttgctgctgttgttgttgtcttaaataaatgtctaaggtaggagaaagttgttagatgtctttg

SEQ ID NO: 399185 - DNA, 265 bp, Homo sapiens
gtacaatttctattattcaaatgacaaaacccaatatcttcctccacattctccgtctttgtgctgaataagcaaatcttttctccaggtcaaaagtggtaaaataggtgaaatccacagagataatgaaatacaactatgggtaatataaaaaatgatgcagcattattggcagtcgtctctcagcctgcttttaggtttgtttttacctttgatcttatcaaaaaatatacaaaatatagctacttacatccatactctttaa

SEQ ID NO: 399186 - DNA, 160 bp, Homo sapiens
aaaattgttaattacctgtactacttgtgaaatggtagtttttgaaaatgaacttagatcagttgtaagtatatattacaaactgtagtgcaaccactaacattttttaaaaacaaatgtagttgatatgaaaatataggggagaaaaagaaatcagata

SEQ ID NO: 399187 - DNA, 459 bp, Homo sapiens
gaatcacttgaaccagggaggtggaggttgcagtgagtcgtgatcccaccactgcactctagcctgggtgacagagccagactctgtctcacaaaaaaaaagaaaaaaagaaatattaatctaatggatgcaaatattgttgaccctgacagcaaaactatggacacgctgattgcaaaagggttggcctgggctttctaggttgttttgtcacttccttcttgcttttattttgttctacatttccatttcttccttttcttactcttcctttcaccaaagaacttattcctccttctttctctcctctcaccccttagccatatgaggagtttcaagaaatgacagagtgaggaagatttctccccgggaatccacaaacccccatcacttctgcctccagcattagccacagactgtggctgggtttggggagacactggacgcctaatattctgt

SEQ ID NO: 399188 - DNA, 225 bp, Homo sapiens
tgggattacaggcgtgagcctccgcgcctggcaaacttccgttttttcattttcgaagtgggattgttgtgatctttgatgacaatgttcttgcagagggatgcctgactcccaaaaataagatataaagcactgacaagtaagttcctaattagagttggctgttatgacagccctaattatcttttttagtcctccttcctaaacatacacacacacactacc

SEQ ID NO: 399189 - DNA, 533 bp, Homo sapiens
actttgtgtggatgcagcatgactgtgagaatcacacgcctgcggggggcatgtgtgtgcacacacatgtgcacttttgtgtgtgtgtgcatgtacacagttgtgcccctgcacttcgcgtgactgggaatgtgcacctgtgtgcacaattgtgcatgcccgtgtatgcatgtgccttgcacttttaaatggagcagcagcaggtgaagtggggctctcctggactggcccccagtgtctggcgcctgcactctggagcagggcagttcactccttctaggttttcctacagaggacttcccctgctctgctttcatttacaggaaaacaggagtgccctgaaaaacaagttttgctgaaattcaaaactatcttccaaagtccttgcatctgaatcctgaagactccccagtgggtgagcccagaaacaagaccaccttctacgcgggagggtctctcgttacctaggcgccgtgtgccctggggtgagccacacccacggaacccaggtcactgaagcccaatccctgcag

SEQ ID NO: 399190 - DNA, 461 bp, Homo sapiens
agacaaaaccctgacatgtgaacatttactattatttaagctggaaacaaactttaccaaatgaatactgactataatttgctttaagttactttctagcttcctagtggaaatacacagaacagagcttcttaaaaaatgcccttttgggccaggcacagtggctcatgcctgtaatcccagcactttagcaagctgaggtgggaggattgcttgagctcaggagtttgagagcagccttggcaacactgtgagacctcacctctactaaaaatacatttttaaaaaattagcctggtgtgatggcacacacctgtagtcccagctagtcaagaggttaaggtgggaggattgcttgagcccagaggctgcagtgagcctggagatggaggatgcagtgggccgagatcacaccacagcactccagcctgggcaacagggcaagatcatgtctcaaaaaa

SEQ ID NO: 399191 - DNA, 161 bp, Homo sapiens
ccattcaaacaaattgttctaatttatagtttctgggaacttttggaaaaatggatgagagccccaggttacctgagatgctgttacatattttaatggtgctaacaatgtatattttgtcaaaatgaaacaggattttgaaagacttcataacagttgta

SEQ ID NO: 399192 - DNA, 627 bp, Homo sapiens
cacaaaatttaaaaatttttatgatatccatttctctatttttctttgattgtctgcacctttggtgttgtatccaagaaatcattgccagacccagtgttgtgaagctttgccctgttttcttctaagagttttttttagttttagcttttacattttggtcatggatctcttttgagttcatttgtgtgtaatttgttaggtaggtgagggtccaacttcactgttttgcacacggatattcagttttcccagcaccatttgttgaaaagtatgtattttccctgttgaactatctcagcacccttgttgaaaatcgtttgatcataaatgggatttttttttccttagggctctctattctgttctattagtctatatattttaataccagctgtggttttactttttaggttaaatcttaaatccatttgtaatttgttaaaaggaatgaggtatagggatcagcttttttcttcagatcatgtagctaatccacattattatcattctccattgatttgagatgcccacttttataaacttttttatatatggatttttaaaaatgtattcctttgatctttagcactctgttcctaggctaatcccatactattttatttt

SEQ ID NO: 399193 - DNA, 425 bp, Homo sapiens
ggatcctgagctcagtgatctcaaacaaacaaaaaactaagtagcacattgaaagaattgtgttaagagttagcactactcagtattaaagtccaagcagctaaacagatagaagctatgaaacttagcagaggttaaataactattgcaaaaccatagtgatgactattctaagttttctcaaaacttctctttggtatgttgttgttagattttgctttacattttaaccttcaacatttgttcaatgtatttattatatacatctctttctatatttatagatctagttatataccaaagaatggtatgaccagacatggtggctcatgtctgtaatcccaggcctgtgggaggatcacttgaggccaggaatttgagaccagcctgggcaacataggaagaccccatctctacaaaaaata

SEQ ID NO: 399194 - DNA, 586 bp, Homo sapiens
ccctgtctctactaaaagtacaataattagcagggcatggtggcaagctactcaggaggctgaggcaggagaatcgcttgaacccgggaggcagaggttgcagtgagctgagatcacgccattgcactctagcctgggtaacaagagcgagactccatctcaaaaaaaaccaaccaaccaaacaaacaaacaaaaaactaagtagcacattgaaagaattgtgttaagagttagcactactcagtattaaagtccaagcagctaaacagatagaagctatgaaacttagcagaggttaaataactattgcaaaaccatagtgatgactattctaagttttctcaaaacttctctttggtatgttgttgttagattttgctttacattttaaccttcaacatttgttcaatgtatttattatatacatctctttctatatttatagatctagttatataccaaagaatggtatgaccagacatggtggctcatgtctgtaatcccaggcctgtgggaggatcacttgaggccaggaatttgagaccagcctgggcaacataggaagaccccatctctacaaaaaata

SEQ ID NO: 399195 - DNA, 375 bp, Homo sapiens
aggtcaaggtaggaggataccttgagaccaggttcaacaccagcctgggcagcatagtgagacccacatctctatttaaaaaaaacaaatcaaacaaacaaaaagaatggtctgaaactggggctatccaagctgaacattgaaagcactatagctacagcaaagaagtagactattatttaaggcaatattatgagttcagtctctgcttggctcagagaggaactgtaaactcctctttgccattggtggcctttaggccacacatcactggtgttggcaagattgctttcaaacagattcaaaacggattgcatatgattctagagggtctagggtcatttaataaaggtgctgctatgcacatgcttgaag

SEQ ID NO: 399196 - DNA, 411 bp, Homo sapiens
ttccatgccactagaaagccgagcctgcagacagccttgaagaaacaggctggggagaagacaaagcattcaaagctgcaattcctgcccaaccttcaggtagaacattcagtggacagtttggattgtggaactgaggcctggagcaaaggtcaaggctgagggggcagacatggtggtacatttggctaagttggtggacaaactttgaagggagtaaaactccccaagagaaactaaaaaggaacaagaataagcagacctcttttatttatagtactgtctgtaattttcagaatattttttcttttctcctttgatcttagagccatctaatagctttgactagataccctggtatttttgttttctatctagaaaaataaaaaattgataaatcatcataccctt

SEQ ID NO: 399197 - DNA, 398 bp, Homo sapiens
acccagcctcagtccctgaaatgtaacatttccttccagtagtggttcccaaaggtgttgtatgagaagattctatgtgtacactgatgcaagttgtcaattttaatgactgtattagtctgttctcacactgctaagaaagacatacccaacactgggtaatttatcaggaaaaagaggtttaatgaactcacagttccacatgattggggaagcctcacaatcacggtggaaggtggagtaggagcaaaggcacatcttacatggcggcaggcaagaaagcttgtgctggggaacccctctttataaaaccatcagatctcatgagacttattcactatcacaagaacagcatgggaaaaacctgccacccatgattcagttacctcccactgggt

SEQ ID NO: 399198 - DNA, 762 bp, Homo sapiens
  misc_feature (28)..(28): n is a, c, g, or t
  misc_feature (33)..(33): n is a, c, g, or t
  misc_feature (36)..(36): n is a, c, g, or t
  misc_feature (41)..(41): n is a, c, g, or t
  misc_feature (44)..(44): n is a, c, g, or t
  misc_feature (46)..(46): n is a, c, g, or t
  misc_feature (52)..(52): n is a, c, g, or t
  misc_feature (54)..(54): n is a, c, g, or t
  misc_feature (61)..(61): n is a, c, g, or t
  misc_feature (68)..(68): n is a, c, g, or t
  misc_feature (82)..(83): n is a, c, g, or t
  misc_feature (105)..(106): n is a, c, g, or t
  misc_feature (109)..(110): n is a, c, g, or t
  misc_feature (112)..(112): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (139)..(140): n is a, c, g, or t
  misc_feature (167)..(168): n is a, c, g, or t
  misc_feature (171)..(171): n is a, c, g, or t
  misc_feature (204)..(204): n is a, c, g, or t
  misc_feature (207)..(207): n is a, c, g, or t
cagcaagggaatgaggagtgtttcgacntcagnaanatgangantnaagacngnacgcgtngcttcanctgactgcagccannattgcagatgggctcgttttgnnacnntnccccnantntcgacttatctaataggnnggtagataaggacagcatccgcagtgnnggnccagttgtggtgctggtgcagctggacgagagnagnaagtcacaggccctgtcattgcgcctctcttcccgcagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaacc

SEQ ID NO: 399199 - DNA, 419 bp, Homo sapiens
ttcctttatgctccatacttactgcatagagaccttcttgtttttcctttatccatttttaaatgtgactctttcttaaattctgaaaattgacacagattagttgccttacttctctggtatacacttgaattccctagttagaagttagttggagcctggatgttggtgtttatgttgtttctatcattcaggtgctatgatgagaggggattaagaggggctatgagcagcgacagtcaggatgcttaactctgtgcctcccttggtaatatgttcacgaggaggggttgggttgacagctttctgattgatatagcggcccattctcctttctttgccatatttggtgctcaactacagcagtaatccccagctaaaacaatggccagaggcaacagagcaagacactctcaaaa

SEQ ID NO: 399200 - DNA, 191 bp, Homo sapiens
tagcaagcttttagctgactttcacatcagctctaaaccctagctttcccctaactgccccaagcctagtttgtagtaggctgagtggcaacctagcccaaagtgggattatgatactccaacttagttgtggttgagttttatgtaaacatttttgtcgctatttcatctggcttttctagataaaatgt

SEQ ID NO: 399201 - DNA, 519 bp, Homo sapiens
aactttttccaaatagggtaaactcgtgattttgcgagaaaaggagaaggggaaagaagaagggatagggttgatttacagcttttacaacttatgaccaggaagttgtctttgaagaggaacttcgttgtcccaacaactccttacctcaagtgatccacccaccttggcctcccaaaatgctgggattacaggcgtaagccacctaggctcgccccataaatttttaataggagaaaagagaaactgtcaaccccatggtccaaagctcttcccattcatggacccgcaccccgagtcaggattctcccctgaccaccctcccgtggtccctgcacaatctgggagagacgccacactgcaggcgcagagctgcccagacagggctccaggccagggcacagtcgctgcacagggaagaggcaggacacccaggtgtggggaaaaggaagagagatcagatcgttactgtgactatgtagaaaaaggaagacaaaataaactccattttgatctcta

SEQ ID NO: 399202 - DNA, 587 bp, Homo sapiens
aagtgttggtgagtgtgtagagaaatgggagccttcatacatttctggtgggaatatagaatagtgcagctactgtggaaaacactttggtgtttcctcaataagttaagaatagaattaccatttgactcagcaattcctttcttgaatatacactccaaagagctgaaatatgttcacaccaaatttgttacataaatgttcaaaacagcattatttataacagccaaagagtgaaaataacccaagttgatgaatggataaacaaaatgtggtatatctatacaatgaaatatatgatttatcaagaaaagaaatgaagtactaatacaatatgaatgaactttgaaaacatcatgctgattaaaagcagccagtcatgaaaggggatgtatgataggattccatttgcagaaaatgcctagaataagcaaatttatagagcagaaaatagattagcagctgcttagggctgggcattggggtgaggtgggaatgggcattgactactaattgacatggggttttctttagtgaaggacaaattgttctaaaattaggtgataataatggctgtacaatcctgt

SEQ ID NO: 399203 - DNA, 440 bp, Homo sapiens
aaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccaggtgacattgtcttggccaaagtggtgactagatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttacc

SEQ ID NO: 399204 - DNA, 731 bp, Homo sapiens
aggtatagtgtgcagcatttctcatacctgtttgtccataaaaccctcagctgcatctcacaggattcatgttccatagaccatgtttgggaaatgctcctctatgctaataaaaagaacaatgttcttgtacagacttcatgggagattttgacagagcaggtctttaatgagcactgtcctaaaccttgggacaaaggctgataaggctcctggaggtagaaagaactctgtctttcaaaatgcaagccacataccgtggctcatgcctgtaatcccaacatttgaggaggccttgcacacatcttcacaagagcatgtagcatgcctgatgtaatgtcacgtccctgaatcccttgaaccccggaggcagaggttgtcgtgagccgagatcacgtcactgcactccagcctgggccaacagagcaagaccctgtctcaaaaaataacaataatgataataataataatgtcatggccctctagcacagagccccgtgcataatcaaagcttggtaaatgttcgtttttgaattagttgatttagcccaactcttttcactttatagaggaaaactaaattctgaaggacagaggagaccaaaatatttatggaagagctgaggctgcaccccagatccccagtttccggcttcctggttcacattctagaaaatacttccctcggtaccaggagacctcccacttcccatctcatcagtcccagcttt

SEQ ID NO: 399205 - DNA, 736 bp, Homo sapiens
agtgattggcaaatgatagctgttatttcattgcgtggggacatctgggaggagcgagaagagtcacagccagttacagagcagagaacactggactgagaagcagatctgaattcaagcccagttctgctacttaatagccgtgtgtcgttagacaagtcccttgacctccaaccaatgggaagaacaacgcgtctctcagcacagttgtgacaatgcctgtgaaagcacacggtgtccaagggctgccaaagtcaggcattgtttcacagactcagaatgtgacagcggcaggaggccttgcacacatcttcacaagagcatgtagcatgcctgatgtaatgtcacgtccctgaatcccttgaaccccggaggcagaggttgtcgtgagccgagatcacgtcactgcactccagcctgggccaacagagcaagaccctgtctcaaaaaataacaataatgataataataataatgtcatggccctctagcacagagccccgtgcataatcaaagcttggtaaatgttcgtttttgaattagttgatttagcccaactcttttcactttatagaggaaaactaaattctgaaggacagaggagaccaaaatatttatggaagagctgaggctgcaccccagatccccagtttccggcttcctggttcacattctagaaaatacttccctcggtaccaggagacctcccacttcccatctcatcagtcccagcttt

SEQ ID NO: 399206 - DNA, 301 bp, Homo sapiens
ccccaatactaagcccattgccaagccatgtttattttatctcttaaggttcttccaactctgattttctccacccagtctaccagcaccctacttcatgctgtcttctctcttaactaggcctctatcatggtcttctacttggtcttttacatttacttttgccagcttacaatacattatctaccctcttgtcagagtgatcttttcaaaatgcaattctgatcacgccattctgcttaaacccttgtgtgttgttgccttgctcacaatattaagagcaaaatccttaccatggtct

SEQ ID NO: 399207 - DNA, 402 bp, Homo sapiens
ccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccagaactgcctttttgttgagcacagaaaacgaaggaaatttgcatttccaatgtcctt

SEQ ID NO: 399208 - DNA, 814 bp, Homo sapiens
tgtcccttctcactctggcctgatcctctcctcgggggacgcggttgtgccacgggcggggtggtcgcggggtcctgggccagtgccccgagcgcggcagaatttgtccaaactcctgatgccccagcgtcacctcttccaggcgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccaggcggcggcggcggcggcggcgcccgggagccggagccttcgcggcgtccacgtccctcccccgctgcaccccgccccggcgcgagaggagagcgcgagaaccccagccgcggccgggcgggcggcgaagatggcagaggcaccggcttccccggccccgctttctccgctcgaagtggagctggacccggagttcgagccccagagccgtccgcgatcctgtacgtggcccctgcaaaggccggagctccaagcgagccctgcc

SEQ ID NO: 399209 - DNA, 468 bp, Homo sapiens
tgagtactatagcttggtagtatatttcaaagtcaggtagggtaataactttagtgtttttttttcttgattgctttggctatacaggatcttttgtggggtatcatataaattttagatatatttaatttttattaagtatgtcactggtattttgataaaggttgtgttatatctgcagattattttctgtaatatggatatttaacaatattaatgccaattcatgaattagtactatttaattggtttagtatttaatttcttcctttaatgttctttagattataatgtaaggtgttttaactttttggttaaactgatttcaaagtgtagttattacatttattgtagatgagattgcttttaatttcattttgagatagttaattgttcttgtgtagaaatgctactgactcgtgtgttgattttgtattttgcaagtttaataaatttgtttattagttc

SEQ ID NO: 399210 - DNA, 386 bp, Homo sapiens
caattatgtaatgtcctaaatccccaatacagcatcatgcaaaatagtttcactgctgaaaattccctgtacttcaccatttcgtgcctcctcctctcctccacccctgacaaccactcatcattttactacttctatctttttgactttccaagaatgtcctagagttggaaatacagtatgtaggtttccagactggcttctttctagcattatgtacttttaagttcctccacgtcttttcatgacttgacagcttgttttgtaaaatcactgaatcagatttcattgtatggctacaacacagtttgtttattcattcacttggtgaaagatgtcttgggtacttccaagttttgacaattatgataaaattgctgcaagta

SEQ ID NO: 399211 - DNA, 438 bp, Homo sapiens
tcttctaatgtcaatctagaaacttgttttagtagtgcattttgagagaaaccatttggtatcatcttgcatggaaacatccgcttccttaggaatgaccaaaaactataattagtgataatgaatcttttatgatttggcaagagtgttttaagtggagttcttttgatgatatgattgttcaggtcaggctgaaagagccccaataataatgtttttctgactgttttcctctggtaatgtttgtgataaaattcctttgtcataaataaatattgttgctggtgcagactgaatatttgtattcccccaaaattcacatgtcgaaaccctaacccccaatgtgatagggtttggagatggggcttttgggaagtaattaaggttagattaggtaatgagggctggtccttcatgatgagattggtatccttatta

SEQ ID NO: 399212 - DNA, 161 bp, Homo sapiens
atgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgtt

SEQ ID NO: 399213 - DNA, 187 bp, Homo sapiens
agcattttgtgattttgtcagtctgccactcaaaagaggtgatggcagattatagccagctagaaacagctgcaaaacgtgtattgtgagctgtgcctcacttctgtagtgtgtcacaatgctttatagtcctcaagaaacttgacagtcaaatgcaatgcatgttccttgcttaggggatagatcc

SEQ ID NO: 399214 - DNA, 538 bp, Homo sapiens
caatacaagaatgggcaacttctcaagcccaacttagcttcacctatcatcaggacctctctatacaaaaaccttccctctgctaacataatatttttaatacaacctaaagcagcttttaaagattttcttaaacccacccccattgattcaagccccttgttctcccctgctaccctcattggccaggcactcctatacatctgtgctactgtaaattccagatccattgtgggtgctttagacccagcacaatgcaacacaacaagcaccattattgatatttctcaaaattttgtttcactaaatattctcaacatcaaatgagattttctattctccctccaaatgttttaacacctggaccattcatccaaaatgatgcctctgagttctgcgtcagtcacccttcttggagtcaacccaacccatggtgttgaccaagccagtataaattatgcaaaaggtttcaagtctttaatttctttcagaaaatccttttctttgacactactagaaacatgcctatgtttaaaaa

SEQ ID NO: 399215 - DNA, 650 bp, Homo sapiens
cctaaagagaactaatcattatgcatctatagtattgtattttttattctagtctaagcttaatattactaaattgggaggtcctaacataagatctagatatctttgtctatgccttagtactaagaacagagtataataggctgggcacagtggctcacacctataataccagcactttgggaggccaaggtgggcagatcacctgaggtcgggagttcaagaccaggttgaccaacatggagagactctgtctctactaaatatacaaaattagccaggtgtgttggcacatgccgtaatcccagctactcgggaggctgaggcaggagaattgcttgaacccgagaggtggagttggcggtgagccaagatagttaggaaagatgctggtatggttattttttaatagtaataacatcaatacacatatcagatagataagatagattaggacaaagcaaataatgatgtcataaaatgaagtaaatcttaaaaccttaactttgaattgggtatgtcaaaatgaaaatattatttaatttcttatctcaaaaaatgtttcctactagcctctgaatcagtatcaactcagtaacactgagcatccctaccacccagattgtggtcttcaaataccattttccact

SEQ ID NO: 399216 - DNA, 570 bp, Homo sapiens
ctggaggtaagcaggtccagagtgcatgtcatatgccaccaggtcaggaccgtgaacaaacctgaggctgggcactagatcacttgctgtgttgagccaccatgcctgccaatgcccttagctctgtgaggatgtaaaatcaggtatgtgtgggctgctgtgctgggtttccagcaggcacggagctgttcgcaggctcaagaggggtccaatggccatcaaaacccacatgtccaggagtcggtggctgaaaccacaaaggagctccagtcaccttaaagaaagatggattctaccaatggcagggttcaatggtcccaaaccagccaggagatgccaacgcttgtggagctgaacagacacatactgaggatgccttcataaactgctcacaatcagggcttgaaatacagagcaacccaggaaggggaggggggtacaaaccttttgttgctcctggctcacagtgagataggagtttggcaggactagttttgcaagacaaacaggaggctaggtccccaagacacaggtcacaataccctcttgataagacatgattccttttaa

SEQ ID NO: 399217 - DNA, 390 bp, Homo sapiens
cacacggtggggggcaaagcccatgtgccttggggaagagaatcccttaagtcagcgtgagctgagttctgtagcattgagcactgcagactactcagcccttatagccctcttccctggccttcccaccctgctccccactccacctcccctgtggttttcttcctgcctctctggccatttcttcattttctctctctctgtctctgtttttctcttttcttttttttctttctttctctctctttcttttctttctttctctctctctctcctttcttttctctctttctctctctcctttctttctctctttctctctctttctttctttttttctttctttctttcttttcttccttccttctgtccttccttccttccttcctt

SEQ ID NO: 399218 - DNA, 406 bp, Homo sapiens
ccatgggagcctacctcttgcatcagtgtgacttggatgtgagggactctgtgagggggtcccaaccctacatttcccttctgcactgccctagcagaggttctccatgagcacctagcccagtgttggggcattcagtattaacataattaataagaaacaattcctttcttattaggaaagattgggctctcgccctgataattcgataacagaaatcagataaatacctaggtaacaaaaaccgtgtcattcattcagccaacagtttattcattcaacttagagatctcgtcaatttccatcaggtgtttcccatctgatgctctcaatcaccctgaagtaaatttacgaagagggaagtggggatcagagaagttctgaaattagtacaaatcgcctgttc

SEQ ID NO: 399219 - DNA, 737 bp, Homo sapiens
ccgaagataattattataaaggcagctaactttctgtgaactcttattacatgccagacactgtgtaagtgcttgacatatgcttgatatatgtaactgcttgacatatgcatgaattcattgaatttattcaattctctccctacgaggccagtactagcattagtctactttagagatgagaaaaccgagacacagaggtaaagtcccatgttaatactgcatgaggcagagctagcatgcagaccatccaacttcttatattgaactgtagcccatctgtactcaaaacacatcaactaattcgtctctggcactcaataagcaaaacagatttaccctatgccaaaagctgttggtcaaggagcataaagaatgaagcaatactgcctagaactgcatgctacagggtagggtgcaaaagcagataagctaaaccactgcaaagcattgctcacaaatgttttagaggattggagctgtcaactaaagtaactgaggtttttccaaactgtgttacataaggatggaactgtttcttatggtcgtccactttatagatttctggtctttataacctttcagaatgacagttccattatgtgtccagcctatggcataaatagcttttttttcccttaagtttcaaaaggcactccctggtccacctatttaagagtttgattgacaagcacaagcctgtgttctccattaatgtcaatcatttctccttactc

SEQ ID NO: 399220 - DNA, 689 bp, Homo sapiens
gcctggcgccgggggcagcgtgacccggccgctaccgtgtcacagctggcgactgacaaacagcaggcgacgtcgggagaactccccgagacacccgagacatcagccttctcgctccgcggccctgcaggacctgcccgccgggagccccggagtccgcggcagcgccgagggcccctcccccaggcctctgggctctgaggctcatccatggaataccaattctttttcttagtgttcacattggatttttctgttaaaaatagattgttggagttggctaacaagttgattacttccagtcaggcactctcttctgtaaagtctcttttgtaaactcctacaagcagctatttcactggatttgaaaagactgactaaaaagaaccatgcactgtaactctcaagtatacaggaatattgttattaggtcacagtgagccgagatcatgccactccactccagcctgggtgacagagcaagactccatttcaaaaaaaaaaaaaactgaaaataccaaatattgacaaggatttggagcaagtggaaccctcatacattgctgatggaaatgcaaaattatacagccaatttggaaaaataactgggtgtggtggtgtgcacctatttttccaacaacttgggagactaaggtaggaagatcccttgagcccaggagtttgaggtt

SEQ ID NO: 399221 - DNA, 450 bp, Homo sapiens
ctactttcatatttcacactaagtctgtttcaggtttaagtaagggtaaatccttctcccataatctggactttcgggttccccagtggggatgtgtgttcagaggcagcttttcccccttctcaccttaagaactcacagtttttctcctgtctcacagaatttgcagcagcctactacttctttcaaatgatctgtgaattcttttggttttcctggtacattcctgtggtggttcctagagcaaaagtccatggtgtaagtctccacacactgttctgtctgtccaagtgggagctgtacatcagccttgtctccaatctgccatcttgaattcttatctctaactattttgtaataacacttagcttaaaatacaaacacattgtatagctgtacacaaattctttctttatatcctaatcttataaacttcttcttgccaaaaaa

SEQ ID NO: 399222 - DNA, 385 bp, Homo sapiens
ggtaagttatgtattacttttatataaaagaaatatggaatttatatttatcacagatgcagtaaacttatggtttggcggtgattccatgtgggaaaaatatttagtttaaaaatactttagaaattattcttatgcttactgactgagagcatttaagggaatttctgttccttttaatttgctgccaaacttttcaaagtcatcatcaagggcttacttgagtatttgtgctgtgataagtagaaactctgagcataactataaagacaaggattacccaggaccattctttacattgttgaaatacaaacattttattaattatctatactaatagagttgttaacattctgtgtgtcttcagtagcaaacgaaaaataaa

SEQ ID NO: 399223 - DNA, 238 bp, Homo sapiens
ctatcccttctcaatctaatccctttatgtgtattcctgaccctatggtcctctttcacccaggcccttactcaataatctcctgccacatcatcagtcttttcttcttattccctcttcctaataggtctctgaatgaggtccttctcatgtgggtctctcctgttctaacaaatttttccaacaggctaccctctgaagataatcactgttctttcttttaagcttttcaagataa

SEQ ID NO: 399224 - DNA, 542 bp, Homo sapiens
tatttttcttattaaacaactcataatgcttgttttatgttctgtctctgtcaattccaatgcccaaagtattggggattcttaatcagtttctgctgatgcttgctcatggtggattacttattatgtgtttgctatttgatcgtgcgctcatacttgataaaattggtgggaatgctgaaaggcctgaatggtaggtgacttatttcctgatctaatttaggtttgcttctgctaggtatcaaagggcactggtagcctggaaccactttaatttcttggcctgggagttccctgaccatagagggaagagaaaatttcaacctcagacttaactcatgaggtcaggcctgtgattacaaaatcccagagaagcctcttcaccgagagcgtggacctgaaatgctccctcataggtcttttgagtataatcaacttctttctcactcatccttttaatgaagttgcagaccctttcaggggttttggtctaatgtaggagtttccagttaagcgccctcatagtaaataaaaggtaagtt

SEQ ID NO: 399225 - DNA, 386 bp, Homo sapiens
caggtggattacttgaggtcaggagtttgagatcagcctggccaacgtggtaaaaccctgtttctactaaagaaatataaaaattagccaggtgtggtggcacgtgcctttaatcctagcctgggtgacaaagcgaggcaagactccgtctcaaaaaaaagaaatctgatagacttcacttgtaatggatatttaattctatatttcatgttatcttttgtaagaatttaagattagtcaacaccaatcctatactcctctagaaaagtatctttgtagctctactcattatttcttatctctaacctaagttactttattacatattaatctgttcatttgttcacttgctcattgatgtaataaattagtaatctcaatttatt

SEQ ID NO: 399226 - DNA, 468 bp, Homo sapiens
  misc_feature (2)..(2): n is a, c, g, or t
  misc_feature (18)..(18): n is a, c, g, or t
  misc_feature (52)..(52): n is a, c, g, or t
  misc_feature (56)..(56): n is a, c, g, or t
  misc_feature (59)..(59): n is a, c, g, or t
  misc_feature (90)..(90): n is a, c, g, or t
  misc_feature (92)..(92): n is a, c, g, or t
  misc_feature (358)..(358): n is a, c, g, or t
  misc_feature (365)..(365): n is a, c, g, or t
  misc_feature (374)..(374): n is a, c, g, or t
  misc_feature (395)..(395): n is a, c, g, or t
  misc_feature (415)..(415): n is a, c, g, or t
angtcatggacaccgggntgattcacatcaagaccttccacagtgccccccntggnccngaaaacagccatcccccaaccccaggcaaantncacaggtggccccttgccagtctctgcagcctggccaacgtggtaaaaccctgtttctactaaagaaatataaaaattagccaggtgtggtggcacgtgcctttaatcctagcctgggtgacaaagcgaggcaagactccgtctcaaaaaaaagaaatctgatagacttcacttgtaatggatatttaattctatatttcatgttatcttttgtaagaatttaagattagtcaacaccaatcctatactcctctagaaaagtatcnatattgntcgataaanagcgttgaattgtcttgtatnagttaagagtttgtgagtgntttaaataaaattagttgattaagtattttttttcctatgattgaaaaaaaaa

SEQ ID NO: 399227 - DNA, 658 bp, Homo sapiens
ttgtgagataattgactacaatgttttacatcaccatgatttgaaatgcaagaataattaagaataaacttattaattgtcacaaatcatttaaatctgtacataaggatgtactaaattaatcaggcatcttaaaatattaatacttttttgcagaatattctccagaagcagttgtacctgcattttgtagtagaaaatcaggtagaatttgtttcccaagactaatcctcattttattctgatacacctacctgaagaaatgccttaatatttattaagatcctaatatatgcctgactctatgttaaaggtcttttgcctacataatttcatgtaatcctcacagccatcctaaaagggcagtattatcatctttattttgcaagtgaaaaaataatgtgcctcaactaaaggctggtgctagaaaatgctgaagccagaattaaactgaaatctaactgaagctaaaacacatgatttttccattatgccaagctgcccacccagaggaaaaaaaacagaatgtaaccaacaacatgttaccttcaattttatcacctgtatctgttcatttctggtgagatgtagaaatcacaaaggctctttcacaatccctgatggggctgaaaaatacatttggacgctaggactgcca

SEQ ID NO: 399228 - DNA, 514 bp, Homo sapiens
acgggattttcccatattatcttctagaatttttatggttcccagtcttagaagattaaaatctttgatccatctcgggttgatttttatataaggtgagagatgatgatccagtttcattcttctacatgtggcttgccaattatcccagcaccctttgctgaatagggtgtcctttcctcagtttatctttttgtttgctttgttgcagatcagttggctgcaagcatttgggtttatttctaggttctctattctgtgccattggtctatgtgcctatttttatgccagtaccatgctgttttggtgactatagccttatagtacagtttgaagtcaggtaatgcgatgcctccagatttgttccttttgtttagtcttgctttggatttgtggggtcttttttggttccatgtaaattttaggattttttttctagttctatgaggaaagtcattggtagcttaatggggattgcattgaatctataaattaccgtgggcaaatctaccg

SEQ ID NO: 399229 - DNA, 603 bp, Homo sapiens
tgagtagcaaaggactaaaggttgtgagataaactgcttttagcagcccaaagggccagctggaaagacgagaccagttacagagcaaatggcaagacagatctggtaatctgattcttagagtacttaaaaaagataagaaggatctattcctgatatacagggtacttggtggatgtgtccatgacctcgagatcgaaaacccattagttaatctttgtgacatctgaattttaaggatcttacccagtgaacatataactagtggaaatcctgataattggctaatgcaaggaagtgatacccatgtgtaatgcttatctttgtatccatttcatggggaaggtcatggaagacgacagcaaacttgagtggttaatgagagcttcactaatgttgtctgctgcaggcaataagtgaagtctctggcagtgggaagcatggacccaagaccgaaagctctggcactttatagcagtggtggggggtagataggacttagtgtggccccttaaagagcaaggtccaagtgattttctctggtgaatgtcgatgtggatctagtctccagggttagatccaggcaggtaacatcaaagtcag

SEQ ID NO: 399230 - DNA, 227 bp, Homo sapiens
tcgttggtgactcacaagaaagtccatcaatacaaaattgtacaacatccttgggtcacagttttgttcctcaaaattctgtatctattgcttcgtggttttctggctttttgtgcttcagagatgtctgaggcagcctacttttgacttactttttaggaagcctatttttcttgccttggtgcaagatttttttcttttgttcttacaatttaaaaatactacca

SEQ ID NO: 399231 - DNA, 630 bp, Homo sapiens
  misc_feature (34)..(35): n is a, c, g, or t
  misc_feature (46)..(46): n is a, c, g, or t
  misc_feature (52)..(52): n is a, c, g, or t
  misc_feature (69)..(69): n is a, c, g, or t
  misc_feature (77)..(77): n is a, c, g, or t
  misc_feature (82)..(82): n is a, c, g, or t
  misc_feature (99)..(99): n is a, c, g, or t
  misc_feature (117)..(117): n is a, c, g, or t
  misc_feature (127)..(127): n is a, c, g, or t
caccgagcttcccaggaacatcacatatcactgnnaaaatagcatngcatanatggatcaggccagtgnaaatgtanagaangccctgaagctgatggngtcaaatgaaggtgaatncaaggctganggaaatagcaaattcacctacacagttctggaggatggttgcacgaaacacactgatgggatcttctcccatcaggctaatcagaagcaatatcgccgagatcatgccactgcactccagcctgggccatagagtgagactcagtctcaaaatagaaagatgagtgctttacacctagtatggctaagtgttatttcatgaaacttttcagttgtctgtttatataagtctgtatttatgtaaatccatccatgcacatacacaggtcacccatttgcatgtatcccgtaggtcctggggccctgtgtagaaagcaggtctcatcgtggatcacagtcaagcaaacgttgaaagctgcagctcaggaggctcctcacgcccctgctatgccatctttgtcactacttccttcagccactttggattctgcttccctttctctaacttccagatgcatctttcttcccttaaagccagtcatgcattccagactggtagtgcat

SEQ ID NO: 399232 - DNA, 883 bp, Homo sapiens
tacttaaagtttaaggactgctttaatactccatgtttaattgttaattgagaatttaaaaatcaaaaatgccaactttgccttcgatgagatggaaaattatgctgctgtagaaggtaacataatgtaaaacagccaacattaccaaggcacacaaatgtttttggtatgtaaaattgctttgtaaaatatttgctccatctgctgaaagcggcaaagacaattttccctcgatagctaatggcccatttcggctgtgtggcaagtgattcgctgtggtggcggctctcattaaacagaatggtgaaaatgcggtatataattccatacttatgtagcattatccactcgctgcttctcgaggagtctgtccctcattatctaggcctccaccttgcaccaacatgcaggcctagcagttgatttgactcgagaagcgttttgtccaactgaggcacatatgttgtgcctccattccaaagctcagcacaactgctttgcccccgaccacaaacactagagaggttcattccctttcaactttccagcacttaaattgctgtatcttttttcctctcaccacagggggctgtggttttctttctaggctcaccctgtgcgcgctgcatgctgggggtttcaatagataaagattaaatgcttcttgaaattcttaattgaaatttgcacatacacaaaggcaggaaaatttttccctgggacaaaattgccatcatcaaagccccgacaagccctgtccttggttcatggtgtatgtgagggcctgtgatccttttctttcagggagttgtttacactactcccagaattacttcaacatctgctaaaggaacaattaaagataaataatccagggtggttt

SEQ ID NO: 399233 - DNA, 448 bp, Homo sapiens
tgaatgtaggtacttctacctcatcagctagaacaaagaaagtctaaataatcatagtttgttttgtagttggcatctcacctcataacttttaaaagaaaggttctgaatttgtcacgtttgctgcctaggtaatgtagtgacttattttatgctgcaaatgtctgcttgtttaggatttctgatataggctggcatgatttcattcttgtagacttacgaccaaattactctgtgctgattctgaaaagatttgtctttttggtgcatgtataagaacataagttgcctgatcttaagagtttttttctgattgggtatggtggctcatgcctgtaatcccagcagtttgggagacctaggtgggaggattgcttgaggccagcagtttgagacgagcctggtagcctggtcaacatagtgagaccgtggctctatttaaaaaaaa

SEQ ID NO: 399234 - DNA, 503 bp, Homo sapiens
cgcacagaaacagcgttgcccttggcctggagccattgtcctgaaaggggatccttcccaactggggcctgagactgatccctgagaagtggcccctccatcctggaacccctcctgcttgtgtctccttacttcctggtgatcaccgcattcaggctcagaatgccgcaggcctatcccactggaagctgccaaggtgcccagcgccctgttgcactcttgtcccacaggacgccaggcacagcagcagcatcaagggaccagcagggaagaggctgcagtgatttggggaaacagtgtgaaaatcacctggggcctggcgacacggggtcccgcctcctcccccatattaggtcccagagaaaatgacaatatgaacagctcatgtcaccattattaggcagagtctttattctttccttaatctttgccattaaattgagctctataggaccattttctgcttttaatgccaataaatgaaattccagagctgcttctgt

SEQ ID NO: 399235 - DNA, 363 bp, Homo sapiens
aggccaagctggccaagcaggcagagcactacgatgacatggccacctgcatgaaggctgtgaccaagtaggtcgccgagctgtctaataaggagcgcaacctgctccttattagaatgtggtcgggggctgcaggtccgcctggaggctcatcttgaacattgagcagaagactgacacctccgacaagaaccctcatcatgcaattgcttagagacaacctaacactttggacatcagacagtgcaggagaagaatgtgaggcagtagaaggggctgaaaactaaatacatacagggtgtcctccttctttccttcaagaaacctttttacacatctccattccttattccacttggattt

SEQ ID NO: 399236 - DNA, 441 bp, Homo sapiens
cagaaaataaatgacatatgtatatcatgtggggataaatagataaaaatacacggaaagacagttagaagccagccttaatctgtcttgggcccagacagcccttatctgttgggggcccagatgtgtctacagcattgttaacatctggtgagaggagaggagtcagccagccatcctgatgcgttttcttgctgatggccgatgatgcccaaatgctaagcagttcgcagtggttaactgtggaggaggcaaaggaggacttgaatgttttcctcttatctgtttcctgtatttgtgtgttacctgagtaaggtttcacttcctgtattactcatgtgatattttactttttaatttatgtacttttgtatggcttgtatctattttttaagagtaaaacaaaatgcagagattatctgcagtgttgtctaagatcct

SEQ ID NO: 399237 - DNA, 655 bp, Homo sapiens
cactgagatgcctttccactgccagttaacaccagatagcaaacattacagaactctgaggtcgttttggggagcctgtatcctctatttctttaggcccgaagtggttctcagagcagtggtgatttcttatttaagcctgtctacattagatgggcatgcgcataccaccattctgtaagattccaagtggtgtattcattttgttacatctgatgggaggaaacagaagaggaaaagaagcaagctcttttgggattgacatgattaaactcaacttcttaaaagcttttttcctctggtagaccatcttcaatttgtagatcctttatgtcagatgaggggaaaaaattacacatagtacattttatttggaatattgttagatagctgaattgtcaaagatcagaagttgttacatatttttgtctcttagataatatggaagtatataccttgtgtgattgcatttgggagtcttttttttccctcacttccatgctttcttaagaaagaaagagaccttttaacctttaaaccttttctttttctgagatttaactataagttaattgttcagaatggagggtattttctatcaaaccaatgcaaattttggtgattagattattggaccagctccataaggcctatt

SEQ ID NO: 399238 - DNA, 404 bp, Homo sapiens
agttttacatgggctagagccagccagtgtgactaaataggaatgttctttatgtgtaaaacggtaacattctaggaaataattatattaataaaaccatatttaaaaagtgttcttggccgggcgtggcggctcacgcctgtaatcccagcactttgggaggccgaggcaggcagatcacttgaggtcaggagttcaagaccagcctggccaacctggtcaaacgctgtgtctacaaaaatacaaaaattagctgggcgtggttgtgcgtgcctgtaatcccagctatttgggaggctgaggcaggagaatcgcttgaacctgggagaccgaggttgcagtgagccgagatcgtacccttgcactccagcctgggcaacagaggaagactccgtctcaaaaaa

SEQ ID NO: 399239 - DNA, 391 bp, Homo sapiens
cacctgaaacaaacttagtaggagaagaccagccttccaaaaaattattattttaatggaatataaagaatgaactaggaatagaatagtaagtatgtgtgaaggccacatactatgagtagatattaataaaatatgtgtgcatatatatagtataaagtctagaaatacaaacgaatatgtagctaaagatatatacatgtaagtaaatataagatataaagatatatatgcgtgtatgtatacatataagcatagatgtatataatgtctaaaacaggtatgtatataaacgtagatataaacaaaatgtacaataccatatataatgtacacatacagtgtaaaatttattaccatgtgaatgagaattaaaatatgaaaatcgcta

SEQ ID NO: 399240 - DNA, 270 bp, Homo sapiens
tattttatttaccattgtacccaagtgtctggcacaaccacttactattacaagttgggacttctgggaagcagagaaacatcagatttttaaaagaacatgaacaacaatggaaagattatgtaacaaaggttgaatataagagagtggataaaccatagaatagtttcaggatgattaaacctcaaataaaccaagatttgaaaaaaatgttgacaacaaaattttatgtagctatattcagaataaaaatataccaatgaatgttca

SEQ ID NO: 399241 - DNA, 398 bp, Homo sapiens
tgttagacgttagggaaacgtgggtgaagggtatatagaaattaactctgtgaactaatgtgccaacacttctgtaaacctaaaattgtctcaaagttagtttttttaagccgggcatggtggctcacgcctgtaatcccagcactttgggaggcggaggctggcggatcacctgaggtcaggagcctgagaccagcctggccaatgtggtgaaaccccatctctattagaaacacagaaattagctggccatggtggtgcacccttgtaatcccaggcactcaggaggctaaggcaggagaatcacttgaacctgggaggcgggggttgcagtaagccaagatgacgccattgcactccagcctgggcgacaagagcgaatctccgtgccaaaaaaa

SEQ ID NO: 399242 - DNA, 560 bp, Homo sapiens
gacctactgaatgttcttcccatggctggtcagtgctgacacctcaacacaggaagagaaatactcctatgaagtcatctgaagcctggtcatgccagggacacttcacgaaggcaggaacagtcctgtttctaaaagcccaaaatctaacagcctctctacagatataaaagcccaaagacatggaaagtttgtatgcagacaaccctagaagtaaggaaaagtgaatgacatatatgtcaatgcccagaaagttccttgagatcagacactgtacatttatgggatactttctaagtgccagctactgtacttggtgctggatcagtgcatccatttcccggggctcccgtgatgaagtgccacaaactggatggctttaaacaacagaagtttactctctcacagttctgaaggttagaagtctgccatgaagatgtgagcacagccagcctctctccaaaggctccagaggagaatccttccttgcttcttcccagagctccttggcatacagctgcattactccaagatttgcctctcttgtcacacagcattct

SEQ ID NO: 399243 - DNA, 419 bp, Homo sapiens
aagggaaggggacaatttgccaagtaggtgccttggtctactcccatttgaagtgtatctaacgggtaaacactcagtcaccacatgaatagggacatttctcccttccctacccgcttgtctccatgccaccttggagaggggtcacacatggaacctaccgcttccctgcccctttcccttcttcccctacaacacactgggacctgaggagccgaccctttgtctctgcctaagacactttgtctcttcctaggcttctctgaccagaagcagcaactggggcactggtttaaaatattcattccctgctgggcgcggtggctcatgcctgtaatcccagcactttgggaggccaaggcgggctgatcatttgaggtcaggagttcgagatcagcctgaccaacatggtgaaaccc

SEQ ID NO: 399244 - DNA, 426 bp, Homo sapiens
ccaaagagaactctaaaggtgggtaaattgaatagcatttctcctcaattgcaggacaaacaactccatctcacaagactggtgcttgttctgtttatttgtctttatgttgtgagcactactggacacgtgctggccactgtcacaggagatgaagggtgtagaacacttgatcagaatcaggggcatcagatcaataataggcaccctatactcttctgctatccaaaaagtgaaagatgtttttagaatctgtttcgacgtacaatttatttatcaactgggtactcagggagactctattttccagttcctcttgcatctacgtgtgaccacatgactgagttctggccaatggaatgtaggtggaaatatatacttgactttgagcttggtcataaaataaatacaccacttggccccctt

SEQ ID NO: 399245 - DNA, 727 bp, Homo sapiens
ctccttttggggaatccattcaaatgtggttctagtggcgtccaactctggaactgcaaggggttttgtaggaagctggaatgtggcttacatctggcagttggaaattctccccgtggaatctgaatctcccctggaaactctcccctgggaccataccccattattcgtactgctttagatacatggggagtgtcgaggtatgggacactctgctcctgctccctggtcttccctgaatgactttagctctttcctttgaaccccaaatatctgagacaggtctcggtcaatttaggaagtttattttgccaaagttaagaatgtatgcctgtgacacagcctgaggaggtcctgacgacatgttcccaatgtggtcggggcacagcttggttttatacattttagggagacatgagacatcaatcgatatatgtaaaatgtacactggttccgtcaagaaaggcgagataactcgaagtggggagaggacttccaggtcataggcagatacaagacaaatggttgcattcttttgggtttctgattagcctttccaaagaaggcaatcaggtttgcatttatttcactgggcagaggagggatgactttgagttctgtctgtcctcttgtccaccaaggaaattccttgtgagggcaggtatgtagcttttaaaaaacttagtagctattttttaggaactagaatgggggggttttgccctaa

SEQ ID NO: 399246 - DNA, 244 bp, Homo sapiens
tactgcattaaaatgtcaggtcagtgcaggtaataaagccgtagttgcttatccatatgacatcacctgttccactaattgatatttcttcctagaagcaaatctcaggagccaaaggtgcacaggtgccccatgtcactgggcctcgaataggaggaattactatagtatctacttatattgctcatccttcccttaccagcatcccaccgcttttggccaaagacttgggaagagtatagta

SEQ ID NO: 399247 - DNA, 337 bp, Homo sapiens
gcaattaccgtctcctacggagaaaatgccccttttccagcactgggcccaacatggatgcccttggggcgagggcaggatgcccttggctcgattttgcttataggtagattttcaccaagatggacgcaggagactcgcctgtcacctgctggagaaatcacagcatgcaaatcactttgtgccttctgcctttttattaggttaatacagacattggtaggttttatatttacagctaggcctggatgcctgcctgtgaccttttgaagggtacacactgtttgtttgttcatttgtttgtttttccaaaaaaacctctgtattactttttttt

SEQ ID NO: 399248 - DNA, 281 bp, Homo sapiens
tatcaagtagatggcagtaaaccattcatgaaaaacacctccatgatccaatcacctcccaccaggcccacatccaacattgggaattatactttggcatgagatttgggtggggacacagatccaaaccacatcagtaagagaatgcaagggagaacttaatatagttcattatttgacagacactaagcaccttccctgtactgagcagtattataagagcttcggatagatgaagcttttgtcctactgtagggaagtagataataggcaaataaatc

SEQ ID NO: 399249 - DNA, 249 bp, Homo sapiens
cctgtttcctattttggagtaacctgaagcagcaataagagtaggtaccaaaacatctatgatcattctggtccttggtaggaatacagtcacttagaacactgggaaaatagctctatgtcaagaaaatgttttcctacctgtagcatacctgtatgccagggtattatcaataaacttagggtcatcattttatacctcttcattgctcaaaatggtctgagatgctacagtatgatatacatgcta

SEQ ID NO: 399250 - DNA, 744 bp, Homo sapiens
acagtggctcacacctgtaatcccaacactttgggaggctgaggcgggaggatcacttgagcccaggagtttgagaccaacctggacaacacagcaagactgcatcttaaaaaaaaaaaaaaattagccagccatggtggcatgctcctacagtcccagctactcgggtggctgaggtgggaggatcacttgagcctgggaggtcgaggctgcagtgaaccgtgatcataccactgaactccagcctgggcaataggagaccttgtcataaaaaaaaagaaaaaaaaaaaaaaaagtctagacacaccagcaggactgcccatcttcaggaaacgggaaaactggtagatgtatgaaccttctcacaaatttatttgagttagtcatgaaaagaactaacatcctaaaacaatgaatacaggcaaattctccatggaaggagaaactataccagcagagcttatgtttttataagaatgcaaaagatatattaagaagcaagagaaggtaaaaatagataaggtaagcttttatgagtaatgaacagcctggtcttatgaaagaaagaaaatgtaacagaagttttagctagaaatgtcagaattaatgagtaaagcaggcatggcagcaataatctgttcaaaaattggtcacatatatggtcaccaatactggtcacaagtcatcttccagtattttgacatattcatggggatttgggtgctgtcacaagacaccacattg

SEQ ID NO: 399251 - DNA, 614 bp, Homo sapiens
ccccagggctcggctcccgtgtcagccctgtcacctgggaaatggctccagggccatcaccaccacttctgccccagggtccactcttgacacaagggcaccaggcaggacctctggctgagtcctcagtctcacccctttggagagtgaagtcctccgtctggggggcaatcagtgggtctggggcggccaggccgactggcctcagcagcgggcgcaccgctgagctgtgaccgtgcacctcaggcacatcgtttcggctaacgttcacacaacccgcagtgtgtgctcctaccgcacccccttacagatgagcaatgggaggctcagagggatgaagcagctgccaccgcacacccaccgcaccacacggcggcagcactgacgctgaaagccacgtctgctggcttccgaagctcctgttgttaatcgtggctatgtttcaaaactgcagagaagaaagcctggaaataaataaggggcaatgtcaaggttgcccaagtggtgctccttctttatccttctcatattctaaaatttctagaaggaattagacaaccaaaaaacctaagggatggggactagttagtctcaaaataaactcagaatattag

SEQ ID NO: 399252 - DNA, 443 bp, Homo sapiens
ataaattctgtctgctgttttctttgaagggataggctcactttgttaatatttgagaacataccatccatagaaccatagcttgtcagttgttctttcaataaaaatagtattccatgagaaaggcagagaattcagctcacaattcagtcacacaagtgcttctctttgagacaaatgttgtacttcagtatgcaggtgctttatgggtacttctcatcttgtgtcactctacttaaggaccaagatttaataaaagtaataatttttattgcttctccaaggtcattcttaagtcaaagaggcacttgtgtttttactgcaagtgtttggttatgaagaatatgatcactactactagtagtttggtgccaccatactaaggttccaacagttctacccaccactgcttttgtacctcaataaaaatatcaatgcagcaa

SEQ ID NO: 399253 - DNA, 438 bp, Homo sapiens
caaggatactctccatagaaagggaaatagaaccagggagtttcttaagattcagtcagaataaggccagttagctgggtcactcaaatatttgagagcactgagctaagcatatatttcaatagcaaaggtaaatttgtcattacagtcttttccatgtgaacttgtcattgtcatttttgcctgggcatctcctcttcacattggaaagagtgaggcttgtccattgtcagataggtcccaggcatctcagcattacttcttatcgttgtctgtcctttgattactacgtagcctcctttagctagaaattaaatgaagtaatggatacggatcacataataaaatgcttggcataagttaggagagcaagtattaatcccctttctgatgcttgccttttctatgcttctgatgaacactttattctcttaggta

SEQ ID NO: 399254 - DNA, 541 bp, Homo sapiens
atgctaaaggtaggaaaaatgatgggttcttctgctctgagagctgttctctcttcttttagacttttctaggctgttagcaaggaattggtgaagggaagcctttctttgttcaggtctccctttcagaccctggtgggttagccaagttcataggacgtttacatattagtcctccacttaaaaactagcttgtgttttgaaggttgctgaatagatgtcactaagtagtagaccaaaaagctcaccctaatgattgttttacagaatggaatatattaaaccatgacccttttaaaagatgcagtcagtggtttatatgacatttcacttattgcttattataatatttaattctgaaaaaaatgttttgatgaaattgactttactactcctgtaagttgttcctataagatgattttgcctcttaagtctttggatggtatttattactattctgagatttgtatctcaaatttggatgttataaagatgtcattatatatgtgtacagcatatgtaattaaagatgagagccatg

SEQ ID NO: 399255 - DNA, 556 bp, Homo sapiens
gagtttggtagctggagtccaaaccagttagtatgctgtacagtttagaaattagtgggttgcctgctgtcctgtgtgtttacataacagggcacctgaggtaggaagggccctttcaggactgatttcttgggggccagaatggacatttggagtctagagcaaatgcaataggagaggtgggtggcagggagcatctttatgaagctttgtatagaaggaacagtccagctttagtgagtgtggagctagactctgatctggatttgaattctggttcctgcattcattcaactgtgttactgtatccaagtaacttgattgacttgtgtgagcctcagtttcctcactgtaaaatggctattgtagtactcacttaatggagttattaaatgactaaacaaactccaaagagtatatctaaagccagctgccaccaggcctggtagcttatgcctgtaatcccaacattttgggaggccaagatggaaggattgcttgaggccaggagtttgagaccagcttgggcaatataacaagaccccatctctacggg

SEQ ID NO: 399256 - DNA, 197 bp, Homo sapiens
catcacatcaaataattaagcaacaccataatgaccagacccaggaaattctgtaaagctccccaactttcttgctctctacaatgcactgcgtaagtactctgcgcttcccaccctatgcaggggataaactcagtaactttcaggctgaaatcctactgttccctcttcatcctccccaaatccttccccccagt

SEQ ID NO: 399257 - DNA, 427 bp, Homo sapiens
aatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacatggcaggattgcctgagcccagcagttcatgactaagcaacatatggagattctgtctatataaaaaagtaaaaaattaactgggtgtggaagtgcatacgtctagtcccaagctacttgggaggctgaggcaggaggagttggaggctgcagtgagacgtgattgtgccgctgtatccagcctgggtgacagaaaaagaagagacccttcctttaaaaaaaaaa

SEQ ID NO: 399258 - DNA, 887 bp, Homo sapiens
  misc_feature (509)..(509): n is a, c, g, or t
gtgtgtttgcttgcgttgaggggagcaggaccataggccctagaggcccccagctgccttctgagactgggcgaaaccctcggcagcgcgcagggggcgctagggcgcgaggggcgggcactgacgggcaccaatcacggcgcagtcccaccctataaataggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctngtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaa

SEQ ID NO: 399259 - DNA, 484 bp, Homo sapiens
gccgagattgtggcactgcactccagcctggccaacaaagcgagattctgtttcaaaaaaaaaaaacaaaaaaaaccacacatagagtagtataagggtgttatttagtaataagtaaatgttagaagaaacagccaaaggatttgatgagtgctttggggaagcagaaatcaagagtgggtatttccataatttttctttataagtttggaagtactgtttgacatcttaaagtatgtacatgcattactttgataaaaattaaatgaaaaggcgtatcactgcccaccaaaaacagacaagtagggtggatttgtgaaacgatcttcaggaaaccacaatttagacaaattcaccagtatcgaatactttagagattgccattgaagctgttgagtaattacctgagaattacccagaaatatgtgaaacagcttttgaactggattttcacatgtagcattgctcagagaaaactaacagt

SEQ ID NO: 399260 - DNA, 317 bp, Homo sapiens
ctgcccttgctgcccctgagacctcggatgagccgtgggcattgactctggctgtgcccgtcccccggtgagctgcagagagcgaggttcaattctgtgttttgtgtttttttttcttttctttttttgagacggagtcttgctcagtcacccaggctggagtgcagtggcacgatctggactcactacaacctccacctccagagttcaagtgattgtcctgtctcagcctcctgagtagctgggattacaggcaccccgctatcatgtatggctaattgtattttagtagagaaggggtttcaccatgttggcca

SEQ ID NO: 399261 - DNA, 740 bp, Homo sapiens
attgttaatactcttgataattgtcataactgccataggaaaggtacaaagtgctatgaggtttcaaaggaatacaaggcttctgtggttgttcataaggaatgggtaatttcattttgtaggcactattgagatggattttgaaggatggtcagaaacatttctaccagttacaaaagtaatatgtgcttatttaaaatttcaaaaataggctggttgtggtggctcacacttgtaatcccagcactttgggaagccgaggtaggtggaatgcttgaacccaggagttcgagaccagctggataacatggcaaaatccagtctctacaataaatacaaaaattagccaggcaggtggtatgtgcctgtagtctcaggtactcaggaggctgaggattgcttgtgcctgggaggttgatgctaccgtgagtcgtgattgcaccgttgtactccagcctgggtgacagagcgagaccctgtcttgaaaaaaataaataaaatttcaaatatagccatatataactttaactctaagaggcaatcattgttagtattacttggcaattcaaaatattattaagacttgagccttgaagttctttcttctcttgttataaagaaactttgatcatcctctctagcccatttgattatttcagcatggtatcggttttctacttcaagataattttactgagtacacattttatacatatctctgttaaattattactctactg

SEQ ID NO: 399262 - DNA, 366 bp, Homo sapiens
ccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacacgagaggaaaaaaatggaagatatttttgcacagaaagagatggaagaaggtgagttcaagaactggattgagaagatgcaagcaaggctcatgtcttcctctgtagatac

SEQ ID NO: 399263 - DNA, 735 bp, Homo sapiens
gccaaatatgccagattttactttctaactggagtctgattttatacttctgtcctctttcttaccacatggcttccagcatcacttacaaactaacccttaaaaaggagaaggctaagttaccaacatttggaaggcttatgaaagtgaagcatacttacaagccagcaatgtttttatttatggaatgtgtgagaaccatacacttaagcaaactttggggaatgagagttggggagaatcaactcttttatttgctaattggtatttcctttaaaagatagatttcctgcagattttaactgtgttaacagttactctagaaaaattggagatttgtgtgcatatattttatgttgtaaacagacacacacccagagacactgagagagacaaatagacagtaaacagaggagcactaaccacaaacggtttacaaatgacctccgtactcattcacccgtctgttccccaccttgccttttatagcaactatagcaacagccatgagagtcattgtggaaaaaaataaaataaaataaaaaaatcctggaagcttgtaaagaacctgagcaaaggggaggaagttgtgaaaaaaacgaataaagggcaccgatccagagtattgaagaaggcagagtggacagcctagcaatgagtatctggtactccagtatcctctcccacagaatctgtacagctttccatttatgacagtttaaacttaatttaaat

SEQ ID NO: 399264 - DNA, 435 bp, Homo sapiens
gccacaacacgccactagagaacaaacccttgccccggtcacagaccccgggcggaatacgcccccagctccggagggacacaagcaggtccgggggccaagacctggttcttgcgccccggctggcggggatctccgagctcccggcccccgggcgcgcgcccctcccccgcccggcgcctcacaaaggccctttgtcccgccgagcccccgggactccagttcctgaaaagttccaggagaaaaatcaaagagagagcaaaatcggcgagctccgccgagcgggcggggcaaggccgaggtggcagctcctgagagaccccaaggaagaggggagcatcgagggctactctggaaattgcaaaaatccgaaactgcaattcgaacaggaggtggatttttttttttttttaagtcgagacttgggacgccaag

SEQ ID NO: 399265 - DNA, 365 bp, Homo sapiens
gcacgaggctaactgaattcttattttccggtggagttaagttttcaaacattaaagaaaaagttgtcaagccttaggcacatatatgtgaaaatgcctgtgacatgtcttagatcccagcagatatttctaaatatcatgcccacacttttgtgatataaagcaaaatgatgaccagtaccaggagatactttaccaatgttttctttatcagttctacctccctccgaatatgaaataaactcttccccttttctctatacccagcccttctgtttccagctctgcaagcctcagggagacaatttcttaagccacacttctttcctttgcctaggaagcaaataaactacgttttgttttta

SEQ ID NO: 399266 - DNA, 595 bp, Homo sapiens
ggattaatattttggaatatttgcattgcacttaccagttgaacatcccaaatccaaaaatctgaaatgctccaataagcgtttcctttgagcaccatgttggccatcaaaaagttctggatttcagagcatttcagatttaagatgttcacctagactcggtatcatgtatttatcagattggaatacgacgagtcagtaataacatcctcccagataaactccatgtaatcaccaaatttaaatgtacagtagtccctccttacctgcaagtttgctttcccaggtttcagttacccactgaggttcacaatattaagatattttgagagagatatcacattcacataactgtcattacagtatatggttataattgttccattttgttatagttacatatgtatagcaaaaaacagcactgtatatatagggttcagtactatctgcagtttcaggcatgctttggtggtcttgaaatgtatcccttgtgaataagtgggatctactgtacttcaccctatccttttgtagtacagcttgaaaaatacaaaattggcaattttaacctgtatacataatttcatataccact

SEQ ID NO: 399267 - DNA, 439 bp, Homo sapiens
acagtacaagcattcctgaatctctagaccccggctaaataggactcagttcctttttctaaaaaagtcattgacaatataagtaaaaccaatatataaatagaaagctattttattaacattttcacacatttaaattattagtgaagtttttttcataaatttcttttctttatgacactcctattcatttcttttgctcatattccagttggaattttctctatattactaatcttaacaggaatttaagctattagacctttacctaatgtttaagtatatgccaccggtttgctgctgtctcttaccatcatacctgatagcttttgctgtagggaaatttaaaacacttacataaaaactgtgcttgagcatctacgttcatggaatgactaagagacaaaactagagaagagacagtaattgagatggaaac

SEQ ID NO: 399268 - DNA, 396 bp, Homo sapiens
cagcccgcttgtctctgcccccctacgggcccggggcgcctcgggcgcctcggtgctgcctgcagcccccgcgcgctgcccccagcccagcttgcgctgtacggagcgcgcccgccggagtcacagccccctcctgccgcgacctcgcctgacctggctgtccgggcacccggaggcaactaaggccgccccctgcccagatgccggcctgcctctcagcttgacttccctccccggactttggagtgtcttctgcgttaggatttggatcccagtggccctggagcggcagaagggccgcggcgataggaaagcagcgaaggaggccagtggccggagtctgccccagcccccacccgcgggtaaccttggaggcgccctcggagtgagtgtgtg

SEQ ID NO: 399269 - DNA, 271 bp, Homo sapiens
gcatgatcatagctcactatagctagcctctggtcctagcctcaagtgatctcctgctttggcctcccaaagcactgggattaaaggtatggtccactgcatccagcccaaaatagatttcttaggtgaaatcttttttactaatcttggattttttttttttttttgagatagatggagtttcgctcttgttgcccaggctggagtgcaatggcgcaatcttggctcactacactccagccaggaggacacagagagactctgtctcaaa

SEQ ID NO: 399270 - DNA, 624 bp, Homo sapiens
ctgcgtttcttgccgcggcacgctcctgaccgacctggaggagcgctgaccagctggctgaaccctgccagcgactctggaagggccgctcctccctcggtgccgactctgggcggtggccgcgccaaaccccgcccggcgtgggacttttcgcatctccgctactgtgagggcggaaggcggcgcccttgacctacgcaggatccttcccgggctgcggtgctccatcggaggggaggcgcccggcggtgtcctcgctgctgcgcctccatgcatcggcccttcgtggccaacacagaggtgatctcagtttactttaaccagggatgtttgtaccatattgcacctcggaataaagaaaaatggaatttcaatcccgaaatcacttcaaccccaaaaacggccacgtctccaagaagaaccagtaaactagtcttgctgccccaaggaggctggagcctggaggtcttgctgaaatccctaaccttgtttttactctaactcgttactttgaattttatcctgcttgtctctttaatcacctagccttgcttctcatgtaaataagactctctctagctgggaaagccggacaaactccagttgaccccttaatttacaaga

SEQ ID NO: 399271 - DNA, 381 bp, Homo sapiens
atagacattttagaacagtcttgtggttctgataaagaacgtttggaggttgtagacacgaactgtgtgtttgtgtgtgtgtatgcgtaggtgtttgtatgtgtgttttcttcatacttatgccccatctgaatatgtgggaattagatccttggatcatttacaaaagaaagaaagagaattttcctagcagcttggactgcatgtgtgcaccaccatgcccagctaatttttgtatttttagtagggatgggttttcaccatgttggccaggatggtcttgcagtagaatcacttgaacccgggaggcggaggttgcagtgagctgagatcccaccactgcactccagcccggcaacagagggagactccgtctcaaaa

SEQ ID NO: 399272 - DNA, 521 bp, Homo sapiens
ctgcaaaatactgttagggaatcaggggtctaatgaaatcgtctcttgaaatggaattagaaaatctgaatgttagtccccatatgggcagtaagtgtgatgttgggtgaatcatttaactagccgtaccttgctttcttcatctgtaaaataagagaactaaatataggttacttcttaaggtcatattcactgcaggtcctgtacacttctatgattctaaaaagtggctgtctttaacttgaaatgtatggggataatggggagaaaaagaatatcggaaacgtgtatggaatagagaaataattatggcattattctttaagacatagaataaaagaggtcatttgccattttagcacttgtgctaacattatgaaatgagaagataaaattccaacttgtacattaacacaagactagctatataaagtaaccatataatatttacacacttggatgtgtcataggcacctcaaacttaatatgtgccaaattaaacatgactcttcccacaaacc

SEQ ID NO: 399273 - DNA, 508 bp, Homo sapiens
ctatagattagcttcatttaaatgttcaaaataaaatatagcagtgtattattagtaacatactgtgactaagattttaagggggcagttcagtattatatgctttattaatacagttattatgttagtagatcaaaggagaaaaaactatctggttagttgtcaagacactgataagagtcaacattgaatcttgattaaaacaaaacgaacaaaagcacttagtttacttagtataattagggaggtgaagaacttccaaaaaccagcatcatacttgatttgtcattagagtgaagaacaggttgaagatgtattatcccacttgacagaattcatcatctgttccaggtaaaacatgtaacaacataggaattgataggtccttaaaagagtacacatgcatgtacacacacacacacacacacaaactttcttcagcccatgcacacatacacacacacacacttcagcccccgcccccgacacacacacatacacacacaca

SEQ ID NO: 399274 - DNA, 460 bp, Homo sapiens
tgtaggaggtaatggagaagtcagaaagacatgaatgtctcatttcttctggcaagaagtagaataagttgtataaagaaaggtcatggcctatttcaaaagcagaacgatgatgacagggtaaatctagttggagacactagtagaaggaagtgaaggcaagaggactgtgagtgagtggcagaaagaaggggtgcctatggaatggtgcaaaggttagggccagaagagccctaaagaaaagaaaaagtcaaatggctacgaagccaagaagttgaatacctgggcctttctgtcccttctcagggaacctgatgtatcttggtatgataaggacatccaagcagacattcaggcctgaacctgtcctggaactcaatggcagaagtcttcaggaagtttagacaagtgggttctcaaaggttaatctcatcctccttgcaccacccactctcagatc

SEQ ID NO: 399275 - DNA, 368 bp, Homo sapiens
acctgcagagaactccatgcagagcgactttgtagttgcacaaaatgggaaattaactggctagacagtaagtctggggaagtaaagataggagctggaagcatttaaacctggataactgcccagttcaggaggcggggggaaaaaccctagcatggcgcttttgtctatagagcaactttccagtacaaaagcgattccaagtatttgcagactatacccagaagcttggtttttcatgccaaagacacacatattaaaactggacttttaaaccacagcaaggaaaacaccaattccaactgcattcggtttgggctttccggctgtgttgaatccttctaaaggaagatttctgccccctagcc

SEQ ID NO: 399276 - DNA, 983 bp, Homo sapiens
gcgtcagactatcaccaaagtttatttgctggcaaagctggttttcccagaaatttgtatgtaggaatggtttaaataaaagttgatggaattcttagttagcagttgctctgccaagaataacacttttgtgtgctttctgtatataacagttttggtcagctatactgacagagctgggctaagatattttcctgcctgttaatcaaggccacacagacaaagctcaaggaaggatgatccctgcctcaggaagttttgaatcaactgctatttttaacaagtatacagtagaacttgagatcaggtcttcactcagttggtaggaacctctgtgtgaaaggaaggaatgtgacagtggctgtaagtatttgtattgatttgggtcaagggtgtggtagcatagatgtggggaagtccagtcgtcaaataggttattacattttaaggcaactgatagttcatgggcaccttgagttgtctttagtgtatatggaatcctgtgctgctaatagtaaagttgaaataggctatgtgatgggctgatattattaatcaacgtaggacaggaggagaaagttggctattggtgtgtttccatgctaactggctcttgctgtggacatatataaattttgggggggttttgagatgtaattctgtgtatatatatgctccttgtttcattaagagaaggtttcataaagaattaatttatgcctgggtgcggtacctcatgcctgtaatcccagcacttttggaggccaagggggtggattgcttgaactcaggaagttcaagaccagcctgggcaacatggagaaactccgtctctacgaaaaatacaaaaacttagttgggtgtggtggcatgtacctgtagtcacagctactcaggaggctgagggggaagatcacttgaacccaggaggcagaggttgcagtgagccaagatcaccaccactgcactccagacttagtgac

SEQ ID NO: 399277 - DNA, 757 bp, Homo sapiens
gcgtcagactatcaccaaagtttatttgctggcaaagctggttttcccagaaatttgtatgtaggaatggtttaaataaaagttgatggaattcttagttagcagttgctctgccaagaataacacttttgtgtgctttctgtatataacagttttggtcagctatactgacagagctgggctaagatattttcctgcctgttaatcaaggccacacagacaaagctcaaggaaggatgatccctgcctcaggaagttttgaatcaactgctatttttaacaagtatacagtagaacttgagatcaggtcttcactcagttggtaggaaaagttttccgctgaagcttacatataaggaaacggtttatgggcctgaatgaagcctctgtgtgaaaggaaggaatgtgacagtggctgtaagtatttgtattgatttgggtcaagggtgtggtagcatagatgtggggaagtccagtcgtcaaataggttattacattttaaggcaactgatagttcatgggcaccttgagttgtctttagtgtatatggaatcctgtgctgctaatagtaaagttgaaataggctatgtgatgggctgatattattaatcaacgtaggacaggaggagaaagttggctattggtgtgtttccatgctaactggctcttgctgtggacatatataaattttgggggggttttgagatgtaattctgtgtatatatatgctccttgtttcattaagagaaggtttcat

SEQ ID NO: 399278 - DNA, 279 bp, Homo sapiens
gttccagcccactgctgaacacatatttaaaagctacaatagctctgctcactgccattgcagagtctggaggaaagagtagcaggcttgataggagcaattggctgaataatcttttgcaatgccaataaataatgaaaaagtatataaatataacgctgtatagaaagctctcaagttcagtgtttggttaaaatacatactcagtaaatggtagctattattgtcttagtttaagttattgcaagcattaaaattaaatgtttagctacagactca

SEQ ID NO: 399279 - DNA, 485 bp, Homo sapiens
agaaactaagttcaggtgttttattttttaagttctagatacttctaaattaacgatataaattaatgttttacataaaaagatctaaatgaaaagttttcattatagttgagaaaatgagtacttagagtgtgctctgataatttgacacattgacataaaaccttaaattgaataataaaacaaacggctaaaatattcccccttggaaaaataactttaataataaagctagaaaagttttaactgtgttgaaccatcacttttttctctggaaggcagattatcctaaagagtattattttccagaaattctgtcaaggcactttgaaataatatatgtttgtattatttaatattctgacacttccgttctttgaaaatgctcagactggaatggatacgtagccatgcatatatttaatataaatggtatcttgtcgttaacataaaatattaaagagaaaataaaactttgggctttg

SEQ ID NO: 399280 - DNA, 524 bp, Homo sapiens
acattacttggtctcagatatttctttatagcaacacaaacggactaaaacaacttgaaactgggcaatgtaataaactatcactggcctatatcttggccatatgaaaaatatataaacacttatttttataaactatgttttatcaaacaaaaataatcatcattattatcactgacacatggatctaacataaacattggtaattaaataagaattgcagaaaatgaggtttaaaagcttccttatttttattcttttattaaattcctctgaaaatgatatgcaaaagctattgtattctccatgcttggtatgagaatcaagcagaaagatcttctatatgccatatattgcattgggaaagccaaaaagccagcagctcagggaaatgagagtaggaaaatggtaagagacttgcaattaccctcttttcagtgttgagcacatcatttaaatgagatgcttcactggagagataaaataagctaagactagtcttttattctgtgaatttaactaga

SEQ ID NO: 399281 - DNA, 760 bp, Homo sapiens
  misc_feature (619)..(619): n is a, c, g, or t
  misc_feature (621)..(621): n is a, c, g, or t
  misc_feature (633)..(633): n is a, c, g, or t
gctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggagggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaacatagctgtgatttctgncnagctaacaggtntgcgaacagcttatgatgctgttgatccccgactactccgaaagtgttgccttgggggccggaaacggtgggggcccaccgtcccgatgtgcgggtccccccggggggtcccccgttgtggggtctc

SEQ ID NO: 399282 - DNA, 887 bp, Homo sapiens
  misc_feature (598)..(598): n is a, c, g, or t
  misc_feature (600)..(600): n is a, c, g, or t
  misc_feature (612)..(612): n is a, c, g, or t
gctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaacatagctgtgatttctgncnagctaacaggtntgcgaacagcttaatgatgcttgttgatacaccagactactcaggaaaagtgtgtgcacttggaggcactgaagaacaggctggaggcctagccagtccacagatcgtagcggattcacctctcaggctgtagatcagccaaagtggttgtgaaggtgttactggaattgacgcatgcccatcctgtctaatactacaagtgtccaagtgccgtctacgcgggagactggtccaggcatccggaccgggtcacggccatagcgctgggtggcaca

SEQ ID NO: 399283 - DNA, 419 bp, Homo sapiens
ttcctctgagtactgctttagctatataacatttgttctgctattgagtgatttcattaattgttttccagaaaatctgcaatttcagtttttcttttcctctttcagccatgcattgagtattttttgttttgtttggattttactttcagttaaatgggcttttggttttatgatttagtattaatttccagtttaattgcactgtaatcagagaatattgtattttttctaccttttgggatttattgaggttatctatgttccctaatagatggtcaatatttgtgaatgtttcatagacccttgaaagatatattttcttcatttaatctacagggtttgctatttatcaaccagatctactttattacctatgttaattagagcttccatattgatttttattctttgtctag

SEQ ID NO: 399284 - DNA, 365 bp, Homo sapiens
atccatctcacgttagacttgtttttatattggctttccctcttccctctttctctctcacacaataaaatgcctttgaaatgctgacacataaataatttcctacctaaacatctcagagcctgattccatcaaaaagaaaggagtaaaaagcaagttacagcccagcagcacatctgctttccctgggtccgggggctgccaggagggagcgggaggtctgtccacctcacaaggcaggctctgtcagcttttgtcactccctgatttcttattctttgttaccttttttcgcctgactgatttttacttggcatttaagttccccttagcactgccagattctaaaaggttatattcttttt

SEQ ID NO: 399285 - DNA, 248 bp, Homo sapiens
agcatctaaatgtaggagtgaataaagttaatttctaagttttaatgaagagtgagaagtctgttttaagggaaagcctagctccttttatggcctggaatgaggaatctggcaataaattttactgataattacagacaacgagcattgggatggagctgtccgctccactgggggtatgcagtgtaaagtattggttgagcatgcaaacaaagtcagtctagaaagtgtggacttttatttattta

SEQ ID NO: 399286 - DNA, 460 bp, Homo sapiens
agaaactgtcaaactctcttccacagtacatggtgctatactgtaaatggtattttttttatttcagtttctgattgtttgctgttattatatggaaatacgactggtttttgtatagcatcttcaccttgctaaattcgattgttctagaagcgttttgtagattctattgaattttctacataggtcatattttctatgaatagacagttttactcttttccagtcttgatgcatttttcttgctttattgtgctggcaagaaccttcagtataatgttgaatagaaatggtaagagtggatgtcactgcctcattcctaatttttgagggaaaacattgattctttcacgtctcagtaaagtgtttcctgtaaattttcatagctgtctattatcgatttgaagatgtttacttctattcctggtttctggagagtgtttattaggaatggttgttg

SEQ ID NO: 399287 - DNA, 470 bp, Homo sapiens
gctctggtttccacatttggcatggtttttttttttgatactctagaaggaggggaaaggagtggtttggcctttgttggggactactattgaagggggtaaacttgcagctattccaaaaagatgggttttactctggccatcttgaacttggaagggactatgtccagaataagtgggctcatggaactaactggttctaaagcctcaagatagggggcaatcagatttgaggctgagagaggtaaaccaagattttctttgaagatacgggctttaagaaagcaaaagtggctgagcgtgttggctcacacctgtaatgccaaggcaggaggatcacttgagcctaggatttcgagggcagcctgggcaaccgcgagaccttgtctctgcaaaaaattaaatattagttgggcacggtggcatgtgcctgtagtcccagctacttgggaagctggggttgggaggat

SEQ ID NO: 399288 - DNA, 310 bp, Homo sapiens
acaaagaatatttcccatgaatctgtactctttagcagctaatgaacatctgtttgtttgtataagcaatcaaacaaacaaatggagcccagcgctcagactcaagaactagtttcacatgtaagtaaaatgtaattctctgcttctattgtatcattattatttttattataactttggggtatcagcaccaaacaggtacatataattaaatataaaaaccatgaaatatgtatacaattaatttacatgtaattaaaatgaatatttgtataattaaaaataaattttgcattattcttattagtaa

SEQ ID NO: 399289 - DNA, 473 bp, Homo sapiens
agctaaggtggtcagagagcctctcaggtttgaaccgacagctgagtaacaaataggaagaagtcaaatggttacgtggtgattggaggaatggcattacaggcagagggaagagcaaatgcagaaagcctctacttgagccagcagtcagcctggaggactgttagactgggagactgtcagaagaaactcttaaacttcgtgaagtgctggcctactggacaaaggggagagtgggaggtagtaatgagatcagtgtagcgcctttgcagaacatggtagtgactttgtagtgagctctgcatcatccatacttttacatcccaagaagaggataagcagccattttaaatgaataagatcgaagaaccaggtgctgtggtgtgggcctgtagtcccagctacttaggagactaagtcaggaggatcatttaagcccaggagtttaaggccaacataactagatcctggct

SEQ ID NO: 399290 - DNA, 611 bp, Homo sapiens
gggactcctactaacatagctatgtgtgacaagtagaagtccctgtgtgtatccaaggttactcttacaacctctctctgccaatgcacaactttgcaccaaaatttcatcatgaggactccttttcagagcaccccagaattgagcaagacatgctaaactggcttcttcaccccctcaccccatgtcagcttcccaaccaagaggagtaaggacaaagttgcaaggctgcaagtataatttgtctcggttcctattattcctttcaggattatgatgccagagcagcttcagctgttctgctgtctgattcatggccaataccagttctaacaggtctaacccaaagagtcagccagataggacagggagagcaacggccactgtgagatgtctggaaggcgagcacagctctagaaaaggcattagctacatttccatggggttttgctcctggataaagcaggtcacaagggaaacctagatgtggaatctgcaaaagggcaattactggggctagttatataggaaatacttattgaagctggcaatgtgaaagagtctccattaagtccggcctttttgtatatacagtagaagctttgaagtca

SEQ ID NO: 399291 - DNA, 1347 bp, Homo sapiens
acatttattaggcatctgtagaccatataattgagacagagaaacattttggagaattagaagctcacactatttatggcataggttatataattatgataatttatgatttactttcttgacaaaaacagctacaaccatgtatacctactatttctcctacaaagtaggtgagattttttgattttacattagttagggaggtttttgatttggttttgctttaagataggcattgactatagcttctgattagcaacacacagtattttgtgcttgggtatctgtgagggtgtgtaattctagttgtcagaagctgtgctttttctccttgattttaatactagctgacctcaggcaaagccactcacctctcagccttttaaattgtgaagtgaatggactaaatggcattttaggcaattgttcccatattctaggccaacagtaaatattcagctctcctcaaaggaaaaatataaataatgctgatagaaagctcaaatttgatttttttattatgattatttcagctcttatggtatttaagtgtcttttatgaaatgttgattgtagtagcttggcaaaatagtaaggtggcagcccaatgttgatccctacttttttttttcactgctccatggaatttaaaagtctgggaaccactaagccaacatcctatctaaagttctgagacttattaaggtattaaagtaacagttttattttgagatttagcttgtgttatatggaatttttcattagcacaatgtgttgaggtgagacttcatggaaagttactgtaaaaaacaaaaaaaagtccttacttccattcagtttaccatcatggatccaaactaagggtaaagccaatacatcctaatatgtgcccaacccataactttaaatgattaaatgaaacacacaacagggagatctattgttaatgtgttaaccaaaattgccaggaattgccctaaaggggaaaaattgtttaatcagtaaatcagtgaggaaatacaagattataaattagaagtgttgctatggtgttagctcttacatccctgaacaacaaaaaagacagttcaaccccaagcatggaacagaaaaatgctgagcttagaatgttgtcagctagatattgtgtaaaatagatgttctctttaatacctgtgtctctgtggataatgtatttctagttcttccatcctgtcccttacagataaccagaagtcaattcatgttaatattttgttctttaattgtgacatcgttttcatttgtaaatatgcagcattatgtagattcccagctttttcatttaaaataatttcgagcattgcc

SEQ ID NO: 399292 - DNA, 508 bp, Homo sapiens
ggatataccagaaccagaattctcatagtaattacaacgtttcccaagtttcacatgagggattcaaagttggagctggattgctgtcatcgtaagtgattaagtataagtatctgtgtatactgtgatcttacttcgacagtgtttctacattccagaaagcagtttacttaatgacagcaatttgttctttctgattttctttggttatatacctttagatcttattgtccccttgtgaacaagcatatttatttcccttggataatgcttttattttataaattagccttcatcttgtactcagctaacgtatattaaacatttgtggggtttaagacaccttgtagaatgtagaataaatacatttaggggagtagtgggaagactggaagagcaggttaaacacggaaggtcttcagactagctgaacagcctgggttctgtaaacacaagggaagcatcaaaggttttggagcagatgaatgactaacatgagctaggcttt

SEQ ID NO: 399293 - DNA, 951 bp, Homo sapiens
ttttacagctggtttattcaagtcaagatccaaaaaagatacgcacacatgtttaactagcatatttcttaaatgtctttaaatctatacctagatcagtgccattttttcatgtcatttagctgttgaacgaaccaggtactgtgtcctgcggcatatcctaccttctgggtttgactgattgaatctttgtggatgtccctctgcctctgtctttcctgaactctggtagttgagatcaggactggagatttcttaggcaggaagaatccataggtgggtacttcctatcgcgcctcgaaggagacacaaagtgtccagctgtcccacttttactggtgttaaacttcatccaccagatagtgcacccattataaaattctgtccactaatgatttgtgctgagatccacttctcattaggggctgccaagtagtgcttttctatcattctttctgcacttgttagccgaaggttctctgtcgtgaagatatttcccttgtcaactatttggcttggatggaaaggctggatcaatgtttgattctttatttttcatcttcataataatgagctagctcctcggcaccccgggggaagttgtcttcaaatgctgccttgaagcatagaatatttaattctaatggatatgggagggaaggcccttccaagccgagggaagagcttgagcaaaggctcagaggcaggagaatgcagggtgtttagagaacagcagagctctgtagcacgtgcaacaagaggctttttgagtgaggaccctgagcacgatatggtgggaaagcaggggagaggtcaggattgctggtttgactcccagccatgggcaaaaggttctccccttgtctatacaatgaggacatctctctagatcagtggctttccaacgtttctggccccagttcactttaataaatacattttatactctga

SEQ ID NO: 399294 - DNA, 552 bp, Homo sapiens
tttcatgccagcagtagggtggtattgagggtggttttcctcctttagctgaaccattcccagtgtcacagcagcaaccacagcattcagatgagaaagctgtctctttgacggattcttttaggagcacacttgctgctatcccagaagcccctgacaagtgtgtccccatgtctctcggcttcatgaaccaatcactacagaagggatgggattaagttttccccaggagtaagggggaaagtcacagcacatatgggaacaattaggaaagggtgaagaagaatggatgctgagacaagcaaacacggttccacaccacagaccttaacctgaaaacaagtcctctcctggccctaggcagattcctacacttaatctctcctcctccactgacattctcagctgtgagtatcttcaatgtatcatgttctcctgtaacaccctatgacagctaaaacattctaatgaagtcatattttaggtgttttggagcagtggttctcaaagtttaaaggaaagaatcacctaaagatttattacaatttaggt

SEQ ID NO: 399295 - DNA, 514 bp, Homo sapiens
gtcggacgttagtagaaagatgggagcggagagacgttgggacgccaaaagtggaaggcaacgacacacggcccgtggcgccttcagctagggagaaagagagagaggacgggggctggcgggcgggattagctgccggagggctgagtttccgcaggcctggtaagagttccagctctcgcatccctttgccgtgagtttgaggaggtggttggagcggggaaatgcaccagaggggcggggccttccagttattatattacgtcatgcaaatgaggtggctagacagaccaatccaaaggccccgggaagcgtttcgtccgcaccacgcagcgtaggcattcttcgggcagttctacctatttgcataatgtatgcaaatcatttgaacaaagataggctaggaatgactcgttcatcaaaatatgggcaaccatcgactaagacggacatttaattttataacctataattttcatgaataaatttttatatttgaaattattgggaattt

SEQ ID NO: 399296 - DNA, 310 bp, Homo sapiens
gagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagag

SEQ ID NO: 399297 - DNA, 556 bp, Homo sapiens
aggttgcagtgagatacgatcgtgccagtgcactccagtatgagtgacagagagggagaccctgtctaaacttttttttaaaaagtagaaacagagaacaaaaagcagattagtcatttcaaaattacttttcttgtaaaggtttaagcagaatggacttccttatgtggggtaaaactgaccagtttggggatttgatgatttctcagaaggtcagataaacaatttcgtttaggcgtggttgggtagaaattcaccttgagtaactctgttttggtttggtctactgtgctgaagctcagtgcaaaacaatgggctcctataaattgtatttaacagctgttaacattatcacatttaatcttctcaataactaaattttagactaagtgtgcctgtagtcccagctactcaggaggctgaggagggatgatcacttgagcccaagagtatgaatccagcctgggtaacacaacaagactctgtccctaaataaataaaatttaaagatgagtaaatggactccaaaagtccagataatttgcctattatcaca

SEQ ID NO: 399298 - DNA, 515 bp, Homo sapiens
gggaagccctcctgtacttactttatccctcctcctgtatcagttaggctgccttgtgctgcaagtagcagaaacctgactcagacaataccagccatcccttacatgtgtttactatgtgcaggctctgctctaagtgcttgatgtatgtatgtatatgtgtgtgtgtaaatgtgtgtctatatttaatcctcataataaccatgtgaggttggaactattatctttgttttacagactgaggctagagatgtcaagtgacttgtatgaagtaagatggccagtaagtggcagcaccagattcaaacatgggctgattagctttagaatctgagcggttggcagtgacactgcccttcctctcactaaggaactgcattatctcatagccaagtgggcagtatttccatagctcttattcttttggctctacctttctctgtatgtccactttttttttttcaagtttggattcctcatgactgtcaacatcatctaggatcagcgtactaatt

SEQ ID NO: 399299 - DNA, 470 bp, Homo sapiens
agggattttttttgtcttgattctgaagctcttaaagaaatgctcctttttctccataacttgaggatttcacaattgtattggaattattggtgttaaggagttaggtccatctcttggcagcttgtgaagggtgggcaggcacctgtgaattcttcactggcttcttgtaagaatgactttactggagggtgctgagtttgtgattatctcctctgctgctagaaaactccgtgaaccctggtacatatagcgtgataaatcaagtcctgtttttgctcctaacttgcattatggtgtttgatactatatcttcatttctcccatggtagtaataacactgttggaaagagctctcagttggaagttgaagatccaggttctagttgaggcaccagagtttccttgggcaagttgccatacctttttgggccttggtttcctcatctcaataaaatgagtttctgttc

SEQ ID NO: 399300 - DNA, 390 bp, Homo sapiens
gctgagccgtggggctacttccagttcaatgtgaccagcagaaggcacagtactttacaggtcctgcagaatggagggcgtgtaaccagcctggagcaaggaaagagggcgtcctgcagacaggggtgcctgcgctaggttttgaaggataacaggttggccagagcagacaggaacagaagaaccccttctagactatttgaagacaattctccatgggtcgcttgcatttctgcatgtatagtgaaaagtctttgacagcttttattccagactgtctttttaagagtacttgagtatctcagatgatccagatagtttctccctcctggaaagagagcagatttttcctcctgaccaggataataaaatcatacctctcactttgga

SEQ ID NO: 399301 - DNA, 354 bp, Homo sapiens
catttttctgctctgaaacataaataatttttaaaatatattagcctttgaaatgatgtaggaaagaatgtggaattaaaaccaaagttaaaataatgctagccacactttgggaggccgaggcgggtggatcacggggtcaggagatcaagaccatcctggctaacacagtgaaaccccgtctctactaaaaatacaaaaaattagctgggcatggtggcaggcacctgtagtcccagctattcaggaggttgaggcaggagaattggtgtgaacccgggaggcagagcttgtagtgagccgagatcgcgccactgcactccagcctgggagatggagcaagactccgtctca

SEQ ID NO: 399302 - DNA, 395 bp, Homo sapiens
ctggagtaactgggactacagatgcatgccactgcacccagttaaaggctctttacccttctgaggctcagtttcctcatctgtaaaatggatggatgtcctcatgagttattgaggggctcgaatgaaacatacaggccttagatgcttggaatggcatctagacatggcgggtgttcagaaaatgatggcagtggtggtggagatagcaataacttctctgctgtgtggctcttctcttctattacaaaagatcaggaccttttgtaacaggtcaaggtgaatgctttctggagtagactgttgtgttaatgctctgaattggatataaagtaaaatttgggattccctttattttgtaggcacatgtaagtcaataaattgccttgtaattt

SEQ ID NO: 399303 - DNA, 308 bp, Homo sapiens
ttgcaaaaaccttaaaaggaatcttgaaaggatcaaactgatccacaagtaaattagcttctaccagaacaaagcccaatactctgtaaaggacagcacaatgcagacacctacagtgtaatattgatagtgtccagcattcgcttaaaaattactagacatgcaaagaagcaggaacatgtgtctcataaccaaggaaacaatcaatcaataaaatagaaccagaagagtcagaggtgatagaattcacagagaagtaccttaaaatagctattataaatatgttcagggacttaaaagaagaactc

SEQ ID NO: 399304 - DNA, 471 bp, Homo sapiens
  misc_feature (45)..(45): n is a, c, g, or t
  misc_feature (66)..(66): n is a, c, g, or t
  misc_feature (151)..(151): n is a, c, g, or t
aatgtcccctgggtccacagtgggtccccttttcacccttggcgntaggctgcgcactccctttcnccgcagctttaataactcctggcctggcaccctacgcccaccctgacttctccatcccccagcgcttgtcctgcttcaccctacnccgcctaagactgtaaaggcctcgggatcctcattttaaatacaaggtttaagcccttcgtttcaggatggatttctgcagccactacttcccagctactgtccttcgtcctgcccgggttttcagagcctgatgctgccactggcgacccacaccccctcagctgcttttcagaaccacacgataaaatctgcccctgcccgcccccctccagtccaggcagtcgagctccacctgccctctcctgctgcttcctctcggtgatattttttctacgccaaaacagacgggaaagggaacaaaataaagtgaaatccaat

SEQ ID NO: 399305 - DNA, 482 bp, Homo sapiens
ttaagcagtccgcccaccttaccacccaaattgctgggattacaggtgtgagccacttcacccagcacccagcccctttgtgccattctatttggtaaaagtccctcagtgattccttattgcttttagaatagattccataatttagtatattgttactctccctctccagcagtctgttgccacaccccacacatgcttttccttttgcttcatatgacctttcacccccaccccatatcctgcgattcttgcatatttttgcaaagaacttcgaaacttgctctgaacttcttcaatctggttttaggctcctcacctttttttcctcataacacttgtataaatcaattattagagcactctgttaaaccactgttctgtgattatcaccttacttgtctgcccccaatgttagactgtagcttcttgaaatagtctttcctcgtttgtattgttgcactctttgcttgacttaactc

SEQ ID NO: 399306 - DNA, 286 bp, Homo sapiens
ggaattaattatctcacatggatatcatttcacctgatcttgatgaacaaggaaatgggtgatttacccaggaataaatataaagttctgtatggtttggaaagcacaaatggtcacctaattttgaaacactttaggtaaattcccattcagaaaaacatttatcacttatataactaatgaaatgcttaggggaaagtgttttggctgtcaaagaaccatactttgcttttagagactatgtttgtatttgaatatttcataaaaactatttctaagccaagga

SEQ ID NO: 399307 - DNA, 135 bp, Homo sapiens
aaacaaaaatgcttgaaactttgtgagatttaccaaaatatgccacagtgacacattgttagcatgtgttagctattggaaagatagcattggtagacttgcttaatgtagggttgccacaagggttcagcttgt

SEQ ID NO: 399308 - DNA, 447 bp, Homo sapiens
atttagaaattgttaaatattagcaatttgtttaagcaagggaggaaaaggaaccattagaagaaattcagaggcattaaaagggtcacaaggattgacttatgagatcaaacaaacaaaaaaaaacacacaatgctagatctgttgctggacaaaaccatggtaagccaaagctctaatagtgatatatacagtctggggaaagcaacttcacattttggtgtaattgagggaggaaaatgacccagttctacttgctaataataagtatcattaggtaaaggatatagtaattgaaaggcaactcctcagatttaaatattatttaaagtatctttaagcaagtagataagtatagcaacaatcaaaaatgcttattcaactcaattcctactttcccttcccaaatcttaaaattgataaaaaacaaacacacaaacaaaaaca

SEQ ID NO: 399309 - DNA, 486 bp, Homo sapiens
ggcttgtgggatccaggatctgatcctgggtcaggaaaaaggacatcagttgaaagactggtgaaatccaagtaaagtccaaagctttaattggtgctgtattatttttattagtttcgacaactgcattgtatttccttgtgatgttaacaatgtggaaagctgagtgagatgtgagggagctctctttgtaaatgctgtctaaaattatttcagaataaaaagtttaaaatatatacatacatacataacaaagaaatacaccccaaaagggagccaagaaaaaatggcatttaggatggtcccatagctcacctttcaggtactggatatgcaatacttgctactgtctttcagaaataaactctacaaaatgtcatgtagggtacagaaatgtttacaagaattgttagtaaactgccaatttagagacaaactccatttaagcattttagcaattgcttaataaagttatgtctgattgtt

SEQ ID NO: 399310 - DNA, 608 bp, Homo sapiens
agctctgtgtcactgacagtctgaaaatctccagatgtctatagatgtgttttgggggcgatgtctatgggccacctgagattgtccacacacggttgtggggatgtttgctggaggcaggaagacccatagaaatcctcaaaaatcggaaagggacccacagttcctaagaaggtgtgagaggcctggttgtcgcaaaggcaggctgtgtcccctcacggccctagtgcagggctactttctgctccaaccgaactaaagacttgttccagggcagcagggccccagggcacaggcttttggggccacccctgttcccagctccggccctgcctttgctatctgcagtactcaggccagtgtccccaaaagccccagaggctgtcagggagggaaatggggggatcgtgggggaggtgacttgcccgagggcccccaccaggaggtggtggagctccccattggtctggctctagaccccagctctgaccctagaccccagctctgacctctgggccgcacattgtgtctgaagccaaggaatgacgcaggcagacgcccctgctcgccctcctgctgtgccagctcctctgaccccactgcctctg

SEQ ID NO: 399311 - DNA, 669 bp, Homo sapiens
agtggctggacaaaaaccctggcttttgaatccaaatgccagcatgaatcacaccatagtaaggtgatggaaaattttgcaaagccatctcagagtcagacaagttccttctacaacacgtctttgaaagttttttccttctttcttaagcaaggtaactagagtcatcctctagataagcagagaaaatattacttacaatttagatggcactttatattgaatgtgggccagaaatccttctaacacacacaactcatgcacactcatacccaaactcccacctgttacatgctcggctgcttattaatggaatgggacatttacctgcacaacctaaaatcttatctgggggctgcagacttcatattggaattatcaaacatttccagcttattagcccctgcattcctgaactcaaaggtcctacagagcctgaggaagagccagaagtttaaagagcgcattttttagtatgttttcctgctcttaatgagggagcttaaggtctctttatgctctgaaatcccatgttgttttgacaagggccactctttctttcccttaacaaacactgggaacccaccagtctcctctcagggcacctctgaactctggagagcaaagcaatgctctcctgagcacctctgagagctcacccagatccaa

SEQ ID NO: 399312 - DNA, 150 bp, Homo sapiens
tggcatttccaacccaaagattctcattttataattttatgatttgaatatagatgtttgccttcagttaagaatgagaatcaggtaagaagtaacgggactaagctccctaagaaaaagaggcgaaaataggtttctttacaatcaaca

SEQ ID NO: 399313 - DNA, 443 bp, Homo sapiens
aacaaagttgatcatagtgtctgtctcagggttggcaaactatggcccatgggctgaatttggctgggcacttgtttttgcatgatctgtggattttacactgaaaaaaatggattttgcgttaataaaaaatatatcgtggcatgtgaaaattatgtgaaattaaatgtcagtatcgtaaataaattggaacatagctatatgtgttcgcttgtgtattgtgtgtgtctgttcttgtgctataatggcagaggtgagtagttgtgatagaaactgcgtggcctgcaaagcctaaaatatttgttatctggctttttacttaatagtttgatgatctctgatctataccagtcctactcaaaatgccttgataaagtgacataaggagcttgggccagaatgtaaatcaaggcattacttccttcatcaagaaaagcttacta

SEQ ID NO: 399314 - DNA, 218 bp, Homo sapiens
gggttttatctctttcctcttatcagaaaaatgcaataggtccagaaagcatgataacattttatggtctctgtactagagttgtttttcagcataatgtggccttgacagagagacctgaacttgaaagctgcttcttttcaaccaagaaacagagctgctttatttgtatgtattttatttgttcaatctagaaacataaaggtaaagtgcacatt

SEQ ID NO: 399315 - DNA, 446 bp, Homo sapiens
tgccactttaaatattgggtatgggaagagctgggaggtgggagtttgacagaagaatgaagagaacgtaatgtttcctttgataacttttccttggagttacatgaagaattgggtgacagtaagaaaggatataaacaattcattgtaagctgcaaaatttagttgtatttaaataatttaatatgatttaagagtcactaggatgcagtgggatggtcctattatcgacccttaatttatttttattcactgtagaggatgaatctatccggacctgcttgcagacactggctttaaatgagttcgttcccaaattccatgcatgctaagcgtggatgaaagaagacgtaatgtaacatgattgtacttttcttttagagagtcccatctattaatactttttgtcccatttgtagttgtcatgtttgttctgataaaggatg

SEQ ID NO: 399316 - DNA, 560 bp, Homo sapiens
ggattacagacgcccgccaccatacctggctaagtttttctatttttatttttagtagagacagggttttgccacattggccaggctggtctcagatgatgcgcctgccatggcctcccaaagtcctgggattacaggcgtgagccaccctgccaggccacatatgatatattttatcaatgccttatctacatgttacataggaataatctagcgtcctacctgtgtaaaaaccaactctggaatactgaaactgagctacttaatattctgaaaatcaggacgggtgtggtggcttttttttgcctgtaatccgagcactttgagaagctgaggcaagaagatcgcttgaggccagttcagaacagccccatctgcacgagaaattaaaaaattagctaggcgtgcatgcctgtcccgctactcagaaggctgaggcgagaggaacacttgaactcaggagttcgaggccaacctgggcaacatggcaaaaccccatctctaccaaaaaaaaaaaaatttaattagcgggacatggtggcatgtgcctgtggtcccag

SEQ ID NO: 399317 - DNA, 544 bp, Homo sapiens
ctgtgaggcagaggttgcagtgagccaagatcgcaccactgcactccagcctggtccagagtgagattccgtctcgaacaaaacaaaacaaaaatattgagctaatctaaatggtaaaaatctagatttgaagaaatttattttaaaatagttgttcatttgtcaaatagaaaagtatgatcttagcaggtttggttagatccctatctgaaacaaagtaaactaaagatgtttttcttgatcaatgcatagcaataactgctgttcaaacatgtgaggaatcaccagtaaattgggggatagaaagcaggaaaaggagcttttttctcttattttttttcatttatcagtttttcccatttgtccatcctttcctataatcatggaaatttttattttttacactcctctccccatttttttatcctagattgccaccacaccaaggttttctagagttaggcagaaagagaacctgggcctagatgctaatggaaactatcccatgctttctcagactctctttcctccccagagacaagag

SEQ ID NO: 399318 - DNA, 467 bp, Homo sapiens
ctcagaaaagcacgggactgttttgtgcttcagaggctttggctccaccaagtttcagatacttagcgtaattcttgttctggctgttgcctttgtgtgtgaattagaagattatgatgaggttgctttttgacatttttcctggatataatacccacttgtacttaattcttagtccacagtagggatgatgagtaaaaagatgggacattatttttgggccattaatgtatgactaaaatatcatctttcatgctataaaattttataccctttaaaagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaataaacaa

SEQ ID NO: 399319 - DNA, 465 bp, Homo sapiens
cgcaggaggcttctccctctccctcttccccggagagtcctcctgtgagctgtttctcctgcagcagtgccatgctgccccagagacctgctcccatcctcctctttggtttatcttgattccaagggcatccttcccgagctcgctggtggatgcagggatggtgtgggatagggcggtgctgatcgcccctccctggggttgagtgtggctcggtggtcccaggagcatctcctccaacgaagcgtcttagctggcaccctgtgtgcggggagctggctgggcttccacgtactgggagggcaagagcaggcctccggcagacaaagcaagggagggagtctagctttgaggaacaactaacacggaagagaaggtgtccaaagcgaccctgacagaaccagcaggtggcgctagacgtggcatggtgggtggatgggcagtgcctggaggggtctctctagc

SEQ ID NO: 399320 - DNA, 436 bp, Homo sapiens
aaggactctgaagaacttgccagtaagtgtgataggaagaataatgcccccacacccccatcacccaaagatgcctacatcctaatccaaaagggagtgatgatgtagaagaggaagtcagagatacgatgtgaaaaagactcaatccaatgatgttggcttggaaaatgaagaaagagaaatatgagccaaggggcatgcgtgatttctagaagctagaaaaagcatggaaatggactttcccctagaacctcaagaaaggaacacagtcctactgacaccttaattttaggccagggagacgtctgacaaatttctaacatacagaactgtaagatagtaaatttgtattgttttaagacaccatatttgtgacaatttgttacagcagtaataagaaactaatataggaagaaaacaaaaaagctaattgaaa

SEQ ID NO: 399321 - DNA, 135 bp, Homo sapiens
tcctggggccccactcctttaacgggtcatagcaactcccaagtttgcagcagctctcatggctggaataattcttatgactgctgcacttctcagggtcagagcactcctaggagacccagtgtctctgagatt

SEQ ID NO: 399322 - DNA, 252 bp, Homo sapiens
ttttattctggggtcatttctgcgatatacatattcatgggcctagcttagtgtttcttttctgggggctgggagatggagaccagagtagaattgaatatttctcctttttcttcctggaagaatcgatcttcgaggattaagttggtagttaaaaagccgctttatctttctgaaggccttgcccttttatgtgttgatctgatacccaaatgtagaaaacagttctatacacagcttgaggatatattt

SEQ ID NO: 399323 - DNA, 488 bp, Homo sapiens
caacatatgtgttaattgattgttattggtaaggcttctggtcaacagtaggctattagtagctaaggttttggggaagtcaaaacttagatgtgtattttcatgggggattggagcccctagccccttcagtgttcaagggttaactgtacactctatgatgaacacaacaatgaaatcacgtaacaatgcatttctcagaacatttctcccttgttaagagacacttgactgtgttcagttatatatatacgtgagtagatatacatatatatgtgtgtatacatatttatatgtatgtggagagaaatataatgtatgtttatgtatgtgtatatatatttatgtgtgtatttacttattttgcttttatatgcaaataggatcacacaacacatactgttttgtgatatgctctgtgcctttaaaacaacttgataatatggcaaacaactttccatatcaataaatgtatttcttatccattg

SEQ ID NO: 399324 - DNA, 193 bp, Homo sapiens
gcaggacaatcgcttgaaactgggaggcagaggttgatgagccgaaatcatgctattgcactcaagcccaggagacagagactctgtctccaaaacacaaagcagttcaatggaaacatcactaacatcattttttttttttgagatggagtttcgctcttgttgcccaggctggagtacaatggcgcaatct

SEQ ID NO: 399325 - DNA, 558 bp, Homo sapiens
gaaggaagctgatgtcagcttcacatccagacttgtgtgagtaattagaaacttcagagggagggtaaagaaaatctgcctactagttgacagcccccttctcagcccatatggaccaactcatgaaggggaagaagcagagggcatgaggatccattcccaggttagcctgggctctgcttactgcccccaggcagggctccagcacctgcaggccagggactccacaagggtctttggaagccactattgcaaagcagaaatacttctgtacattatctgctaattgtccatgggcaggctggaggcagcaaagtggcttctggacccctacagataaatttcagcaaagagattttaatcaattgatggatcgatctcactgtctcctgctacttgcatattcccttgcagcctttagcccagcaagaattgtagtaaaccaagatcagcatcatactgaatcaaaaggggtttaagaaactaaatacgctaagtcaaatgttttaatagcttatcttaaaccaatatgtagcagtttgaggtgtgattgaatgc

SEQ ID NO: 399326 - DNA, 794 bp, Homo sapiens
tagtaagccaccatctagacctctttacagacacaaagctgaagatgctcagaatctcaggcacagccccgaaggcagccagctgggtccacttcattccaagccacaaatgcaacacagaatgctctgtgctgcctctgcataaccacccctttcactaaatgcaggaagtcacccccacaaccaacaagctctatacccgcaccccatttcaccctgtgtctagtttgaaagatacatcttgaatttagctattctagaaagagataccaatacaaatgaaccctgaatcactttccaaacacctgcaggtgtttccaggcagttcatgaactgtaacacagtgaatttttctgaagggtggtctgttttgaggggctgcacagcagttttactgattgcggaccagaccacctgagatctacaggttgggatgcatgtgagggaagctgtacaaattccccagaatcgtgactccagcccagaacactgtcactacttgactagagtggtggtaattctggaatcatccgggtgacctgcctaccagcaaaagcttttccttcttaatctactgagtaacctaatacctgaagccagctcagaaaattcccattatctctgaaataaaatgttttcatctgagttctctctctgtatttctttatgctgatattttcatatttcatattcttttcataataatgctgataatttcagtcatcttcaggaggagggtcattcctttcaaaagtctccccttcaggtgagcacgttcccctatttgtattcta

SEQ ID NO: 399327 - DNA, 846 bp, Homo sapiens
ataagttttttcctggttattgctgagtagcatttcattatgtgaatatactacagcatgtttatttgtgcttccagaaatcctcctagtctcaactatctctagccatttggccacttgttctggcctagcaaccacctcaaaaaacaattcagcctgggctctgcccatctgctactccagcaagcagaataatagcacttgccacctggggcatctctgttgccactgaagcatgagatgcaatgagacctagttggttctcgtgtgtgtgtaacctgtcagtgatgtggtattaatgctctatggggaaaaccttggaccatgaggagatgggcctcagaagataaattattctcctttcatccttcagtggtctgtagctcataatgcataaggttggaacataatcgttcatgggggcctttcaaaagattgtacttgatactaattaaaggcctactcagaaatccatgtcctgatacttgttctgtctccctaactcccttttttacccacccctgtgcttcctaataaagtagtatcaggtaaacttttgcctcagttctatttcttggggaaccccaggtaatgcatcctatatgcagacatttaggttagtttttgtcttttttcttttacttacctgaagtgtttctctagagtcttgctagtttttaaagtatgttgaagtatgattttctcctttatcaatcctcaaaatttgtcttacatactgagcatcttctatgtgtcaggcactcttctaagttataggaacacattggttaaacataatattcatgattcctgcttgatgggcagaagttatataggaatgttata

SEQ ID NO: 399328 - DNA, 130 bp, Homo sapiens
cctcccaagcagccggtgttacaggcgagtgccaccacacctgactaacccagtagctcttggacattgacatggtcacaagttttgtagatctttgagatgatacatttgtttttctgagtaacatgaa

SEQ ID NO: 399329 - DNA, 368 bp, Homo sapiens
acttaagtttcagaaaactaatctagacttgtcctctgaagactcaagagtttgagatttccaatttcacaatcaaaattagaatctagtatactgctgtctctgcatttatgttttgattaatctgatagttctgaaagatctttctctgttgattttcttcttttatgccattgtaggcataaaattaaaaatggtttcttagccttggcaatacaaaccttttcagtcaggtgatttgttgtgggggcctgtcttgtgcagtataggatatttagcaccatctttgccctctaccttttagatgccagtagcatgctcctcagttgtgacaagggaaaatgtctccagacattgccaaatatctt

SEQ ID NO: 399330 - DNA, 383 bp, Homo sapiens
tatagtgtagttgagggaaaaacacgtttggatgagcagtgatagttacgtggtaggggactgagtgtgagtaatcggttcagggttgtcgcaagccaacacaaaaaagctcatagaaggaatgaggcctaaaagcttagtgtagggtatggagtgtgcaggctggacctggcttttgcctgcagaaatgtgctacaagcatttcagacaaagggactcagtggtagacctcttctacatatgccacttcagtagtgtggttttagattttatatttagccatttatatttagcctgaggcgttctgagtcagtccaaatccactgtcactaaataaatgggttatgtatcttaataacagaggattagccatccttatatgt

SEQ ID NO: 399331 - DNA, 480 bp, Homo sapiens
cataactcgaaattattcatttgtcgtctctaaaataccttctgtttagcttaccttctcagaatcaccagtgaatttgtgagcattcagacgtcaaaaatacgtgctcaaaagtagtttttaaaaagagacaaaagaggccaggcgcagtggctcacgcctgtaatcccagcactttgggaggccaaggcgggcggatcacgaggtcaggagatcgagaccatcctggctaatgtggtgaaaccccatctctactaaaaaaaaatacaaaaaaattagccgggcgtggtggcaggcgcctgtagtctcagctactcaggaggctgaggcaggagaatggcgtgaagccaggaggtggagcttgcagtgagccaagatcacgccactgcactccagcctgtgcgacagagcgagactccatctcggggggaaacaaaagatgaaagaactgaagtaaataaaagtcatatttttaatatg

SEQ ID NO: 399332 - DNA, 363 bp, Homo sapiens
agctattcagttaactttcaaacaggtatccaagaacttcagtgaagtattccagaagttagtacctggtggcaaagctactttggtgatgaagaaaggagatgtggagggcagtcagtctcaagatgaaggagaagggagtggtgagagtgagaggggttctagctcacaaagcagtgtcccatcagttgagcagtttactggagttggaattagggtgtcatttacaggggtagcccttgctctgatttttgccattcagaaatgtgacccggctccattttacttgtttgatgagattgaccaggctctggatgctcagcacagaaaggctgtgtcagatatgattatggaacttgctgt

SEQ ID NO: 399333 - DNA, 458 bp, Homo sapiens
gagctataaggttcttttccagtttttaaagtaattttgctggtttgtgaaatttataattcctgaaacctatggattagaagactgacccttagagataaactatcctgtgctgtctcttgggaggacagattcagcagaaagttactggctcttctcagtttttccttttcccttctctctcatcagcaacaagagtaggaaataagctccattactgtcttttcctggtgtgtttgctgttaacttgcaggttaccttgggccacaattatctttctgaggaagttctcaatggcatgctcatgttggctaaagtgggatattcatgggtttcaaattaagaaataatatgtctattaagtccaacaactatttctagtcacctgacactatttaaatcaactgtgataaatgatgtaatagtgtgcattttgagtaaaactcagtgattaatga

SEQ ID NO: 399334 - DNA, 524 bp, Homo sapiens
taacatgggctcagcaacccctttcatgttctcaaattgtgatgccttcaggtgtggaacttcccaggggttaagggttaccaggtggtttttgaaagcagccactgctgtggaggtaacagcaagctcaggatacaagatctcttaggcttaggcgccagataaaggttttctgcttttggaggactcttgttcccatggctggcatccactgagaagagccagtgggtaacagaatagttaatacagtggttcaaatatttaattactatctgttttatcttataccatttggccttatattgggctgtacaaactcttagaagtgcccctttgcccagctgccctcaagggcccatcaggaggaaaataactggctaattccagctctggtcatataggctatcttctgtggacatggaagggtgacatggaagagccccatttgaagattgggggtacacttggagctagagagccacccatcatatggaggagaagtggtcactctatcacttacaata

SEQ ID NO: 399335 - DNA, 254 bp, Homo sapiens
cctaggggcagggggctggggtcagttctcagtgtggggaggtggctagtggcccaggtcagcggccagagattagaaagctacacagacagggtgcagagggacgggtgcatggacttggcatccgagagaaggggaaggggctgaaatgatggtcttattgctgctgctactgactctgtgtaggtgtctacaggtagctctaagttaacctgtcaaaactgaactctcaattctcccctaaaacctactca

SEQ ID NO: 399336 - DNA, 540 bp, Homo sapiens
ggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgaca

SEQ ID NO: 399337 - DNA, 632 bp, Homo sapiens
ccatttaatatgtatcgtatatttgcatgcattatgtaatcctcacaaagtgtagatgtcttcattttacaaatgagaaaactaaggcaaagtttcagatggtatagacagaaccaggattcaaagccaggtcttttctctacagcatcctacccaggcaaggccccaggtccgtagagttgctgaccacagaggaggaggaagttgggccacagctctcaggtctatgagagggcgttgtcactgaagtggaggaaaccaggattctctgcttcctagagagacactgagattgttcctttaaaccacatatgatttttaaaataagatatgtagagcagaaaccaatcaactagcattggctttggtcagaattatttttatgataaagtagagcatatttttaaatttttaattatctaagtaatattcaaaaacacatttgcacagtaaaagcattaagaatgtattaggttgatgcaaaagtaattgtgttttttgccattacttttttttttttttttttttttgagacagtcttatctctgtcacccagtctggagtgcagtggcatgatctcggctcactccaacttctgtctcccaggttcaagtgattctcatgcctcagcc

SEQ ID NO: 399338 - DNA, 200 bp, Homo sapiens
tgccactgcagatacttggggctgcaacgagataagggatgcagcttgagaatgcatttgagaatgaaattaagtagtcaagcatttcatatgggttttattgccatttaagggcattattcattcaatggagatgttgttaattgttttgaattcacatcaacatctccctaaaaaaatgcagagatttaaaaaatcta

SEQ ID NO: 399339 - DNA, 340 bp, Homo sapiens
gtgataatgacatcttatcaagatggatgtccctggtttcccagtgctggaatatagaaaatggatggacaagtaaatcccactcagcacccatagtccaggcatggggacctcaacacacctgagccccagacatcacctttcattctggacctaccatgaaagacttctgaatccaggaagagaaactgactgggcaacatgttattcaggtacaaaaagacttggactgtaactcaaaaatgatcaaataatagtgcatgcatcaagtgcaatcggaagctcttctggagagggagagaagcttccagttaaggtgacattgaagccaagtcctgta

SEQ ID NO: 399340 - DNA, 576 bp, Homo sapiens
ccatgttggccgggccagtctcaaactcctgacgtcaagtgatcttcccgcctcgactcctgatatcaagtgatcttcccgcctcggctcccagagtgctgagattacagacgtgaacccatgcctggccaggaattttgttttttaggaaggctttctactaatggaattcctggccttgagaggatgttactttagagggaaaggatttttttgttattaaaagagccacctaagctgaagattcccttgagaacaagtactgtccctggtttcccagtgctggaatatagaaaatggatggacaagtaaatcccactcagcacccatagtccaggcatggggacctcaacacacctgagccccagacatcacctttcattctggacctaccatgaaagacttctgaatccaggaagagaaactgactgggcaacatgttattcaggtacaaaaagacttggactgtaactcaaaaatgatcaaataatagtgcatgcatcaagtgcaatcggaagctcttctggagagggagagaagcttccagttaaggtgacattgaagccaagtcctgta

SEQ ID NO: 399341 - DNA, 693 bp, Homo sapiens
catccccaaacagtgtcctcagggatgaatgagtaggagagagggacaggctttccaggcaagaaggagcctgagcaggaaataggaggagctggaaggagtgatggaggtgaaagagaaaaacgcgtgtctcaggaagtgaaagcaggccagtctggttggtgctatggtgcaggggaagagcactgagaggagcagaagagcagccaaagccagtctgctgtgggtgaagcttcagctgcccatctgagtggcgatgctgatcctggtcagcagggatggaagagcagggactgttcacaagtgtgagggtgcaggtcccacggttgccttagacatgatcaaaaccactgtcacccgaaactggccttctggagaagatgctaggcaagggtggtgatgataggaagagacagtcaagcaccacatacagatgctgtgtaagaaaaggaggatattttggggtagtgtggggcagagtgcctgggtgaagtggggaactgggctcagatggagaggacaggcaggggagacacagagcctccacctaagctgaagggccacgccccagctcagttgtcagactcaggcgacccatctgggtgagctgggtcataaagtcccatcaggagacaagatgctctgtcaaattcaggctcattactaacaatttagaaagtgcaagaactatat

SEQ ID NO: 399342 - DNA, 848 bp, Homo sapiens
gacagggtctcactttgtcacccagcctggagtctagtagtgtgatgatagctcactgcagcctagacctgtccaggctcaagcagtcctcccacctcagccccatggagtagatgggattacaggaacctgaactctcagcaagaatgaacgtatagaaccatctcaaatttagcggctaaggactaggtccttggccagaacctactgaaggctctcaaaataggaggtccatagacacagagtcccatataacattacatcagaccaaggtcatgggattagccaatcaatcacatactgtaacccagaaactgtctgcctgtaagaataatgaaatagtctcctgcaggtacagatgaagaccagtctggtgataataatgtaaagaatggggcaccatactatattcgaaactaattatcattgtatggtgtgaattctccaatatatttaatgcatgggtccaagaaccagataaacataggagttatttcacttgtcattatatctcgtaacccattggaggaatctgtgtgcactatccctgtaactctgagatttgtgagtttagagaacctgtttctcagaataagaatgctactattaggggacaaagaaagagtcccattaaactttaatctatgactgtcatccagttactttgagctccacttgccaacagaccagtgatgaagaaaggaatcaccattctggcaagagtcatcgactctgatcatcaggaggtgatagagctgtattgctcagaggagtcaaggaaatatatgtgttttacttagtgatctgctgagtcatttgttccaacaataaaaggatgagtgcagcaa

SEQ ID NO: 399343 - DNA, 496 bp, Homo sapiens
gtaaatatgtgaaaggaggcccctctgagtgcttcacaggatgtgggcaacacttattttgccgtcctgtgtatattgccgtgctttccacccatgcttgcccaagcttaagtgatgggaacaatgagagatacaatattcttggcaatatggccatactccaggttttgttcattcagacgtgacctcaagaacatgtcatgcctcagctccaccagtaaggatatatgtggtaactgttgtagataacagagcccccagtgatagaatctggcgtaaatcagcttctatttcactaagagcaggaaaacacaatctgtaactcatacacaggaacgtcctactctggatttatgatggggttcatcaaccctgcatgttttgaagattttttacatttgtaaacagtaactaacctgaattatttcaatgatactctcgtcacttgttctttctctgcccctctttcttaaatgacagttaaagttcttcctta

SEQ ID NO: 399344 - DNA, 307 bp, Homo sapiens
gaggttgtggtgagccaagatcatgctattgcactccagcctgggcaacaagagtgaatttctgcctcaaaaaaaaaaatagacttttatcttctttggttttcagtggtttgactgccatgtgccctaaatgtgctttcattgtatttattccaatagtgctttttcattctgtggattgatgtctttcattgattttagaaaactcttggcctgaatctattaagataatgcttcttcctcaattcctactctcctattctcctgggactccaattagatggtagtcagccttttccactattat

SEQ ID NO: 399345 - DNA, 871 bp, Homo sapiens
tgttctctgactataaaagggtgtcaccttgtcaccatcttctatcacacaggacccctatgggcttggtttggttttgttctttcatcattattatttggaaagttatatttcctttactgtccttgaggtgtgaggcttcacctcatcttgtctccatatccctgagtcactaaggagtcctatgtcaatgacacctctccatatgctttacctaagctgccccttctctcagcaagttcgcgccaggcttccccatgaaggccacctaagggtgtctatcgtccccctcctaaatctccccaggacttttgaacaagggccatgtccagtttaatgtcacacaaagaagactcatcaaagcccaggagttgggagttcttgctcctcactgccatggaaagcatgaaacatctgagataaaaataatctgtgccatcccctggctccggatggacagcagttggggcatgagcgcctccagaatgtctcagcattgctgagggtaaccggatcgccgctcagatccagcaggcagcctcagaacctcccagctgctgttgtttttagcaccgggattattggtaggggtgtaaatagacatctgtgttctgggtggctcgctcaccccacattcctaggcacacttgttttattaaagctctcagctgtcgggtgatccaggcgtggagaaatgaaaggccgccctcaccagctggtggtggactgcaaactgcaaccagttttcccccataaggacatgttactcctattagaaactgtgtccctcacatgtccttaagaagcgggccatctgccaatcataaatcgagatctcagccgttccaaataaagaaagagtctaccctcc

SEQ ID NO: 399346 - DNA, 400 bp, Homo sapiens
ttcttataaaatacacttaaaaaagaatccagtcctagtgacgaatctggaaataagactaggaaacacttcaccatgtgccaggcactgtttgcagcactttacatatattagctcatttacttctgacaacagccccattttgtagcagaggaaaccaaggctggcttctctagtctggctgctcctcccaatcaccatgagcagccaaggtcattacaggaagtggcagaactgtgatttgaacccaagctgccatggcttcaggatctgtgctttttaggactccttcattgccccttgaactctctcacaacaacgacgaacataaatttgctttagaaacttcttttgccttccacattacctcagtcttaaagtcagcatcagagtttggttg

SEQ ID NO: 399347 - DNA, 354 bp, Homo sapiens
agaatctaaaagacttgagctttgaaaatcactcaggagatttcacatgaagagatttcactttgcagtgttttctttccttaaatggaaaactccctgagaaagaaggaagattaaatctggaaaccatgttataatgaccttagaatgtatcagtagacacagagcatattaaaaaatgggaaaatgacttgaaatgctttatagtgatctcatagtgtgaattccatgttaacctcaagtgaaacaaccttgtaacatgatttattcagaagaatgcacatgaaatgactgtgtagagattaccaaggaataaatcacttgttcagaatcaggaatcagtttatactctct

SEQ ID NO: 399348 - DNA, 427 bp, Homo sapiens
aggcgaaaatcccattagtaatcacttgttggtcttgtctcattacaaaaataataaatgtggatgtattggtttttctcatacattttacactcatgcttgcatttgataaatatttatcttgaatgcctgctatgtgcctgacatgttttagatgctggaaatacagcagtgaacaaacataaaacttcctgacctcgtgaaatttgtatttaaaggggaaattataaaaataaataagtaggccgggcacagtggctcacgcctgtaatcccagcagtttgggagggcaaggcagatggatcacctgagattaggagttcaagaccagcctggccaatatggtgaaaccccgtctctactaaaaatacaaaaattagctgggcatggtggcgtgtgcctgtagtcccagctactcgggaggctg

SEQ ID NO: 399349 - DNA, 347 bp, Homo sapiens
agagtacctatatcaggtttttctgccagagaaacctctccaacactacattacatattgatatctcacatgtctttggattcagtttttctaagctgggttgctggatggctctggtgatatgagatgggccaagttctgcatcttggaattagttagagtttggacaatgtaggctggatcaggcagggacaaactgactccattattttctcattctccttctgggaacagagtagtagccaggcaatgttctcataataaacagaaaaggaaaagaaactcaagtgtggaaaccatctcaaacctctgtgtgaagtctaccaattttctgttaatcaaagcaa

SEQ ID NO: 399350 - DNA, 667 bp, Homo sapiens
aactacattgaagttgttactttgtacaatataaaaacaatgaaatactagcttacttttaaagaataaccctaaaagacaaagaataactacagtacaaatgtcattcagaaatattacaagaaaatgcaatattaatatacctaagaaaatcacttaatcaactaaaatttattaaacattaaaagcaaggggctaagaagcccagaacaccaacaagggagtagattatggtattcaaattattcttgtagcagttctcaaagtgtggtctccaagaccctctcaaggagtctgggaggtcaacactattttcataatgctaaatcgttttttgccttttagactcttattctcttcacaagtatccaggggagttttccaggggctatatgatgtgtgacaggaaagctgactgaatgcagaagcagatatgagaaggaaaggacactataaggctcgtaaacagagaagcctgggcaacatagtaagaccctgtccccacacaaaaataaaacattagccgagtgtggtggcacacgcctgtagtctcagctactcgtgaggctgaggctggaggatcacttgagcccaggagtttgaggttgcagtaagccataactgtgcctctgcactgcagcatgggtgacagaacaaaaccctgtct

SEQ ID NO: 399351 - DNA, 531 bp, Homo sapiens
  misc_feature (378)..(378): n is a, c, g, or t
  misc_feature (491)..(491): n is a, c, g, or t
tgtctagaggtccctgcatttactccatggcctttctgtcaccgggctgggacacgaggaggaattgcaggtgaaatcagatccagtttcaacttgaggaaaattcagccccgggagctgctggtagagcccagaccttgatgctgagtcatctgcacagagaattccgtgacagaaaggccgtgggtagagacgtgaatggaggaagtggagtagatgaaatggttaaatgttggagaaaagaggctatttatgaatatgaccactgtcattcagataaaatttctggactgttatcattgaaaaaagtctcattatgtttctatttgaaagcaaaccattatgcttttttgaggaaaaaaaaaaacggtgagtcangttatgctggcaagtgtttaattcagaccatttcatctttaagaaggccccgggtcacattatacggatgattggcttattaaagggaactccggtttctggcaccaggtggnggggtcaatatgagaagcctaattaacagaataaaaagct

SEQ ID NO: 399352 - DNA, 292 bp, Homo sapiens
acctggcaccttaatcttggacttaccagcgtccacaactgtgagaaataagtgtttcttgtttataaaccattcagtttatgatatttttataatagctcaagcagattaagacatcgtgtaaatatatgccttattatttcaaaggttagctgatgaccttggtggagaaaattttctctggatttagtctcaggcttacatattactttctgtccttaaattagttgccactaatatagtagttgttgtcactattaaataactatgtatgcaacaaatagatcagagc

SEQ ID NO: 399353 - DNA, 503 bp, Homo sapiens
aaaaaaataataaattaatttaaaagcagttttctttaataatgttcttgatgaagcaataaaaatgattaatttcattaaatcctgatccttgagtacacagttttaaaatattgtttgaaataggatgtatgcacaaagcactttggcataatgaagtactatgattaccttaaggaaaagcacttgtgtgattgttagagtagcgagctgaagtaggcagcttttttcatggaacattctttttacttgaaaaatcgctgacagactatcagtttacactttgacagttggcattttcttgaaaatgtgagcttgttacttcaatacaactgagagtgtttgttatcagtgattttaaaaaagaggtttggccggacgtggtgactcacacctgtaatccgaacactttgggattactttcggaggctgaggcgggaggattgtttgagcctgggagttccacaccagcctgggctacatagggagacccccatctctac

SEQ ID NO: 399354 - DNA, 555 bp, Homo sapiens
ttgcttgagcttgggcatttgagaccagcctgggcaacatggtgagaccccgtctccacaaaaaaatacacaaattggctgggtgtggtgctgtgtgcctatagttccagctactggggaggctgaggctggagaattgcttgagtctgggaggcagagattgcggtgagctgtgatagagccactgcattgaggtctccattattgtaaaattgtttcttccttcaattttattagtttgctttgtgcattttggagccctttttttttttggttcatatgtgtttataattgttacatcttcttgtgatttgactctcttacgaacataaaatgtttttctgtaacagtttttggcttaaaatctattttgtgtggtattattagtatagccaccctggctctcttttggttactatttgcatggattatctctttccatcttttcagtttcaacaaatttgtgtctttgggtctacagtgagtattttgtgagttgcatatttggattatgtattacattattaaaaaaattgattctgccgatctttccat

SEQ ID NO: 399355 - DNA, 2211 bp, Homo sapiens
cagaattctcaattaaaaaaaactttgttttacaaactatatccaatgtataagtattttaaaatataaatacatttcaatattttatttaaactttaaacaagcctatacatattataagttaatttaggaatgttttgtaacttttacgataagagtaaaatgttagcatgtaatttcaactgtcaagctgaaaataaatatatgaataacctgcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatcttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaaatacagaggtatatacttcggttttttaagctactgataacgagacatttaaatcaagctatggaaaggctttgtctaaagggtgatattattactaaaggctcacacagaaatctttgcatgctacacacaaaggaaacatttacacttctagtccacaaaagcctatcctaggattgtgccaggggcacacaaggatttcaaagtacagaaaaaactgggcatacacatgccctacaaagcagccaaaagacattccccagtctctctcaggaaatgtttcaagatgaaaagcaaaagtctgaagtcccttggaatcttgggttgatttcttcattattctcaaggctaggttgttttcccccagcatactttgttgggcaaaaataaaacgtttccaaataaaagcaactcctcagccccaattttcaatgcaatatgcttattaaaagttcaacatttctcaaggtctagacttatagtgtgatcatattacagtactcgggaagagcattttctttgttgttgaccctgctagggaaacaggtcttgactcagccaaagtggcgttcttgtgggtgattaatgacaggcctagatctcgccctagtgacatccatcccccaccccccacccccactatactaaaatcagccgtgtctgaactgaaggaggggctgtagcctcgcctcaaaccacccagtcccagagttaatagctgcaaccaatcgattacggcaagcacacatccagattggggtgaaatgtgaccctttcgcctaaatttacgaataatatcgtcctctctgatcatttccgctggggctccagcgactacggaaacaattccaatcattcggcccaaagaaaaagatgtccctgttctacccaatacgggcaaggcaaagcccctacccacctccaaacactatccccttgacatcagcccatttctattgtgtcttattaggtcctcgggctacgaggacctagtgaaaaacgtggctgccctactactttgctaagaacaagaaccacacagtccggcacccccaccccaggggccgcatcccacaccccaggacccctgttcccagttctctccactaccccg

SEQ ID NO: 399356 - DNA, 226 bp, Homo sapiens
tgggactacaggtgcacaccactgtactcggatatcttaaaattgtttgtatagacaaggtctcattatattggccaagctagtctcaaacacctggggactcaagtaatcctcccacctcggcctcccaaagtgctaggattacaggcatgagccaccgtgcccggccagttgtgtgtgttctgactgtgtcatccaccatccattcccaactcactcctcctca

SEQ ID NO: 399357 - DNA, 309 bp, Homo sapiens
tgcctcagcctcccaaagtgctgggattacaggcgtgagccaccacacctggctgcaggtctgcttttaagacaaagcaaacatataaaagaaagatacggccaaaagacagtggagagcataatccctatcccagatccttcagtattcacagcattcatatttctcagaaaaaaaatgcagctttctaaatgaccaactcttttgatgagctactccttcttaaatatgcaacaggcaacatctcaaggttaaactatgaattcctaccaaaaaaggaaaaaaaactctttaaaaattttgattact

SEQ ID NO: 399358 - DNA, 424 bp, Homo sapiens
ttaaaatggccctcataatagttgaagatgttagaaagtataaaaatcatatactttttttgtctctatgtgtgtctatactgagtaaaccaatgacatagagatggaatccaatgtatacagactggagtattagaaaactgactctcaaaaactggctcccattgttgcaatagggcacaattatttttgtcttgatatataggctcaaaacttggaagtaattttttagtagagttttgcctgtggaggttttggtttgtatatttgactttttaaatgtttaaaacatttaaaaacacacaagacagcgctgttttgatcacaaaagagtatgctatcttttgccatatgtatgatctttcttttcctgtgagatcattactagtcaagctctagtttaagtgaaaaatgtggagatgct

SEQ ID NO: 399359 - DNA, 460 bp, Homo sapiens
cagagcaatcctctctcacattttgaacccatgttcctgttcatacaaatctcgggcaccgcaagctccgcaatgccaaaactaaactcattttcctcccaaccctgcaccttctcacctgcggtcttgatggctgaatggcaccaatgtccaccctaggcaggagtctgggagtcgtccttaactctggcctctccccgacctcacatccagcaaatgaccacctgtcagttcaacctcccaagcaccataagcacctgtccctcctttccatcttcactaccactgccttaattcaaggcccatcatgtctccagcttcaatgctccaacctattaaccattctcctgcctccaaatttgttcccctcaacccccaatccattccattcctactgcttaattcatatctgctagcaacacacggaccaaatgtatgggtgcattcccaccttgtaatg

SEQ ID NO: 399360 - DNA, 540 bp, Homo sapiens
cagagcaatcctctctcacattttgaacccatgttcctgttcatacaaatctcgggcaccgcaagctccgcaatgccaaaactaaactcattttcctcccaaccctgcaccttctcacctgcggtcttgatggctgaatggcaccaatgtccaccctaggcaggagtctgggagtcgtccttaactctggcctctccccgacctcacatccagcaaatgaccacctgtcagttcaacctcccaagcaccataagcacctgtccctcctttccatcttcactaccactgccttaattcaaggcccatcatgtctccagcttcaatgctccaacctattaaccattctcctgcctccaaatttgttcccctcaacccccaatccattccattcctactgcttaaagggtcacctttctaaaattcaaatcctaccttgagaatcaccagcattaatatcttccagaagctcaaaagattatgatcacaatcctgaacatcgaagaaacagacttcagtgatctgccttgcacaactaaattc

SEQ ID NO: 399361 - DNA, 587 bp, Homo sapiens
agaaatgcaaatctggatatggcattgagtctttctctaacaaaacgaaagggttgcagatatttgtgaagaagaagtgatatggttggctgtgtcctcacccaagtctcatcttgaattacagctcccataatctccatgtgttgtgggaaggacctggggggaggtattcagagaacgactaccttcagattatcacagatatacagagttgtccatggaaacggcaagcagaagaatatgcaaattttaggagaagaaaaataaagtcaaatgagaaatcctgcatctgaaatactcatgctgctactgacagaaagatttcaaagagaaattggattgagaagataaaagcatcttggacaggatgtgtttgagctgactttaagacaactggatacagaagaccttttgcttggtctggggaaaatataaatgctaagagaaaatgaattctctcaaaaaagtctatcttctcagcaattttattttaactttcttgttgtgctacgagggggtttgtcctctttttatagattcctaagcttttactcattcagcacttaattgtgggtctgagaacttgg

SEQ ID NO: 399362 - DNA, 480 bp, Homo sapiens
atgttctaagtgactaaatgcaggactgaaatcagatggattatcctggggtttcacaaaccagtagcttactgttggaggacctcagaggggctaagtgatttgtctgcacttgacaccaaagaggatggcttgttagcgcttttcttactcccgcaaggcaaggtttggcagagctctgtaaagtcgggagtcaggaatgttaggggttttctctgaagccctgtccatactccgggtaagtcgtttctttgctagggctgggatggcagcaaaatagcaaaacccataccaaatactaaattcagagaaatcatttgggaaggctggatctcaagcactacaacctgcaaaacgtagaaccccaagagatgaagcacagtgttaaagaaagaacaggggaagtttccaaaaagttcaaagaacaaactgaaagcagagaaaaaggagaagagccgtgagagtgagcaataggctctt

SEQ ID NO: 399363 - DNA, 240 bp, Homo sapiens
gccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattcc

SEQ ID NO: 399364 - DNA, 511 bp, Homo sapiens
gttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtt

SEQ ID NO: 399365 - DNA, 147 bp, Homo sapiens
agacaagggacagcagtcacttttcatacattgacatgatctccttggagggcaatttggaaatattcattaaaattcaaatgcacatagcctttgacctacaaagaaatttaacctgcagacattactgacacatttgcaaggata

SEQ ID NO: 399366 - DNA, 426 bp, Homo sapiens
cccccaccaccctctgctcagtacatggggcagtcctctccccaagcctcagtttcctcatttgttcagtgggaatcatgacggcctcacaaggctgttgtgagaatgaaataagagaagtgttaatgcctttagaacactgctaggcagatacgggctcagaagaagttggaattcctaaccgttcacagggcagggccacctggctggggggcgcctttgtcactgtgcgttgtgtgactacagacatttaggaagcacaaacttctgcccggagcagcccatgctgggcagtcggggcctggctctcaggggtggtggcccagcacacagctgttcaacttgatcataactgtccttgacacagccctgacctgttggttatcagcttccctgtgatataattcacatagcacaaaaatcaaa

SEQ ID NO: 399367 - DNA, 480 bp, Homo sapiens
attttggatgggcgtggtgactcatgcctgtaatcctagcactttgggaggccaaggtgagagatcacttgaggccaggagtttgaaaccaccctgggcaacacagtcaggccccagtctctacaaaaaatttaaaaagttagtggggcatggtggtacattcctgtagtcccagctactcaggagactgagataggaggatggattgagctcaagtgttctaacttatagtgagctctgatcacaccactgcgctccagcccaggcaagagggagagaccctatctcaaacagcgacaacaacaaaaccaaacaaacaaaaaagcacattctatcagctttgatttatgttttcttcatttgtaatgacatgtagttaaatgtgtcatacttcaaaaagaagaaacagatagtaggtggattttcaatataatatatattagatatagataatatatattttcaatatataatatatgt

SEQ ID NO: 399368 - DNA, 730 bp, Homo sapiens
gatcccccgggctgcaggattcggcacgaggcctgcagcccagccacttgggagtctgtggtgggaggattgcttgagctcaggaggtggatgctacagtgagccatgatcatgccactgcacaccagcctggtcgacagagcaagacactcaaaaaacagaaaaggatatttcaaaggaggaaggaagagccttctcaataaatagtgccgggaaaactgaatatccacatgcaaaacaatacagtggcactcataccatagacaaaatgatctcaaactggaccaaagactttaatagctaaaactataaaattcttagaagaaaacaggagtacatctcttcagctttgtattaggcaatggtgtcttagatattacactaaaagcacacttaacacacacacacaattagataaattggaccttatcaaaattaaaaacttttgtgcttcaaaagatatcatcaagaaagtgaaaagaggccgggcatggtagctcatgcctgtaatcccagcatttggggaggcatcagtttgagctcaggatttcaagaccagcctgagcatcatggcgagaccccatctctacaaaaattaccctatgtgggggctcacgcctgtggtctcagctactcaggaggctgaggctggagaatcacttgaagccaggaggcggcagggctgcagtgagccaagatcaagccagtgaactccagcctgagtgacaga

SEQ ID NO: 399369 - DNA, 296 bp, Homo sapiens
caaagagctgggagtgagtgtccatgaccatcctgccttaggatctgcttttcaaaatgattatttctcatttgattactgatggcacaacacttgcctagggggatctgggcctgagcacaaaaccacagttacaattcaagttagcccagcagctgaaacttcccacaaaggagaaggaccccttccaagagccgctttgacatcgtgtgggcaacacccagagggtgttcgccgtgaagagagatgcccacacagggaacccacacactcaattgtttccactccctggacgg

SEQ ID NO: 399370 - DNA, 370 bp, Homo sapiens
tctctctcatttaaaataccttcttagtaggtttaaattaacataaaaaatcaaattcagcatttaaataaggtcaatgggactgctggatttaaacacagaatttgattcagtataattggatcaccgtattggttttgacttggaaggattaaatggaggaaattggaaaagcgtgaatttgggcagaaagagaaattttctcttctttttctttctttcttctttcaccttccaagggagagaagtttccccaccttggagaggaaactactaccctgattaggtcagaaacatctcagattcattaattgtctccgttttatcactacttgaataagaaatagtaataaaacaaaaatattgtgta

SEQ ID NO: 399371 - DNA, 166 bp, Homo sapiens
gaaataatttttaacacatttattaatggagaataatcaatattttgtgattaaatatatatgtattaatcagatatgtgttcttgcacattctttaaagttaagcgaatatgagtaacttgaagaagttagaaacaaaccaaataaaactaatagtaaaatgtta

SEQ ID NO: 399372 - DNA, 403 bp, Homo sapiens
cagtgtggcctgggtcttcaggaatgcttgtttgaggaaaaccactgtcatgtaagaagtatggctaccctgagactgtcatggtgtgaggactcctaaatgagtcacatgtggatggccacctattcaggcctcagttcttccagccattgcgactgtggcccacgcatgtgggggaagaggccatttttcacgcccatcccagttgagtctttagatgatcccttcctgggcctccagctgactgtaaccagactccaggcaggaaccacataggaactgaacccagtcaacccacaggctggggaggatgatagtccattgttgtataaagccactgcatttggaatggtctgttgtatactacctaatcagaacaagactcaatcctttcttcatagct

SEQ ID NO: 399373 - DNA, 490 bp, Homo sapiens
ctgtatgaatatatgaagtactgaaatagaataaaaacatacaaagtagtataaacacacttttatttctgtaccacattattgatattgtattgatacattgttatatttttgaagaatcacaataaactctagattggagaaatactcactcatagactcaggccctggaaactaggagagtccagtgcaatcgtttttgttatgactcgttctcttttatttttctcctttctttttaaatcttctttgtctttctatctgacagaagaataaaatttagcaaaataattattcactaaagaaatatctaaatgaatattggttacataccaaagatcgaataattgcattctataatagggaagtctgttgtctttgtggttggttggtcttgtgttatacagttcatgaatacataaataaaattcgtgtgtcttttgcaaattactcttttattgtgttccttggaaataaatcactataacta

SEQ ID NO: 399374 - DNA, 550 bp, Homo sapiens
  misc_feature (6)..(6): n is a, c, g, or t
  misc_feature (18)..(18): n is a, c, g, or t
  misc_feature (42)..(42): n is a, c, g, or t
  misc_feature (66)..(66): n is a, c, g, or t
caaggntggttcagcatncccaaatgattaccatatccatcncccaaccagacccaatgccaaaanccccatgattatttacctgtatacctttttaagtacaaataaatctgggctgtcattatttatgctaacactggttttgtgtccctggaatctatctatctaagtttttttttctttttttctttttccattttccagtacctattagacagaatggctttcaattttttctcttacttccaaacttagtcattataagaagatgtaggccaggcgcagtggctcattactgtaatcccagcactatgggaggctgaggcaagtggattacttgagtccaggagttcgagaccagcctggccaacatggtgaaaccccatctctactaaaaatacagagattagcagggcatggtggtgcatgcctgtaatcccagctactcaggaggttgagtcaggagaatcacttgaacccggaggcagaggttgcaggcagattgtgccactgcactcctgcctgggaaacagagcaagactctgtctcc

SEQ ID NO: 399375 - DNA, 189 bp, Homo sapiens
ggctcccaatcccggagagtggccatactgaagtcacattacaacaattaacttttcaactattagatgattaatttttaccaagtagcaagaacagctgtttggcacgtagcagtgtggcatgagtatcttgtaaatgaattaaacaaaatatctctccaacacacacacagtcattcttgctgcatg

SEQ ID NO: 399376 - DNA, 647 bp, Homo sapiens
cttgtacacctaactgtaagtagaaaattattttttaatcttttcaggctcatactgtgactttggaggttttcgtttgtattggttaacagtgtaaaaaggcaccagagtaaagtcaaaaagattactagtaagaccttttccaagttgcttctctttgaactaaagttttcttatgtgctcataacaaggatgatactttagttaataataaagtttcatactggttcattaattgggacaaatgtaccatactaatgtaagatgttatttacagtggaaactgggcatggggtacataggaactgttatgggtccagttgtgacccatctacccatccaaatcatatatgggaagtcctaacccctagtacctcagaatgtaacctcatttgaagttaagggtctttagtgaggtatacgatgcttataaaaaggggaaatttggaacctgatatgcggagacacagggaagccaaggagaggggcctggaacagatccttctgtcatggctctctagaagaaccaatcctgccgacaccttgattttgaatttctagcctccagagctgtgagacaatagaactgctgttgttgaagcctccatttgtggtactttattatagcagccctagcaaatataaac

SEQ ID NO: 399377 - DNA, 624 bp, Homo sapiens
catgggtattaacttacagacttacttgttaaacttgtgaacttgttagaaattcaaatgactgggctccaacacagaccccaggaactctgggggtggggccaagccatctatgtttaacaatccctctagatggctctgaaataccctaaagtttgagaaccactggtttaacctgaatttaataaggaaacagtgagacaaatccagactttcatatatattctactgacctgaactcttcaaaaaagtcaagttcacaaagaacaaaaaaagcagagccaggaagaaatggtggaaggaaactttagattaaactaaaaagacataacaacctaatacaatgagtagattttaattggatcctgaattaaaaagaaaattaaaactaagagaattttcaaggcaactgagaaaactgaaatacggactttatattagatcacagtgtgcatttatcattacctatcttagatgtaataatgtattttgattataaaacagaatatccttacttttaagtgatgcatgctgaagtactaaggaataaaatgtcttaatatctacaacttagcaactttctttcaaatgattcaggaaaaataaaacaaatgagcaaaaatt

SEQ ID NO: 399378 - DNA, 393 bp, Homo sapiens
aaaatccctgttctttattgtcttttattgagagagttttcttcctgtttcaggctaagtaatatagacataagattttctattttcagtaacaatgattggctttcaagacaaaggacagatagttgatatccacagatatccctaaactcactttgtctccattctcttgcttttcctacaatcgatcctgttactcaaaacataatacaaaacataaatactcccactacttgaatgtctcttgaacgctttgggaaaacattttctgaatttgtgtctcaccagaagcagaccctgatttaaagattcaagtgcaagcaatgtattttggaaataatttcaggaagcacagtaggacatgggaagtgaggcagggaagggaaggaaagc

SEQ ID NO: 399379 - DNA, 364 bp, Homo sapiens
ttgatcccaaagagccaataaagtgagaaaattaagatttgtgagaatcagtattacagtaatacttctcttacttgcattgctagttatttatcaaacagctccagctatgtagaagacagatgagaaccaaaagaaggaaagaaggatttctaaacagccaaataaactgtcccttgcccaagcattaaatctcaggtactttacttaaaagactcaacttaaaaatttagaccttggccgggtgtggtggctcacgcctataatcccagcactttgggaagctgaggcgggtggatcacgaggtcaggagatcaagatcatcctggctaacttggtgaaacctcgtctccactaaaaatcc

SEQ ID NO: 399380 - DNA, 2214 bp, Homo sapiens
  misc_feature (876)..(876): n is a, c, g, or t
attcttatgtattcattaaactaggaccctgtaggatttattttaggtgttattgccttgacctagagttaatctgtatttttgaaggaaaatacgttgccttttttcacaagcactttataactcacttctccctaattcagattgcttttcttaatcatttgaagttaatgatacaattatcacatagtagccttacaaatagccataatattaaatcataatttatgtaaagtaaacatccaaattccaaaacatctgaacatgggaacaggctgattgaagtttttgtgggtcataagaccttggcaattgtttgtgagcctgatgccgacatttctcaacagtaatcaaagcacagaacaacaaccatccacatgaaaaataactcaaattgtcattgtacttcccatgctattgtcatttagcaagttatggcatgactgattcagccagtaagaaaaatgtgatgagaatattggctaggagtacagtctgcttagatcttttagttttttttccttcaaaagccaatagacttttactctttaaaataggagctatgcaaaaacgtaatatttggaatgccaagctgcctccatgattgagatacctgttttgaagttctcctctactgtaaattctaacagaataaaaaaagaatcaatgattcttgttacctccaatgtacctaccacactactcatgaaaaaagctttaaaaattaatgaaaattgatggactgaagttctgtctgtttcttctggtgcagatttataaaatggattctattttaggaacgatcaaattctaaaattgagaagctcaagggtagggcactggagataatatagaaagacatgtaatatataaacnattctctagatcttatatctggagttaagtaaagcagacaacaaagagggagacagcttggttgtcaggatggtggcttggacatgtgttaatatgtatcccatctcatcatgatgctatcagaagcacgggtctttaaccatctcctttttctgaattttaatatgtgaatgagtcattaaatattggcttccagttagtttctgcttgatatgtacaatcatgacagtagcatagtggtttgcacattaaaggtcaacaaatgtttgttggttgaatatacctttcctagatttagcaaaatttcaaaccataaaagtcccttatgtgcttttatattttaaatcaagtctttcatgttataaactttaaaactcaggctcatcgaagtgaagtgatttgcccaagcataccttcccacacaaggcttaacaccgactcccactttagtacaataaaaaaaaaaaagtcatgtaacattaagagcacatacctggaagtcccctaaaacataggttgttgaactctgactctgccacttcctcgctattgatgtgtgctatggtctggatatttgattcctccaaatctcatgttgaaattcgatccccaattggagatggggcttaatgggaggtgtttgagtcttgggaccagatacttcatgaatagattagtgtcctccctggcagagggagagtgagtgagttcttgctctattcattcctgggggagctcccttgagagctgattgttgaaaagagcctggcaccttcctgctctctcttgcttctgctctcgccatgggatctctgcacgccggctccctttaaccttctcccctccaccaggagtggaagcatcatgaggcctctccaaaacccaagcaaatgtcagtgccatgcgtcccgtgcaggctgcagaaccgagagccaaataaccctcttttctgtatagattacccagcctcaggtattcctttatagcaacacattgacttagacaaggtatgtagatatatacttctaaagtggcttctcccacaaaagagaaatttgcggcccagcacagtggctcacacctgtaatcctagcactttgggaggccgaggtgggtggatcaggaggtcaggagatctagaccatcctggccaacatggtgaaaccccgtctctactaaaatacaaaaaattagctgggcgtgctggcacgtgcctgtagtcccagctactcgggaggctgaggcaggggaatcacttgaacctgggagacagaggttgcagtgagctgagatcacgccacttgcactccagcctggcaacagagcaagactccgtct

SEQ ID NO: 399381 - DNA, 380 bp, Homo sapiens
gagacagaatctcactttgtcacccagactggaatgcaacagcaccaccatagtatgatcacagcttgaactcttcagctcaaatgatcctcccacctcagcctcccaagagctgggactacatgcatataccacaacacccagctaatttgaaaaaaactttttttagagatgagggtcttgctatgtttcccaggctggtctcgaactcctggcctcaagcgattctcccacctcagccaccccaagtgctgggattaaaggtgtgagccaccatgcctggctgccttgggctttaagtatgtccaggtgttggtgtaatttggattcttaactctttcttcttttatgcaaagcttcctattgaaaaacatctaaat

SEQ ID NO: 399382 - DNA, 365 bp, Homo sapiens
caagagggtttagagagaatttattgccctatatcttactgcctgtgccactttttttctagcacaacaacataatgtggttcttaaacaaaaaaataactaaataaattatcaagtgttatatttatgtgctcagaacatttctttaaaatgtggattttcaaatagccatttttgcttgtcattgatagtaacaagtttgactcttgcagaaatgttcattttcattaagtgactgcacatatcaatttctacctctcaaatgggtattttttagtttagataaaaagatgaatataatgtataatttttgatgtctttgttaacaactgtattttgattcaaaaattgtatccattgaaatg

SEQ ID NO: 399383 - DNA, 215 bp, Homo sapiens
gaagaagcacctaactcaaagtttaacaccgcagcatccctcagccatttcctaatcttagttccctgggccagctgtatatctggcccttgctcttccctccacgtgttgagacatggactaatttccatttatatagaaaactcccctgttccttctccctttcacccacatttttcttctattcttccatttgaataaagccccctgatatg

SEQ ID NO: 399384 - DNA, 184 bp, Homo sapiens
aagaatttcatggattctgattgactaagaccttctcttgcttggctcctctccatttgtcccctgccaatttctgtcccctatgaaagcttgcctccctatttgagaactccttcaaaccttggttggtctgtcccacctggctcccacctcctgcagcctcttcctgatgaagccagaattc

SEQ ID NO: 399385 - DNA, 271 bp, Homo sapiens
aaccctccaggattgcctagaaaagtgagagaatgataaatttaaacaaacagaatgttaacccacctaagtgaaactattagaggaaacagcttcaacaacaacaaaaaatgggcacttaagaaaattcaagtacagcataaaaatacttttctgagcttaaaactcagttgatgaagtgggggatagtcactgtggagacttaaattattcaactggagacttcaattattagactggaaaaataagataaatctccaaaacatagagc

SEQ ID NO: 399386 - DNA, 439 bp, Homo sapiens
ttcccggtccacttggcaggattgccgtctaaagtggtgagcccttggagtcggtgaaccctttggtcggtgaacatttggtcggtggcatttcatccggaaaggctggatcggttctgtcggacttagagggaaatgttttccttcctgggctctgtaggtgaaagatgagagtgtggtttaggtgaggatcaagctcctttttaatgacacgccactgcttccaccgcgggagaatttcagtgcttagatttaactttgggaggttatcagttcagaaaaagtaaaaaagagagagctgaattacggttgcgacatacaggtatgtatgtcacatacatgcaatttttatttgctggacaagtgaaagagaaaaggctacttcccaagcgttcttgccagtcattgaatatttcgtattaaatcttgacatactact

SEQ ID NO: 399387 - DNA, 459 bp, Homo sapiens
taaattaattcacttttgcatttttttctctgatcttgtcatcatacactattttaattaatatagtcctgacatacatggagattgaggaaatcatcaaaatcttaatgtaaaaaaatgtaaatgcctaaaagctaacgatgacacaattcaggaaggtgctgatgacaatagcacatactcaactgaacactttgacattatgtttcttctttgctggtgaagactgaaattaagaaaaacagcaaagagagaacctgagaaaaaatgtatacgatttcattatttctacttttacatgacctatgaagtatattattgttttccatgggggatatcagagctatctacatgctgatattctctactttcctttggatctcttaatgtagattgtcctaattgttatatagtatcagaaataaactgtaaaaaataacctgtatatataagaagcag

SEQ ID NO: 399388 - DNA, 410 bp, Homo sapiens
tacctgtttgtttgtttgtttgtttatttatttatttattgagacagggtcttgctgtatcacccaggctggagtgcagtagcatgagcatggctcactgcagcctcaactttcccaggcacaggtgatcctcctgcctgcacctcctgagtagctgggactacaggtgcacaccaccacgttcagctaattttctgcagagatgaggtcttgccatgttgcccaggctggtcttgaactcttggactcaagagatctgcagcctcccaaagtgctgggattacaggcgtgagacaccacacctggcctcccattgcctgtttaaatagaaatgatgcaactagcaatatggaaggacttccagatctttaccacattaagattagggtcagcatccatggctctgggag

SEQ ID NO: 399389 - DNA, 316 bp, Homo sapiens
aagaactcagaaataagtctttgtacttagagccaactcattttcaacaaaggcactaagaacacatactgggggggaaaagagtctccttaataaatggtgctgggaaaactgtatatctgtttgcagaaaaataaaaccggatccccatctttcatcatatacaagtatcaactcaaaatgaattcaagacttaaatgtaagacctaaaactatgaatctgctagaacaaaacactgaagaaatgctacaggacattggtttgggcaaagattttttagggtaggaccgcaaaagaataggaagtcaaagcaaa

SEQ ID NO: 399390 - DNA, 971 bp, Homo sapiens
aaaatgtgatcagaggaccctaaccttgtatttgccttaggacccagtgggtcggtactgactaattcagtgttcacggctgcctcaaatcaggagaatggattataatctggcttcataggaccccgggagggaagggagggaaggcagggccgtgagcacagagctgtccgaggtgctaccaccgtaagcctggctcagctttcggggccacatctgcttccgtaagtctccactctgcttgagggtggggaaaacctgcagccctgactggcaagacggtagggagaagggacagagaggagtctggagacgacgaggctctgtgctggactagcagctcccggggcttgtgacccaggggatttcttgctcggcagcccctgggaaagggtgaagggagaaggggtttgcttgtgggagaaagagtcagcagtgacttcacaggccagctgtgcctcgtgtgtttattcacagccagttgctgcaccgtgaggccaaaggatactggaaggtttgggatccactgacgtcatccaagcaggccacactgccgtgctcggtgtcagtgtttctgacatgcagggcagcagagcagagggtctccagcagcccacattgcagcagttctcatcaccctgggatagctgaattcccttcccgtggtaaatcttcaagttacagcaaacaatttactagtagcacgagttacaacagaggagactccacatttgaaagcaagagctattaaaatggcagatgaggccggaagtgaagccgatcatgaaggaacacatagcaccaaagagaggcctgctaaaatctcgccctgtcagaggtatccaacttctcctttggggaaagccttccctggtccccttagacttaagttcaaagtatttctgcacagtggttccccatggccccttgcatttcccttcttagtctctgttacaccgtcattgaaactc

SEQ ID NO: 399391 - DNA, 613 bp, Homo sapiens
agagatgactttagagaagcggcattacgtcctgaaaagaaaagtgctaagagagaagcagaagtactaaagaaaatgggaaaacaggagaaggaggttagagaggaggggactaggcattagttttgagtatttaaggtacttgtttagaatttgaaatggagatattaagcaggcagatggaaacctaggcttggattttgtactggagctgggcttgtagacacagataagcgatcagttagaagtagtgatcaaaactgttgaactacatgaacttgtcaggctagagcagagaagtccaaagacagtcattgagaccagcatcagttaatggatgggggaagaaaaaatgtgagtccaagagataaaagatgaggaagaaaaaaatcagcttactaaaagatgaatgtgatgccagggggtggggagaggggagatgggaatcactactaatgggtatgtggtttctttttgaagtgataaaaaatattctggggctgggcgcagtggctcatgcctgtaatcccagcactttgggaggccgagggggatggatcatgaggtcaggagattgagaccatcctggccaacatggtgaaaccccatctcc

SEQ ID NO: 399392 - DNA, 359 bp, Homo sapiens
ctctagcctggcgacagagcgagacaccatctcaaaaaaaataaataaataaagaggggggtcactatgtcacccaggctggagtgcagtgactcttcataggcgcaatcatagcacactacagcctccaattcctgagcccaagtgatcctcctgtctcagcctcccaagtagctgggactacagatgtgtgccaccttgcctggctcaacttttattttgaagagtttcaaacccacaagaaaaactgtgagattttgcacttgctttttgctttctctccctgctgcttgcattgactgccttcaggtgccactgcctctgcctccatgtgtccctagctgtcctttgggctgttc

SEQ ID NO: 399393 - DNA, 412 bp, Homo sapiens
atcactagaatactgtaccctcaatggagaattttgaagaaaatgcttgctcattagggccctaaattgggaagagacaaccagactgtagtacccctactgtaatatatctttggctgcaggctttctggaaagaacatagcatttaggttatgagatatatccattttatactctgatagtcaccttgcttgtgtgacattttatcctataagtctataaaccgtatgtttgattatcattaaataatcatgtacattcttctgaaaccattccacagataacagctatcaaatgctattttatcatgaggtccagttatgatattttatatggagattagatcatttgcatgccttcttttattcccaggagagtcacatttctttttcactaaataaggaggggaaga

SEQ ID NO: 399394 - DNA, 379 bp, Homo sapiens
agattcagtaagccattctcaggaactataataaatgcttcttccaacttcactttttcaaaaatgtgttttgctgtggtatttataaatgtggaaattgtgctgaatctctttagaaataaaaattctttgagttattgttacaaatgttaactttaatgctgtggatttaggagagatgcaggaagtatagatcgggaatcagaacactcaaattctagtcaaaacttacactggggcagcctcctaatttatctctgtttattttctcatttatgtgttgaggcaaatggcctttgtaacttattgttttcaccctcctgattctttgattcctgtggatcatctgtgcttgaaaattactaattattatctgatg

SEQ ID NO: 399395 - DNA, 201 bp, Homo sapiens
tggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgtctgcaccaggccctgcccaggccatgtc

SEQ ID NO: 399396 - DNA, 632 bp, Homo sapiens
caaaggtgagagtttgattaaaagaaaggagaccttggccgggcacggtggctcacgcctgtaatcccaacactttgggaggctgaggtgggtggatcacctgaggtcaggagttcgagaccagcctggccaacatggtgaaaccccatctctactaaaaatacaaaaaaattagctgggcgtggtggtggatgcctgtaatcccagctacttgggaggctgaggctggagaatcccttgaacttgggaggcggaggtttcagtgagccaagatcatgccattgcactgcagcctgggcaacaagagcaaaactgtctcaaataaataaataataaaagaaaggagaccggatttattagatgtggtccgttttgtctttctgttcccaaacttaaactggattatacctgctaatatcaggaatataatgataattgcattcattcaacaaaaatttattgagcatatactgtgtgccaggtactgtcctaggcattatggatataaaacagtttttatgtagagacagtcctatatttcctgtgatcttaaggaacatttgtctagtattagagataggactaattaaacaaaaacaagacaagaataattaaacagcaaactcaatgaa

SEQ ID NO: 399397 - DNA, 684 bp, Homo sapiens
ccctgccggagaatttagtatttctagcctctagagtggagatgaacaaagaatagaatgggcatttgcttaggaaccaactgtgccttacaacatttttgcacttttttctgtaacattttgtgttaaatcatataaaaatgctgatcctaacaaatatggtcaatgagtcacaccataattctccaagaactccagtccaaaagggttaatcttgcttttaaactccaggcgcggtgtttcacagctgtaatcccagctacttgggaggctgaggctggagaatcccttgaacttgggaggcggaggtttcagtgagccaagatcatgccattgcactgcagcctgggcaacaagagcaaaactgtctcaaataaataaataataaaagaaaggagaccggatttattagatgtggtccgttttgtctttctgttcccaaacttaaactggattatacctgctaatatcaggaatataatgataattgcattcattcaacaaaaatttattgagcatatactgtgtgccaggtactgtcctaggcattatggatataaaacagtttttatgtagagacagtcctatatttcctgtgatcttaaggaacatttgtctagtattagagataggactaattaaacaaaaacaagacaagaataattaaacagcaaactcaatgaa

SEQ ID NO: 399398 - DNA, 482 bp, Homo sapiens
caaccctcaatggaaccaccagctcccagtggacagagtactcagcctccctgttagttgtgacaacttaagacaaaaatgagagcagtaatacaatgctcaattcactcatcactagctacgtactttctcctttggtgtcttgtctccttaagggacaggaagcaccatccctgttttggtgggggtgcgggtggggttgtatgtttcagacaggtcaggtctcactaggttggccaggctggccttggaactcctgtgctcaatctttgcacctcagcctctgtagtagctgagactacgacacagtccgccacgctcgactaatttttgtatttttagtagagacggggtttcaccgtgttagccaggatggtctcgatctcctgaccttgtgatccgcccgcctcggccccccaaagtgctgggattacaggcgtgagccaccatgccccgccaacaggaggatttttttagtccgt

SEQ ID NO: 399399 - DNA, 454 bp, Homo sapiens
aacaggattaggaggcttaaagaatggtttcataagccacattttggaggttggtgtgcttgtgtgtgtggaagtattttagaaacgaaagttgatatttaagttgattgggtcacccttgagcttgcttggtgggaagaggtgggcaggatgtggctattctaagtggccaggggacacctctttcttattcacccccaggacattatttccaattttccttgaagaggaaataccatttaccatcagtaaatggttttgggacttcattctttggggactcaacacatctggagatgccaaattctggagctgtctcagtggcaggtgtcccagggactcctggatgatgttgtaattgggattcatgtgcagtcagaataggccccacaaatgaagaggatgccaacgtgtgtgtgtgtgtgtgtgtgtgagtgtttgttttacaaactta

SEQ ID NO: 399400 - DNA, 404 bp, Homo sapiens
aaaatgctacatatttatgtagtatataatttcatgtgggtctagttgtcaaaataaccttttttgcttaggaaaattatctaatatattaaagtatatgctttttgagaacccatatcattttcttcatttacaaagcaattctcacatcattcatatgtatgagaaataataatgagaaataataattgtacctatttgtggtttacaatgtgatgtttccatacatgtatacaatgtgtgataatgaaatcatggtaattagcacatccgtcacctcaaacatttatcattgcttttcactggacacattcaaaatcctccctactagctatttgaaaatatacaataaattgtttgctaaagtcacccaacagtgttacagaacagtagaatttagaaca

SEQ ID NO: 399401 - DNA, 513 bp, Homo sapiens
ggctacatactatatgactccaactataaggcattcgagaaaaggtgaaactatgaagacattaaaaaactaccatgggttagggtaaagggagggataaataggcagagaacaggatttttagggaagagaaactgttctgtgtgatgaaacaatgatggaaacatgttaatatacatttgtcaaaatgaatagaatgtacaaaactaagagtgactcctaatacaaactataaactgtatgtaaaaataatgtgccaacattgatttcttgattgtgataaatttactatggtggtatagcatgttgatagtcatgtaggttgtgtatctgtggggacaaggtgcatatgggaaccctctgtactcaattttgctgtgaacctgaaagcgcttcaagaaaataaaatttattaattaaaattcatttcacttttccccctgaatgatatatgtttacatgtattaacatgttttactcaaaatatatatatacataatatgtaccattatt

SEQ ID NO: 399402 - DNA, 407 bp, Homo sapiens
agccatctgaaaggcaggaagagagcccttaccagaaaccgagctctgctggaccttgtccttggactttccagcctccagaacagtgagaaaatcaaattctgttatttaagccatatagtctctggtatttttttttaatggcagcctgagaagactaatacagttgactttaagtaagagaggttatcctcagtaatctttgggctcaattcaatcagttcaaagatcttaagagcagaactgaggcttccctaaggaagagaaaatttttcctacagacggcaactctgaaggagaattctatcctgtccttcctaacagcctgccctatgagttttggatgtgcctacccagctaccacaattacataggccaactctctgaaataaatctcttaataggta

SEQ ID NO: 399403 - DNA, 523 bp, Homo sapiens
tgaaagatcctttttaggaagagagaaactaacacattttcataggctgggactttaatgaaaatacagagacctgtgttatacaatcagaaagagacccaaatatgcagttagtgattctatagtaacagaaacctgatcagtagtatcctgtggccagggtaaactgaaggatgactgcaaaggagaacaagagcacctttttggatgatggacccttgctatattttgtttgtagtcatagttatatgagtatatacatttatcaaaaccactggatggtatttttaatgttggtgcattttattgtatgtaaattatatctcaatgaagttgatttttaaaaaaattttaaacatcaacacaagaaactaacacaactaacagcctaacacagagaatgaacagaaatctacatcaaagtaagtcattataatatttttagactatcagctacaaagaagatcctatttttaaaaaagaagaagaaaaacaagaaaaaaagattacaggcaaaagatcc

SEQ ID NO: 399404 - DNA, 523 bp, Homo sapiens
cagtggtctagtaattgcactgttttcaacggtgaccagagctgtcaagactaacactcaaggaggccgttcttctggacctctctggaacaacggggagaggacagggcctgagaagagagtcggagcacagacgggatattctgccagcgctgccccaactgtaacgtgcatatggtcacctggggatcctgtgcaaatgcaggctctgatggggagggatggaactggaactcaatggaaaagaacccagttgggacatgacccactgtgtggacagagagcctttgcagggaggtaaagggaggttcaaccgcaggggcctgtgatggggcagtgggcagatgcctggtttcaagagaaatttctccttaaatgactggttcagaatcataaaaatacttgagagttatttttaagagtttgaggtagtctgtatttcctttattactttgctgctccatttggtatgctatttatttagaaattgttcagctcctgtttataaattttaggtattccg

SEQ ID NO: 399405 - DNA, 458 bp, Homo sapiens
ggggtttgattgatgatctgggtgttgatttctcctcctgccctttcctcttccagtcctcaggtgacacccacccaagcccatctccacattcttcatctacttgcacaatcttgactgacatctctgatagcccaaagcaaattgaatagtgaagtttatcttgctttaatgcttatgctagtggaacttatttaaatgtatttaacatgtacagaaaaattaacaggaaaataaatcgaggaagaagtgtcaacaaagagtgcaaggtacagaaacaggtgctatttttgtatttggtgatgagacctgggggtaagtgatggttgttgagctgatgatgatcgtattttctttaataccacggaccacctcttcatccagcctcactagctgtgaagcagctctgaggaccattcttacagttctttccacatctctgtctccactccccagac

SEQ ID NO: 399406 - DNA, 404 bp, Homo sapiens
ggggtttgattgatgatctgggtgttgatttctcctcctgccctttcctcttccagtcctcaggtgacacccacccaagcccatctccacattcttcatctacttgcacaatcttgactgacatctctgatagcccaaagcaaattgaatagtgaagtttatcttgctttaatgcttatgctagtggaacttatttaaatgtatttaacatgtacagaaaaattaacaggaaaataatgtatttggtgatgagacctgggggtaagtgatggttgttgagctgatgatgatcgtattttctttaataccacggaccacctcttcatccagcctcactagctgtgaagcagctctgaggaccattcttacagttctttccacatctctgtctccactccccagac

SEQ ID NO: 399407 - DNA, 543 bp, Homo sapiens
gctgcacagaaagaaaattctggaaatatgctgagaaccactcttgagtatttagcagagtactgattggcatctgtgtgcatgaagaaactacaagaggccagagaaagaaccattttgaaggatgagtaggatcaatacttggcatttgtaaagggctgagatcagtgctggttctcaccagctaaactagaaaacttcacaattcatggggcattaagtagtatgctcagaaaaatcttgcttcagtagtaaaacataattacccctaaatgctgccctcccatctaaaaaaatttaaaagcaaaacttgaagagatcagcaaaacttgaaaagatcagttccatgatacatttcaatatttacagaaatgcaaaaatatctggccccaataaagtaaaattcaccatgtctggcatttagtcaaatattaccaggcataaaaagaagtagaacaatatgactgacaatgggagaaaaaaataaccaatcaaaacgaacccataactgacacaaatgttagaagtggcagaaaagaacat

SEQ ID NO: 399408 - DNA, 645 bp, Homo sapiens
aataggcatacaagggacataccttaatgtaataaaagccatctatgacaaacccacagccgacataatactgaatggcaaaaagctgaaagcattccctctgagaactggaacaagacaaggatgcccactctcaccactcctcttcaacatagtactggaagtcctagccagagtaatatggcaagagaaagaaaggcatcgaaactggtaaagaggaagtcaaacggtcactatttgcagatgatgattgtttacctcaaaaaccctaaggactcctcctgaaggttcctagaactgataaaagaatcagcaaagcttccagatacaagattactgtacacaaatcagtagttcttctatacaccaacagtgaccaagtggagaaccaaatcaagaactcaaccccttttacaatagctgcaaaaaaaacaaaaacaaaaacaaaaaaatcttaggaatatactgaaccaaggagtcaaaagacctacttgtagttttttaaggaatctccatgttgttttccatagtggttttattagtttacactcccaccagtagcgtaaaagtgttcccttttcaccacatccatgccgacatcaatttaattatggccattcttgtaggagtaaggtggtatctcac

SEQ ID NO: 399409 - DNA, 667 bp, Homo sapiens
ttctacagctcttcatccccttcccagccctaatgcacagccttccttccccagcacctgggggtacgaacgtctggctgttcagccccacaggttcaccattcacttcttgcccacagacagacccaaaccttagcctaacagcatccccgccccccgaatggctctgtgagatcacgcagcattgatggttctgctgcaaaaacaaaacactgatgaagccgccatgctcaaaaggccacatgaggctgagcacggtggctcacgcctgtaatcccagtactttgggaggccgaggcaagtggatcacctgagttcaggagttcgagaccagcctggccaacatgatgaaaccccatctcgactaagaatacaaaaattagccgggtgtgctgggcacagtggctcacacctgtaatcccagcattttgggaggttgaggcaggcagatcacaaggtcaggagtttgagaccagcctgaccaacatggtgaaacgctgtctctactaaaaatacaaaaattagccgggcgtggtggtatgtgcctgtaatcccagctattcaggagggtgaggcaggagaatcgcttgaaccttggaggcggaggtcacagtgagccaagatcatgccactgcactccagcctaggcaacagagtgagactctgt

SEQ ID NO: 399410 - DNA, 374 bp, Homo sapiens
agccccaggaaattaccacctacgcccagaaatctccttctcagagtcctgtcttttagagcagcgcccaatctcttaggttgtctgtcgatggtcactgattactttttgacctactcattttatcctggagaatcaaagattcacagcagctacaagtgctccttgctaataaggtatcaatagcttggattcaaaagatgacttctgagtctagggaatggcattttgggatggaaggccatgtaacactaatctttaaactcaatatcccaagaataaatatggtttattaaccatatgtctaaatttccttcatgcttctgatctgcaaagaccagtgataaatatgcagcaatgagaaataaatgaag

SEQ ID NO: 399411 - DNA, 551 bp, Homo sapiens
gaggctggggagggtggagaagggcgattgtgtttgcttccttgctcaaaatggcatgtcgctggaagccttccagctcctaatggtggaggcatagcaaggactgcatttaccgacttatttccctcttttttttcacgtattctttcttcccctcacattttcaggactgaaaattagaaacacttttctcctacacacaaaattactccctcacacacactttattttccccctgctttgaagtgacagttgctgcaagaaaaggtttctctcagaagagcacaggctgtcctggccagaacgaaggggttaatttaaaatacagccagctaggtagtcctaggggcatgctttcccttggggttgggggtggtatctgaaaggttggagggggtgctcctggggctctgctaatattttatttcttcatctgggtgtgagatgtacagatgtgttcactttgtgaaaatccagtgggctggatacaggatatgtggtcttttttttttttttgtctttaataaagttttaaaaatgtaaaaagctac

SEQ ID NO: 399412 - DNA, 322 bp, Homo sapiens
ccactttactacttactgctgcttgttgatcctagtttgagacgacagagcaagtctgatccctttcaaatgtgacagccttcaagatagctattaatttcccatcaattccaagcccaagtcttctacatattaagtatccccatattcttacctcttattcatgtagcatgcttttgagatccttaaagattttgtagatcgactgggtgtggtggctcacgcctgtaatcccagcacttcgggaggctgaggcaggcggatcacaggtcaggagatcgagaccatcctggctaacacggtgaaaccccgtctgtactaa

SEQ ID NO: 399413 - DNA, 118 bp, Homo sapiens
ttcttttttggtaactagttggttttttagaatcataacttgctttggttatgtgttggaagcaacgaagcatattcctctcatcttaatcatttttgtgtaaatgtcatgtaaaaaa

SEQ ID NO: 399414 - DNA, 444 bp, Homo sapiens
tgttgcctagcctgaagtgcagtggtgtgatcagggctcactgcagccttaaactcctgggcccaagtaatcttcccgcctcaccctcccaagcagattacaggcatgtaccagcaagcctggctaattctgtttatttatttagttatttattttgttgagatggtatcttgctgtgttgcccaggctggtgttgaactcctgggttcaagcaatccccccgccttggcctcccaaggctggaattataggcatgaaccaccacagctggtcaaaaatggttatctcattaaagttttaatttgcattctttagggatggaatgaatattgtatgtttaagaagcatttgaatttttttctgtgaactgtatattcatatattttgcccatttttctattgcagtgctccttttcataataaatctgtaggaactctttgtat

SEQ ID NO: 399415 - DNA, 217 bp, Homo sapiens
ctcttaacacccagcctagctttctttccagtagaccagactgcatgtgcgtttggaaataaatggagcccatgaatcatttagaaattattagggctgggtgtggtggctcaggcctataatcccagcactttgggaggccgaggcaggaggatcccttgaggccaggagtttgagaccagtctgggtaatgtagcaagaccctgtctctgtgaaa

SEQ ID NO: 399416 - DNA, 300 bp, Homo sapiens
ggaggggtggcaccagctcagggctgaaggggcattggggcctgacagctggagccctggacctttcctgcagagtctggggcctggaaattaaaaccccagggacactgtatatcactgtgtgtctgtgagcaagccttggtttgttcccctgtgaaatgggataatagcacctgccttccggagctgcagtttatgaagactcaggctggagcccgaggcctctgagatgagactgatcggcatgtgtgcaggctgcctccgcgtgtccacaaaacttgtgctggggttatttttagt

SEQ ID NO: 399417 - DNA, 469 bp, Homo sapiens
taagtattcaataggatcatgatatttccatttaaaatttaaccagccaataaatacaaacatgtctggttatttaaatttataatacatatgttatgtattaaatttgtaatacatatttaaatttataatacatatgttatgagttagaaattaacagtctataatcagtgaaaatagatggcgtcatcagtgtaatatgatgtgccctcagtacataagttgtttagaaccttttaaatgagtctctgcagtaaatagggagaaatccatgtttccctaagtgatttaaggtttcattttatttactatcaagaaaaaaatagtgtggcaattcacacctgtaatcccagctacacaggaggatcttttgagcccgggagttcaaagctgcagtgagctgtcatcacaccactgcactccagcctgggtgacagagcaagaccccctttctcttaaaagcaaaaaa

SEQ ID NO: 399418 - DNA, 531 bp, Homo sapiens
tgaggagtttccctctgtcacacaagctggagggcaatggcgccatctcagctcactgcaacgtccacctcctgggttcaagcgattctcctgcctcagcatcctaattaggtgggtacctgtagtcccagctactccggaggctgaggcaggagaatggcgtgaacccgggaggcggatcttgcagtgagcggagattgcaccactgcactccagcctgggtgacagagcaagactccctctcaaaagaaaaagaaaaaagatgtaaaaaccattcttagtttgtgggccttacaaatcaggccactggcccattgcttgtagttagttgatccatgtcatgcaccctaaaaatggctctgtcactgtgagtggcttcagtaggattttgagaataagtttatattcttgctaggtaaaacaaaacaaaaacgacagtaataccaaggaatttccccccccttttaccctccatttgtgtttattgcatatccactataacaacattaaaggacctttaaaaggaagtaa

SEQ ID NO: 399419 - DNA, 340 bp, Homo sapiens
tggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtttgggaaggaatagaaaggggcccccaatttttttttaagcggccagataataaataatgtaacctttgcggtttaagagga

SEQ ID NO: 399420 - DNA, 439 bp, Homo sapiens
gctaagagttcagccctgcattgagaagaagaaaaagtcccatgagagcagggcagggtggggtgacaaggaccacgatggccagcctggccctgggtgtaccctgagatgtggattccttgtccccagtgggaatcaggttcaggttggcagattggcagtcgctgtaacccattcacaaaggtgttctaggagcccattgaacatttgtttgaatggaaggaaatgtccaatttattttaatgaattactgataaacagtgctttgaccaggggcctccaggcctgagactgaaggcacagtttaaccagtacacgggccagtgttaaatcttatgcagactgagacgaacttttgtttatttccacattattaatggttctactaattttatctaagggggcgcagagaagaaaaagtggggaaaaaagaaaagat

SEQ ID NO: 399421 - DNA, 441 bp, Homo sapiens
tactgaatcagtccacaaacattttttaacatgtgctgtatggcagattaatttcttacatattgaaatcagcttacatctaaaagaggaaacagatttcgaacaagtaaacctatcatgtcagaggatgatcagtgctctgaagaaaaataaaatagagtaacagactagcaatgactgtgatggacatggctatattaggaaacagggtgcatttaggagtctatgaggatgtgacatttgaacagagacctgaaagaaaggaggggaaaagcaaatgcgaagactctgaggtgagcccacttagatcctaaggtcaccagtaatgatttcccatctctgtgtatttacgattttgtattatctcctcctgttgagtgtaggtggaacttacaacttatttctaactaatgaatatggcaaatataatagagtgccatt

SEQ ID NO: 399422 - DNA, 613 bp, Homo sapiens
tgtgtgtgtaaatgaaagaggaaatctcacatgaaagactcaatcaatgcagcaaactttattttattttattttattttaaataaatgaccacagccacctcacccgttagtaaccaccaccctggtcagtcaggaggcatcgacatcatatctaaaacctccactatcaacaagattatgacctgctgaaggttcagatgactattggcatttctcagaaataaaatatttttaacaaatgcatgcatatttttttctttagctgtaatgctattgcacactaaatatatgacagtatagtgtaaacataactttatatgtactgggaaatctaaatatttgtgtgactcattttattgtcatatttgctgcattgcagtagtctagaattgaacttgcaatatctctgagatatgcttgtatataatatgttgtctatatcttatcacagtttttgactaaattttatttttcctggtcctagtatagccaccacagctcttttttgtcactgtttttatagaatatctgtttctgtctttcactttcatactagtcacatctatagatgcaaactgagtttctagtgctgagtatatagttggatcttg

SEQ ID NO: 399423 - DNA, 469 bp, Homo sapiens
aatctcacagatctttttttcttatcgttgcgttccccttatgttgtcttcagatagtaagcgctttataaatgcttattttaaaaagtcttttttccccataaatgggtaaagattgaaaacactcaaaagatattttgtattccctcatgtgatgctttataagagggatgtaaagaagaactgacactacaaaagcagttggtggaaaaattacttttgaagtagtttaatttatcttccctagaggtatatctgagagctacagttggaaacctgacagatatacagaataactgctgaaaggggtgcacacggggagtggaaattaggtttctgaagcaggaaactataagacaattgatttttggtatggaagagcgtgggatggattctgtgttatgtattgacacttgcattcgctattgtgttacttaacgcaattgtattaaacagttagttgactatt

SEQ ID NO: 399424 - DNA, 133 bp, Homo sapiens
tacaagggggtcgcaagtcccagcagccgcgcgagcattggcgacccctccccaccgcagagatttcctgcgccgaccacgtgctcgcagctccacgcacgccgtggatttgagggtcgggcccccgcggccg

SEQ ID NO: 399425 - DNA, 319 bp, Homo sapiens
tcaggtctctccctaaagttccatctaatatattcattctgaaataagcaatggtaaggagaaaaagttaagagaccaatcttggtggcagagaagagtctacttctttaattcaagatcaagtttctcttcataatgaccttgtagccctcgctcctcagacttgctggctgactggacccacaagaaatacaggtaccaaattgtgggctttcatacattaaaaggttttctcatcttgccttgtattcttacaaattattggatttaaataagaaaaaacaagactcttgtttcagcctctcttattctagacttg

SEQ ID NO: 399426 - DNA, 549 bp, Homo sapiens
aaaagacgtaaccggccgggcgcagtggctcacgcctgtaatcccagcactttgggaggcagaggtgggtggatcatgaggtcaagattggaaccatcctggtcaacatggtgaaaccccgtctctactaaaaatacaaaaatcagctgggcatggtggcgcgcgcctgtagtcccagctacttgggaggctgaggcagaagaatcgcttgaaccagggaggcagaggttgctgtgagctgagattgtgccattgcattccagcctaggcaacaagagtgaaactccatctcaaaaaaaaaagagaaaaagaaaaagacataatgtagtatcaggatcaagtatgcggtactactgtaagagacctgaatggaggcttctaatttgtatcaaaggaaaacagaagcttttcgtttgcatcatttaactgaactgtgaacgcttgtgcctcccatctttatcatcggagttgacagtgaaataaatttatatcagaagtttgcatctcaattttatggagtataaaagatttttttgacattcaacgcag

SEQ ID NO: 399427 - DNA, 313 bp, Homo sapiens
ggaggagcgttgctaatgtttttgtttgtttgcttttccatgcatgcataatgagggggcaccgcggcaccacgcgggggctcccggcccacttttgtatttaaagcctcgctgctaacgagtctgcagccgggctcagcggatccgctccccgggctcttggtcacccgagaagctgccgccgagtgaagccagggagccgctctccggcagcgccgactttcttgttctccccgcgcttcccggaaagagctccccggagctctgcggaggccggggttgccgcgggcggagggggaggggacgcggggcg

SEQ ID NO: 399428 - DNA, 271 bp, Homo sapiens
gggaaagggtggcgttcggaatctcctcacggttactctgtgactgctgcagacaggctccttgcagatgctctcatacacctacatatatatatattttctctatttggagagtaatagactgtaggattgggtggtttcctgcattgagatccttctattaatatatcaatgactctgccaatttcatacctgaaaaagtggtaggttagttatagaagatctttaatattcctttgaggtctaagattctgttaaatatttttgttta

SEQ ID NO: 399429 - DNA, 494 bp, Homo sapiens
cactacacattaaatggaattgacagacatatacagaactttttacccaacagcagaatacacactcttattgagtgcacatggaacattctccatgacaggttacatgttaggttacaagacaaattttaacaaatttaaggaggttgatatatcagatatcttttttgactgcaagggaatgaaactagaaatcagaaattgcaagaaaatttgagaattcacaaataagtggacattaaaaaaattcttgaaaaatcattgagtcaaagaggaaatcaaaagtccacttaaaattaagatgcttatagtaattaagttagaaattaaatttcatagtaataaacacctacatgtaaaaagaagaaagatcttaattaaacaacctaactttacactctgaggaactagaaaagaacaaactaagcccaaagttagcagaagaaaaaaagaacaaaacagaaattaatcaaacagggaatggacaaactata

SEQ ID NO: 399430 - DNA, 495 bp, Homo sapiens
cctagtccagattagcagaaattcccagatgatctataagttcatgagatgtaacacatggttgttattaaagccagaacattatgaagtgatttgatgaacagcaatgtgtaactaataagaaagcgtatacagtatctatttagtactagtaaatgattaatgcaagaagagaatttaaactcttgtgggattattagatgcttttcttccctgtacaaatggtcatggtccagaagcctagaaatgaaaaccatgttcaacttagcaattgcttcctttgttataaataccaactcagtccatagagatggttaactaataaataaagcaatggttagtcaattaaaactgaggatctattctgagtatttcccactgattacagaaatgaagtctcctggaaaggagcacacctaattcaggctaaaaatagtacaactaaatatctggaaaacaggacatgtgtttgaaggaaaatattcaaccaaaaaa

SEQ ID NO: 399431 - DNA, 324 bp, Homo sapiens
tgtacagattgcaaagatattctcacactctgtgggttctctgtttactctactgattgtttcttttgctgtgcagaagctttttagtttaattaagtttcatctatttatctttgtttttgtcacatttgcttttaggttcttggttatgaagtctttgcctaagccaatgtccagaatggtttttcacttttagaatttttatagtttcaggtcttagatttaagtctctgatccatcttggattgatttttttttaaaggtgaaaaaatgaggatctagcttcattctttctttcattcttctatatgtggcttgccaatt

SEQ ID NO: 399432 - DNA, 406 bp, Homo sapiens
aatttctagtggagaatagatgaaatggagtctcctcacatcaaagttaggtagatttatatacttatccaggcaacctggacattcatttaaacatttaagggtttatgtccaaagctttgctgggccaataaagatacagtcttgctttcagtaagctcactttagaaactacaatgtatgatgcaaggtcataatactgtacaaaggtacatgcaaagtgctgtgattgcgcagagagaagggaggactcatggccaggccaggcaatcagaaatacgtcaccttggagattttaggaggaggtaagatctacatggtgaagggcatttcatatcaagggaacagcacacataaaagcttgaaaactgtaaaataatcatagttgtttagaatataagaaatt

SEQ ID NO: 399433 - DNA, 2454 bp, Homo sapiens
  misc_feature (1709)..(1709): n is a, c, g, or t
ttctgttatgtaaggcaatttagcatcctgctccctaggaaatttcttttggagaaaacaggccatgcaaatgaaaaagtctaattgggtgattggctgcatttggtaacatgtgcttggagggcagggagattggctagttgtaaataaacatgctttctctgggcggttgacccttctgcgtggactgactctgaggtttgtccccgacagggagcaggtggggtgaatttcttgatttctccttagacaccagttactatgaaatcactgattcttttcagctggagaaggatatgctaggggttcttggaggacataccagggtgcaggatgttgggatgaagtttaataagggtggtcttggcagggtttcctggaattttctgtctgggggtgcatttttccttttttctgcccccatagcagctttctgctcattgccaaatagcccccttgtcagtgacgggagaaatttggtcttacaggccaaccttggtctctttgcacagcaaacccccacgcattacacaccactaggtacccatagaccctaactgggtggcgatactggtccgcagaagttttgcatcttgattgttaagcttttgagaacccaaggagggttagaaaggaatgaaaataaacctagacagccaccggcagctctcaaggctgtgggccacagagcagcctgaaaaaaatgtttgctgatcgatttaaaaagcaatcctaaaacagaaggaactgccgtgttgtcttttctaccaaatattgtttggaaatgtatgacaaaggtgcatttgattactttttcctgtagaaggtgttagcaggtagagctggtgactttagcataaaagtagagaaagggaaccaagtaaaaggagattgtgccagatttttcaggaaagccggtaacattgcctttgctgctggatgggtgtgtgtctctgtgtgtgtaagcgtgtgtgcaaaagcttgttctcctttgccttggagaaggtggcctgttggtgtgtcatgcacacaaagggagaggaaagccgtggaaaatagtgattgtcctttgctggcttcaaccaaggtgacctggaggacacgttccccttcatggcatcccagataacgtcctggagcacataaccttctctggaacattcagatcccactgcaggagcctaggactgtggcatgctcctgcctctgggcctttccatctctggaaccgcctgaccctgctgcaggctctgagagtgtggtgtcaagtcaagggttgacaacatcaacttcagggccgggaaaatccgcgtttccaccgggctcatgggtggatgacataagcactgcaggctgtttcttcacatgtaaaggaggtagcagaatttgccttgtggtgggtcatgccctcagtgcagtgtctggcaccctgcatattctcaaaaaaggctggtggcagctgtgaaggtgctgaggagggagtttgaggaagctttgcctctcctgtcttcccatgtcacccctttgttagggaggagccacatcagctacaggccagggccctagagagctgtagcccctcacagtggcacttgccacgaggctcagcatccccacttcccacatctaccctgtcgtctttcccactcaaaaactggacatcatgaactcttatctgcagactttgaacatccttattagaaagggcngcaaaagtgtagagagatatttccctgagaagcttctcaacaacatgaatgaaaaaatagacgagctctcttggtttgcaaatgctcttaaagttgagggcaaaaatgtgaaaaagaagagtctttttttcctcctcacccacggtgaggtcagaggtggagttgctttaatagtaaacaccaaacacaggctttagggctggaaaaagaactgctgctgcttcttagtgacatcacccttcccagaagcttgaactgagttaattttagttcagttcagtttctaccagcccttttaaaaaacattttaataactatttattaagctttctgtaagcatctggctttatgccagaggctgtggacttgaagatacataaaatagtcaaattcattcctatcagatggattatattctagtacaacgaaggcaagatttaaaccaaaagaatggccactgccaagcgttttggctcacatctatagtcccagcattttgggaagcagagacaggagggttgcttgaggcaggagttcaagaccagcctggataacataacgagaccccatctctacaagaaatctttttttaaaaaatagctgggcatggtgatgcacacctgtagtcccagctactcaggaggctgaggtgggaggatcacttgagcccaggagctcgaggttgcagtgagatatgatgacaccactgcaccccagcctgggtgatagcacaagaccctacctc

SEQ ID NO: 399434 - DNA, 264 bp, Homo sapiens
agtgtaatagttacaactgtgtctagaaaactgtataggatgtttgattggtagcttcatttagatacccaaacatcaacacctaaatacaaagctctggttttaccatggctttcgtttctagcatatggcactataaacctcaaaattaagggccaggcacatggtggctcaagcctgtaatcctagcactttgggaggctgaggcaggattccttgaggccaggaatttgagaccagcttgtgcaatatctctacaaaaaa

SEQ ID NO: 399435 - DNA, 628 bp, Homo sapiens
gacctgttatttccctacagcttgagtagcccctgacttaagaagagcaactgaatcatgggatgctggtgtgagttactcaagtcatcaaattctatcattcaaagggatctcaaggtcgtcttgtccagtgcttcccatgtggtataccagtatgccaccacatacggctgggccactgcagagtggcgggtgagcctcaagtcactgactcccttcagctcagatgtaccttgtgtacaacttacaagaataatcatgatgatgtgtgatttttgctttacatgctaatgttagatcctaatgtgagtaagagagatctcccctgaactacatggtactagacttcatgtgttaatattctggtgtattatttgttgttgtttggccagggatggaaaaactcattccaaatgtgcttattattaatatatttgttatttgcaagaagttacacaggcattttggaattattttcctaatagggtaggcaactaccttcgtattcttttattttgtagagacaaggtctttgctctgttgcctaggagatcaagactgcagtgagccatgattgcagcactacactccagcctgagtgacagagcaacactctgtctcaaaaaaa

SEQ ID NO: 399436 - DNA, 341 bp, Homo sapiens
acctgcaaagcatcacactttgcaataactctccaaacagtggttgatttgttgtggttgtgcttcagaataagcagcaaagacaggataaaacagggaatgaaaaaaagacacttattagtttggtgacatgcataggactaggggttgctttagaagataagaaccccctttattagaagtttcgtgtagctgagggggaatctggaagaagcaaatttagccaataattgcatgatagaaaagatcggtatctctctcctcttccctcaccatctagtatttcttcctttttatggtttttttctttctctgaatatcccctttcctttcttgtacct

SEQ ID NO: 399437 - DNA, 138 bp, Homo sapiens
acattttgtcaaagctgaagtacattgacaaagttgtgtacttcacggcttatctacaccttgagttaagtagcatcttttaatctctactagcattcaaaaaataaaagaaagaaagaagaaagtaccatatgctga

SEQ ID NO: 399438 - DNA, 620 bp, Homo sapiens
aaacgtgtttattccaaaaagatgcaagatttctctcctggaaagcaattcaccactctctatgcttctttttctttctgagaagtcttatacacataacagttttcaatgcacagatggatcttctgtggttcacaaccttttacatttgagggctaattaaaatgaatcctttgtgccacctctaagatacaactcactccttcatgttgttcattgactaagatctaataaaccagttccaattcataactagggattattgaacttcttgtggccattggctatcatagaggcattgtgaaaatctctaaggagacaagtgcacagcagcctggcccggagggtcctcttatttgaagtagaactcaagttgcacccaattatgtaaggctgatccaacccagaaaagagttttctgcaagagattaagccaattctccagaactctaaggaggaaatcaagatccttgtggctgtttgatcacttctgtgatttgaatgtctccacggtttaatcatttgcttacataatgaggacattacagagagaagagatgagggtaggggaagagaaggaagggaaagtgaaaaataagaaggaaaaggaaaagaaagaa

SEQ ID NO: 399439 - DNA, 269 bp, Homo sapiens
ttgtatcacctgtcaaggcatgacttccccagaactaagcgtgtttatggggtcaagcccacatacacagtcgctcaagtatcctgtcacctggttatttcctgcaactggttacttcccaaatggtacttttttgtaactgcagattactaaggaagttatttccctaagttgtcaatatatatttattgcatactaggtgagctggggttttgggggagaaagaaaggaattgctggtggagggttcttatttgtcagacacttaca

SEQ ID NO: 399440 - DNA, 654 bp, Homo sapiens
cttttggtcaaaaaatgaagtttcggtaatgcatagtaacaactgtagtgtaattactggccacaaaataccaggtgccagaccaacccttttcgaaccatttaagagaaccaagccaagcaaaaatgcccagcctagccttacccagaagttcaaaagctcagcctttgtcaccaggaaaaaattaattcaaagagcaaagccattattcggcacaaccaggtattctgttgtaaacatcttttgttaatacatgttgaaagctgaactttctcacgtttgagtgaaagagggctgcttaaagagagtttaaaccaagccaggttcaaggtttttttcttttctttctttttagatttctgacttcatatctgtgggatccacacaatggggaggtactggccttggaatccatggttccccagctatcattttactttagaattacagtgttctctgttagtgtcaagggaatgaacctgacgagaaaagaccaaacataggactgttacagggaagaaaaatatgaaaagacctaaagatgcacgtcctcattatatgtaaggaatctatttcctagaatcctataaaaagctcaagtgaatttgcttcagttaataaatgtgatttaattataatgataatgccacagca

SEQ ID NO: 399441 - DNA, 504 bp, Homo sapiens
ctggatccaagagcatctcctgggttcttcctgttagaatactgaatgtccatggagagtttaacataaggaagaagaggcctgtctcccagctgaaactggtgcagcagatcatgcaaagtaaaacctcagcagctgtgatgaagtagagcagagggcctgggtgtctgtcagctccaagcggaagatttccccagctttctagatttctgacttcatatctgtgggatccacacaatggggaggtactggccttggaatccatggttccccagctatcattttactttagaattacagtgttctctgttagtgtcaagggaatgaacctgacgagaaaagaccaaacataggactgttacagggaagaaaaatatgaaaagacctaaagatgcacgtcctcattatatgtaaggaatctatttcctagaatcctataaaaagctcaagtgaatttgcttcagttaataaatgtgatttaattataatgataatgccacagca

SEQ ID NO: 399442 - DNA, 221 bp, Homo sapiens
acttgttttgagatttaggtattggggtaggaggaaggcggaaaagttggttttcttttagtaccattttattcattcattggcttagcaaacacctttgccctccaccttttttattttctttcaaatccacagaaaactctaaacagtgttaaggtgaacagtctttatctagtttaccaattaatattttccacactgctttttctgtttgtctccct

SEQ ID NO: 399443 - DNA, 505 bp, Homo sapiens
acaaataagatgataaaagtagaagaatttttatgactactcacctacacaggattaaacaaccattcacaaccaaactacacaataaatacacaagttataggaaaatagaaataatatttatacaggcaagcaaacataaacacattagcaatagacatatggctgattcatatttgattttgcttcacactgtcataaattgcagagttaaatattttcatacacaattataatataaactaaaacatccaaacacaattaactaatgtgagctggaatacccttaaatataaaacgcaaaaatataaaagtgcaaaacaaaattaaaacatgaaatgtaaaacttattggacaccatcaagtagaacaatatattcatgaaaaaaaatcatagaataatatagcaaaaaagtaatacagaggttacttgaagatttaaaaaagctgagaactttccaaattatgatgtaataaaaaattcttaaccaatactacttgaaaa

SEQ ID NO: 399444 - DNA, 759 bp, Homo sapiens
agatgccctacggaactagcgagatatggagggtcaactgtgaaaccatcaatatcaggacattagctttgatatgttactgacatcaaatggagttagactccattcacagtttgcctgttgtccctaatatgtcctttatagcaaaagtatccagtccagaatcatgtgttgtgcttagcttctgccctacctcttcagtctcctttaatctgaaacagttccttctgctttccttcatttttatgaccttggtacatttaaagatgataaaccagacatttgtaaaatgtcccttaatttgggtttacctgacatttccttgaactcaattcagattgcacatctttggcaaaaatatgacagaaaagatgccttgttcttcttgcaacctatcaggtggttcatgattttgttttatcccattactgatgatgttcactctgatcatttgactagggtggtgagtgccaggattctccactctaacttagcctttttttcctttgtaattattaagtgtttgtggtagggtactttgaagttatgtaatacatactttggcattaaaaattcagttgataaattggttcttttggttacatcaccatgtactaataggtttctataataatcaatagtcataatccattcctatcattgtttgtcttgatgttcgaactgtcccagatttgtttggtgggagctccttcaagctggctcctgcacagcttttgacttatcgctatcattctgtca

SEQ ID NO: 399445 - DNA, 736 bp, Homo sapiens
cgtttaaatacaagctcctgtatgtactaggtctttaactattggcaagatatttaacttctgtgcctcaactcatctttaaatggagacaatagtagtacctagatcaagggtttgtttttgagtgttggtgagttagtggaaaagttatgagctaagaatgttatacccagtatgtagattacttggctctgtaaccagaatttagcgttcagcaaatgcagccactattattgatattaccactattattattaccagcattaccaatatctactctgaagtagatattattatacacattttatatgcaatgaaacaaagatttagaatggtttttcaaaaggtgtttaatttcaaataattaatgattgatgggtttgagcattgaatctagatctgactcaaagctagtatttggttcctattgctcctataacaagcaccacaaacttggtgcttgaaacaacacaaatatattttcttgcagttctgatgatcagaagtcctaaatgagtctcactgagctaaaaatcaaggtattggcagggctttgttccttctggaggctctagggaagaactcatttgcttgtcttttccagttttgaaggctgtcacatgcattccttggcttgcagccccttccctcttcaaagccagtaatggctgatcaaatccatctcctgctgcatcaccctgacactgactcatctttcgccttcttcttttacatt

SEQ ID NO: 399446 - DNA, 297 bp, Homo sapiens
gaattatttgtgtataggtaatgagtgtgaatacatgcgcacacacaaagcactagtagagcttttaaatgtcaaaatttaaatattctaaaggagcaaagaacaaaatcaaatttgtggagagattctaactccaaagtcaaatctacagttgtttatattttgtggtctgtagcatgtcatttaaaaggcaagagttaagcgaacaggtgatggtgaggtgggaaaggacaggcatggtgttaggagtgtacgtatatgagctgttggccattaaaatatagtcacgcgcaagtc

SEQ ID NO: 399447 - DNA, 438 bp, Homo sapiens
tcatccctgggcaaggcaaaccaaagtcccacaggttcataaggaggaaatggaggtctgcctgtgccacacccatgctagcaggcatatcacacctgggctcattacagcaggtgagatactggccactgtttaacacaatggccctagagggctcattgcaagtagggaagagcagaaaaaggcacttgctgaggcttgtgtagctctctggccactcccaccactgcacaatgacctggaaggtggattggccactgcgagagctcctgactcgctcattccccacatatgttagtaatcagataaataggccttaacttacacaaggagcgatttgggctgcaggtgagagagatcttctcacaggaagccattgctcaagactgagacaagctatcaagggacactaacaccagttccttgacagatactgag

SEQ ID NO: 399448 - DNA, 593 bp, Homo sapiens
tttggagaaaaggtcacatattgctggaatcataaaccggtgtcatggctttactatttgcacccggtctgaaatgtttctgaggtgttatctgagtggttctggataagtagcttagacttgcaaccccaaataggtgggaatcatcctccttttactgaattctgggtggatgataaccccatcgtggccaaatggctgaagtcctacccatatcttagaataaagtgatctgggaacccgagccctttttattggattttaatgttttcaatcagtgtttaatgtgaaaatcagtatttgaaaatatgctttgtgtttcgtcttgcaaatcattaaaaagatgccatatgcatagaattaccttgtatggcaggaatcctaggaaaactttaaaagtcaatgttaacacttggtaaacactcctgggtagagtccagcaatccttctattagagaaaatgttttctctctgggatttgaaatgttttagatttacatcttcctcttgagaaaaactttctaactaccagaaagaagataatggtcctgaatgaatacatttactaaactgtaaaatccagaatagataag

SEQ ID NO: 399449 - DNA, 568 bp, Homo sapiens
ccgtgtctagaggatcccgtccacggtaatttaacaagttagatgaaaatggacaaatttcttgaaagatataaattatgataatgaatataagaaagaacagaaaaactgaagagccccgtatcagttaaataatctaaataataattaaatatctccctttttctctttctttctcacacacacacatacacacacacacaaattccaggcccaggtggtttctctgatgaatcctattaaatacagttatgtgcctcataacaatgtattggtcaatgatggaccacatttataatggtggttggagcagcaggctatactgtacggcaggggtccccaacctctgggctgcagacgagtaccggttcatggactgttaggaactggggactgctgcattatagtaaaactgtgattgtaagtataaccctttcctgagtttgagttgttctagaaaattactgaacccgagtgggttgtggaaactcttgaatttatcaccagttggtcaaagtgtggatagcctggggacttccaaacttgtggctggcctctgaagtgaagg

SEQ ID NO: 399450 - DNA, 560 bp, Homo sapiens
aaataattttgtgccaatagatttaacaagttagatgaaaatggacaaatttcttgaaagatataaattatgataatgaatataagaaagaacagaaaaactgaagagccccgtatcagttaaataatctaaataataattaaatatctccctttttctctttctttctcacacacacacatacacacacacacaaattccaggcccaggtggtttctctgatgaatcctattaaatacagttatgtgcctcataacaatgtattggtcaatgatggaccacatttataatggtggttggagcagcaggctatactgtacggcaggggtccccaacctctgggctgcagacgagtaccggttcatggactgttaggaactggggactgctgcattatagtaaaactgtgattgtaagtataaccctttcctgagtttgagttgttctagaaaattactgaacccgagtgggttgtggaaactcttgaatttatcaccagttggtcaaagtgtggatagcctggggacttccaaacttgtggctggcctctgaagtgaagg

SEQ ID NO: 399451 - DNA, 422 bp, Homo sapiens
tactgtttaatcctcattccataaactccaggttttgcttttatttagatatctataattttactgctcttttaaattttaaaaaacttatttgtgaagggttatcaaaattctcatctccttgatacctttctaaccttatatctttatcataactttatcatatctttgtgcgttctcatagtattgggcattgaatgtataaatttttacctttccatagtttttcacattttgtttttaaaatacactttgcttaaattgtcaatgtaacatggatctctaaaaccctgcttatttctactattgacagattgtatttattataaattgttttcatctctgagcacttattccatgtttgatggtacctgtaatagcatcagcaattctaatatgctattaaacaaaaatttccattg

SEQ ID NO: 399452 - DNA, 485 bp, Homo sapiens
caaagactgcagtttccctggatctgttccttggccattgattaccatggcaacaacaccagaggtagcacttctgagccagatctgatcctaatctctgtgtgacttagtctcaagcatccaggaattacaagcaataatgagagtaattttggacactttctcagaataatttctatattcaagccaccccacctcaactccacccctgtgatacaagtcccatgagtactgacatttgcacagtagcataaatgccttaaggaactttgggactgggagtttttggctgaaatcctctgtcatgggacgagggtacagtaaagaagctctattcctcagaagaaaatttgggcaccgcaaagtctaaataaatcccctttcaggatttgatatagtgtgtacttccaacaaccatcctggcgtagttggggattgttttacaataagtaaacattgctaataactgtgttacaagatcatta

SEQ ID NO: 399453 - DNA, 284 bp, Homo sapiens
tgcgatggatcatgcctgatattgcagctttttgggaggtcgaggcaggtggaggtctcaggagtttgagaccagcctggccaacatggtgaaactccatttctactaaaaatacaaaaaattacctgggcatggtgacaggcacctgtagtcccagcaacttgggaggcagaggcaggagaatagcttgaacccgggaggaggaggttgtggtgagctgagatctcaccattgcactccagtctgggcaacaagagcaaaactccatcttaaaaaaaaaaaaa

SEQ ID NO: 399454 - DNA, 513 bp, Homo sapiens
agtatcagtacaaaaatagtggtcttttcaggaaaaattaaaagtgcatgtttggggatgggctgccaattcctaacaataaaatcagatttctgggcaaatgagttctgtgtaacatgtagcttacaatgcccttttatttacagattgaagggttccagttgatctgcttactgttgtattatgttcctctcaaacaataaggaaaatacatccacaaaggtgaagtataggggagattattattttctccaaattggcaactacaagatgccaattgccaatggaatgcacagctcttagattactttggattctcagtaggggctaagaaggaaggtcaggtaagatactttacatcaaagactgacagttaatggagttagatcaaccttatggggaagggaaaggcagggcttgtgacaattttattcctaaaagaatttctgccttgtttttagccatgatgttaattatatggagcaagaaataataaagtcaatggctaaaata

SEQ ID NO: 399455 - DNA, 328 bp, Homo sapiens
attcgcctacctcgacctccccaagtacagggattacaggcatgagccaccacacccagctaatttttttaactttttgtagagatggtgccactatgttccccaggctggtctcaaactcctgcctcgagcgatcctcccacctcgaccttttaaagtgctgggattgcaggtgctcactaccgcacccggcccagctccaatttttcacaattccctggatctcgttttttttttttttttttaagtgtttatgtcccggccaaaacacagtggtcctgcccctgactgaccccccccacccccgcacccaggcctccagcccttc

SEQ ID NO: 399456 - DNA, 210 bp, Homo sapiens
cgtgatgacagggcccatgtctgtcttgttcgttgttgtgtccctagtacagcactgggctgtacagagtactctcatgggttgaaataattaaatgtactttctggtgacaaagcttcagagtggatcacttgagcccaggagatcaaggctgtagtgagctgtgattgcaccactccactctagcctgggtgaaccaagagaaagaaa

SEQ ID NO: 399457 - DNA, 509 bp, Homo sapiens
actccagcctgggtgacagagtgagactctgtctcaaaaaaaaaaaaaaaaaaaaaaaaaaaaaaatcaaagaatcttcaaagtgatgattgaaaggaaatattctgagaaatagtcagggatttctgtgtaattacagccgtaaggtacatgtaatagcaagaggaaaataaaagagaccaaagcatgagcaggcattgaccaggggaagggaagggagaggggagtggcaagaggagcttccaagacagaaggaacggttcgagtgatggctccgaggctaggagaagctggttactagaagaagcttccagaagctctcttgccagggtacaaggaagtagaaggtgacatttgggaatgggctagggaagaaagaaggtgatagaaaggtagatagaagataggaaaatagaaagatagaaagaaggtagacccagggtctaccttcagaagttgggattttatttgaaagtcactgggattccttggtagggatttgtgccagg

SEQ ID NO: 399458 - DNA, 381 bp, Homo sapiens
ccaagaattcggcacgagggttggagcgacacagggatatagctaaattatttaattctttcatttttttggtgggtttcttgattgtcacatacatttcctcttctcaaactgcaatctactgtcaaatgtgacttacgagaccttgattcctttcccctctatgagttctttctggaaggtatggaaaaactgaccacagatggactccttatgctcagagggtattagccaggacttggtgttgccacttgttctattcttttatcttttatgagctgaggggtcacttgttcccctaaggtcatgatgatccattccactaccaaagggaagttttcttttctctgggttttgttcaacgttatacatttgcggccg

SEQ ID NO: 399459 - DNA, 734 bp, Homo sapiens
agcctgttggagtgcttgtgcaggagttccaggttgcagtgactgataatcatgtcactgcactacagcctgggtggcaaagcgagactccgtctttaaaacaaaaataaacaaataaatgatatacaagtatgtagcgcatgcattctcaacaggggtggtggtgtcccaaagaggtgaaaagtgtttcttgtggtggtttctaccaatggtgaaaaaaatcttaagacaatacaaaaacttgggaccctccaaagctcaactctacccaacaaaatcttattcctttgtactaaatctagcaagggataggaggtaactaggaacaatgtctaaaacaactcttggagaaggtgatcatgaaaacaaggttaagaaacgctgagataacactaaaatgtacaagtctctccccccacaaatcacactccattcccagagggaagggcctatccttcagccaattattcttccagcccacaggcacacatatcacatatcactattaatcatatatccaagagctctggactaagaccaccttcagaaacacaaccccgagggcctatgtgtcctaacagtgaaggcagacactagagcagatacaagcctaccagctgactgggaaacagccatgcccctccctggctctgaaatttgagaagcttccccctaagaaccctcagaaagggagaaagagtaaagggagacctagcttcacaagcactccaaca

SEQ ID NO: 399460 - DNA, 1080 bp, Homo sapiens
aaagtagattcttaggctcagcttctgcttaaggctaggcagggattgggggtggtgttgggagagccctctatgctgagttatggttttggctttgatgttgctggttttaggaggcaccaacaaagctatggacaggaggatttgggagagatttacttacccacggtatgtaagagaagattggggatgaggagtgaggagaaggctggagaccagttagaggctaccgtagcagcgtagagaggctgaaaatctaactagggtggaagcagccaggcaggctggtcctaatgttgggagttgttcagatctggtggagaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctattcttagtgctttacttgttgtatgtgttatctaatgctgtgtaacaaattactcctgaacttaccaactcacaacaacatttattagctcacagtttctgtggagcagggatctagatgtggcttagttggggttgctggcctggggtctctcctaaggctgcagtgaaggtggtggccggggctgcagtcatctgaaggctctagtggggcaggatccacttccaggctcactcaatggctgttggctaggtttagttccttgcagtctattggattggggccctagttcctggtatatggcctctctatagggcaggtcaccttgtggcagtagacaccatcaaagtcagagagagagagagagaaagaaagaaagaaagaaagaaagaaagaaaagaggggccagcaagatggaaatcacagccttttataagccagtcttgaaagtggtagctcatcacatttgtcctactctctgtgttacatgttaatttctaggtcgagcccacactccaggggagaggagtataccaaaagtagatacttaaggctcagcttcctgctaaagggctaggcagggaattggtggggtggtggttggg

SEQ ID NO: 399461 - DNA, 1010 bp, Homo sapiens
aaagtagattcttaggctcagcttctgcttaaggctaggcagggattgggggtggtgttgggagagccctctatgctgagttatggttttggctttgatgttgctggttttaggaggcaccaacaaagctatggacaggaggatttgggagagatttacttacccacggtatgtaagagaagattggggatgaggagtgaggagaaggctggagaccagttagaggctaccgtagcagcgtagagaggctgaaaatctaactagggtggaagcagccaggcaggctggtcctaatgttgggagttgttcagatctggtggagaggtcattacttatagagttattaatttataccccacctttcattcagcagctatttcaatgcctgctgtgtgccaggtgctattcttagtgctttacttgttgtatgtgttatctaatgctgtgtaacaaattactcctgaacttaccaactcacaacaacatttattagctcacagtttctgtggagcagggatctagatgtggcttagttggggttgctggcctggggtctctcctaaggctgcagtgaaggtggtggccggggctgcagtcatctgaaggctctagtggggcaggatccacttccaggctcactcaatggctgttggctaggtttagttccttgcagtctattggattggggccctagttcctggtatatggcctctctatagggcaggtcaccttgtggcagtagacaccatcaaagtcagagagagagagagagaaagaaagaaagaaagaaagaaagaaagaaaagaggggccagcaagatggaaatcacagccttttataagccagtcttgaaagtggtagctcatcacatttgtcctactctctgtgttacatgttaatttctaggtcgagcccacactccaggggagaggagtataccaaaagtagatacttaaggctcagcttcctgctaaagggctaggcagggaattggtggggtggtggttggg

SEQ ID NO: 399462 - DNA, 507 bp, Homo sapiens
acttagccagacatgatggcaggtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaagagagtcagtttataggtatgattttgactaagaaagtaagttaaataggttttatgtcaggattggtcagagaccgataaaacagatggacattgggaggcggagatgggtggatcatgcggtcaagagtttcaggccagcctggccaagatggcgaaaccccatctctactaaaaatacaaaaattagccgggcatggtggcgggtgcctgtaatcccagctacttgggaggctgaggcaggagaatcgcttgaacccgggaggcagaggttgcagtgagccggatctcgccactgcactgtagcctgggtgacagagcaagactccatctccccccacccaa

SEQ ID NO: 399463 - DNA, 615 bp, Homo sapiens
gctctgggagtgtctgtcttttgcagttgaagataaggcataaaatacgccctggtctccttcagtgccctcaggcttgctaggattaggaaattccagcctggcgaattctagtcagaccggttttctgctctagaaaacactgtttcttgttaagatgtttatcagtgacaatgggtgtacagtgggacatgaaacctcatcagcagttctaatctcaccctggccttgtgatcttgctctgcccccattttccttgtgatattttattgccttttgaagcatgtgatctctgtgacccacaccctattcgtacactccctcccctttgaaaatcgctaataaaatattgctggttttgtggcttgggagcatcacggaacctgccgacatgtgatgtcacccccggagactcaggtgtaaaatttctctcttttgtactctttctctttatttcttagactggccaacacttagagaaaatagaaaagaacctacattgaaatattgggggctggttcccccaataggctacacggggttcagggacccacttgaggaggtagtctgtccattctcagagctcaaacaccatgctgggagaaccactgctct

SEQ ID NO: 399464 - DNA, 457 bp, Homo sapiens
tgagacagtctcgcttggttgcccaggctggagtgcagtggtgcaatctcagctcactgcaacctctgcctcccgggttcaagcaattctcctgtcttagcctcccgagtagctgggattacaggcgcatgctgccacacccggctaatttttgtatttttagtagagacggggtttcaccttgttggtcaggccggtctcctgacctcaggtgatccacccgcctcggcctcccagagtgctgagattacaggcgtgagccaccgtgtccagcccgctaccttgtttctttattctcaaaatctacctttgtcatcacttccttcagaaagcctcctggggctgagtgcagtgccacatgcttgaaatcccaactgttaggtaggctgaagcaggagaattgcttgagtccagggctttgaggctagcctggggaacacagttataccttgtctcc

SEQ ID NO: 399465 - DNA, 487 bp, Homo sapiens
gagtcctgccaacagaaaccaaatgagattagctggacgtggtggcaggaggctgaggcaggtgaatttcttgaacccgggaggcagagattgcagtgagccaagatggtgccactgcattccaccctgggtgacagagcaagactgtctcaaacaaacaaacaaattaagatggctcatttgtagacattttctcatttttaaggattttcttctccctctaaactttttgtaatctttgttcccacttggattatctgctagtgagagctaatagtcaacaaaacaattgcacaaatagcaagttaatattaatggaaccatttaaacagctatctcaatggcttgtcatctgggtgcctggactcatgcttctgactttatgttataatctcatggtatagtcctattttgtctgataaagctgttttatttacatggaataattaagtaaatcaaaacatcacagcattcattaaaaacttgg

SEQ ID NO: 399466 - DNA, 486 bp, Homo sapiens
ggatctcatctgtgttgagaacactagctcttgggctgcctgccatgggacccctcactttgcctagttttgccctatttcaaactgaagcctgtaccagtgcacctgttgaaggctccctatttcctctctgcttcgctagggagaaggcactttttctaaacttcagccttgggcagaaactctttcccctaactccccacggcatctctcccctacctacctataggtaacaattttgctcatgttgggggcatttcaggacagccaccacatccagtagccagcttcgtgtttctatccacagagaaatctagcttctcatcccagcttcttcctgggtcacctgcaggccaacacccctcagtccactggtccatggcaaaatagtctttctgatagaaataggcagagcatcctggtccatgtgctatttagtcagtcctttgcttttcgatcaataaacatatatgggcctctgtctca

SEQ ID NO: 399467 - DNA, 324 bp, Homo sapiens
gcccggctatcacattatcacacacaaaaatctattagagagcaactgaagacctacatgctaaaggcaaaaaacaaaaacaaacaaacaaaaaagtttcagaggacatataagaatatctgcacatcttatcatggtagaaaaggttttcttaagaattccttaaacagctttggttcaagtcctggctctaccatttactacctgagtgaccttgaaaaaagtcacttaacattctgtgcctcagtttccttacctataaaatggaaatagcaacagtacttgcctctaatgttataaggattaatggagataatgtgatag

SEQ ID NO: 399468 - DNA, 931 bp, Homo sapiens
cttccaccctttgaaaactttgttctttggttctttgcaataaatgttgctgctgctcactcttcgggtctgcactggctttatgagctgtaacactcactgcgaaggtctgcagcttcactcctggagccagtgagaccccgagcccaccgggaggaccgaagaacttcagatgcgccgcgttaagagctgtaacactcaccgcgaaggtctgcagcttcactcctgagccagcgagaccacgaacccaccagaaggaagaaactcggaacacatccgaatatcagtaggaacaaactccggacacgccgcttttaagaactgtaacactcacctcgagggtccgcggcttcattcttgaagtcagggagaccaagaaccccccaattccggacacagggggacttggctgcttcctgtttctatcatagacgcagctggcctcagaatattccacttatggatgaaagaatgatagtgttattttatggaagaatttaagaagatgttgcggtatcatcgactttattttttgttcattctgaaaatcacatcgccagatccaacacctttttatcccaatcaccagtacaagccacccgtatcagtgtacactgtggctgaccgatccatagtgatgctttgagcacaaggaaggactttctggaatctacttatctgaccaagaaagcttctttccaaaagaaatgcaattgtcttgagacttcttccctagggatctgatcaactaaccagaaaagagcaaccaccagagaagagactgtagtcgtacagtgtccagaagggcaaaggacaaggtattgcacctgccttcttacctactttcccccctgctgcacaggaaaatctgcccgaggacaattaccaacatttcaccaggtctgcgttcttttggatctaatcgagagaa

SEQ ID NO: 399469 - DNA, 438 bp, Homo sapiens
tgacatttcagcaatttctctaaagaggaatgactggggggtatgtacagcaggcatcatgtaagaaaaactcacacctcacgacatatttgtttgatttattcagcagacttcagcaaaggaaagatgtgaaagcaacccttgattgttgattttttgttcattctgaaaatcacatcgccagatccaacacctttttatcccaatcaccagtacaagccacccgtatcagtgtacactgtggctgaccgatccatagtgatgctttgagctctggtagatgtgattatgcccattttacagatgacaaactgaagttcagtctttaagtgatttttcttgatgcagtaatgagtatgaaaactatgaagctctgtagaacttgaagaactactatattgtcagaataaattaaaatgctcatgcttcattccatct

SEQ ID NO: 399470 - DNA, 768 bp, Homo sapiens
cttccaccctttgaaaactttgttctttggttctttgcaataaatgttgctgctgctcactcttcgggtctgcactggctttatgagctgtaacactcactgcgaaggtctgcagcttcactcctggagccagtgagaccccgagcccaccgggaggaccgaagaacttcagatgcgccgcgttaagagctgtaacactcaccgcgaaggtctgcagcttcactcctgagccagcgagaccacgaacccaccagaaggaagaaactcggaacacatccgaatatcagtaggaacaaactccggacacgccgcttttaagaactgtaacactcacctcgagggtccgcggcttcattcttgaagtcagggagaccaagaaccccccaattccggacacagggggacttggctgcttcctgtttctatcatagacgcagctggcctcagaatattccacttatggatgaaagaatgatagtgttattttatggaagaatttaagaagatgttgcggtatcatcgactttgtaagtgtgaagtgtttttactattccactcacaattcagttcaggaaatatttgatttagaaagagatttactacaatttgctgggttttcccaaataaccctcttgacaattattaatatcttaggcttagcaactcactcaaatagactaaaatagactgaatatttgcttaggccttcttaacatatttcagacatatttttctcttcttggtcttcctcagtaacatctggtgatc

SEQ ID NO: 399471 - DNA, 1163 bp, Homo sapiens
cttccaccctttgaaaactttgttctttggttctttgcaataaatgttgctgctgctcactcttcgggtctgcactggctttatgagctgtaacactcactgcgaaggtctgcagcttcactcctggagccagtgagaccccgagcccaccgggaggaccgaagaacttcagatgcgccgcgttaagagctgtaacactcaccgcgaaggtctgcagcttcactcctgagccagcgagaccacgaacccaccagaaggaagaaactcggaacacatccgaatatcagtaggaacaaactccggacacgccgcttttaagaactgtaacactcacctcgagggtccgcggcttcattcttgaagtcagggagaccaagaaccccccaattccggacacagggggacttggctgcttcctgtttctatcatagacgcagctggcctcagaatattccacttatggatgaaagaatgatagtgttattttatggaagaatttaagaagatgttgcggtatcatcgactttattttttgttcattctgaaaatcacatcgccagatccaacacctttttatcccaatcaccagtacaagccacccgtatcagtgtacactgtggctgaccgatccatagtgatgctttgagcacaaggaaggactttctggaatctacttatctgaccaagaaagcttctttccaaaagaaatgcaattgtcttgagacttcttccctagggatctgatcaactaaccagaaaagagcaaccaccagagaagagactattgtggtctactctatagaagggatcatgctttgaacctcatcttgaaaggagattcaatctttccttcttgctcctaatatcaacagagggtggaatatatgtgcaggaacaaataatatctctgtactgggaagtgcaagattgtcttctagtcaccggcacttgacacactaaattgatgcacatccattttaaacccggcatttgtgctccatatcttgccctttgacctatttggattcatgtgggaatgtgacctctgcttgaataggatgatgacattttcaaagaagctaaatcttaccaaaaatcagattctggtacgattgtgatcaagtagtataataaagctaatcgtggcttgcagaaatcgaaac

SEQ ID NO: 399472 - DNA, 1032 bp, Homo sapiens
cttccaccctttgaaaactttgttctttggttctttgcaataaatgttgctgctgctcactcttcgggtctgcactggctttatgagctgtaacactcactgcgaaggtctgcagcttcactcctggagccagtgagaccccgagcccaccgggaggaccgaagaacttcagatgcgccgcgttaagagctgtaacactcaccgcgaaggtctgcagcttcactcctgagccagcgagaccacgaacccaccagaaggaagaaactcggaacacatccgaatatcagtaggaacaaactccggacacgccgcttttaagaactgtaacactcacctcgagggtccgcggcttcattcttgaagtcagggagaccaagaaccccccaattccggacacagggggacttggctgcttcctgtttctatcatagacgcagctggcctcagaatattccacttatggatgaaagaatgatagtgttattttatggaagaatttaagaagatgttgcggtatcatcgactttattttttgttcattctgaaaatcacatcgccagatccaacacctttttatcccaatcaccagtacaagccacccgtatcagtgtacactgtggctgaccgatccatagtgatgctttgagcacaaggaaggactttctggaatctacttatctgaccaagaaagcttctttccaaaagaaatgcaattgtcttgagacttcttccctagggatctgatcaactaaccagaaaagagcaaccaccagagaagagactattgtggtctactctatagaagggatcatgctttgaacctcatcttgaaaggagattcaatctttccttcttgctcctaatatcaacagagggtggaatatatggccctgctgctgaagtttgagatataaaatatgtacctagagctaatataatggagatccctgaaaaagttttcctaaaaaaataaaaattaaaaaaaacacacacacaatgaaataaaaatgagaggtaaaatctgctcaattc

SEQ ID NO: 399473 - DNA, 311 bp, Homo sapiens
tgctccaagaacaccctagatttacaggggaaataagcatgggactaaaagcagctggccatcttactgctgaaacattaagagaaggatcaatcctgtttcacccaaacagggatgagtcactgcctcacctacgggtggcagacatactacaggtggtagatatactacctgtactacctgtctacaggtgttagacacactaccacctgtaggtttcaaagtattgagtagagaccatatttcacatgtctccactgaactgaccccatcaccgtatctctagcaaagccagaacctcctcccagatg

SEQ ID NO: 399474 - DNA, 298 bp, Homo sapiens
gtagaatgggagaacgcatttcttagagctatgtcaatctcagagtgtgtgcggtcaaactccctaaggaaactcgcctccccttccccctttttttatttctctggggatgttgtggctcttaacccctctttggttctggaaggtaggaaagagtgatacagaggttatcttttagtcttctcgagtagtagcaggtagttttgaatatcttcttcaggatcgcatggaattgaacagagccctggggacagcacagctgctctgagacctgcagggctatttggtctgtgactgg

SEQ ID NO: 399475 - DNA, 921 bp, Homo sapiens
ttcaaccttatattaagagcattggcagaagctagcggttttggtatcctgtaattattagttgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggaggattacttgaacccaggagttccagaccagcctggacaacaaagcaagactttgtttctactttaaaaaaaaaaaaaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaattatccccaacatttagcagcttaaaacaaaaaacatttattatatcacactttctgtgggtcaggaatctgggagggacttagctgggtggttctgctcagttctcttgggatgtttcagtcaagcagtggcctggggctgcactcttatctgaagactcaatcgggagaaaatatgcattcaaggtcactcattggttgttggcaggctgtagttcctcactgaatattggttgaagacttcattggcttactacctggacttctccacacactgcctgaatgtcctccccacatagctagagtgaatgaactaaaaaagagagagaacacacacagcccaggtaagagttcagtctttctaagtcattatatgaaaacgatttttttttttttgagatggagtctcgctctgtcgccaggctggagtgcagcagcacgatcccagctca

SEQ ID NO: 399476 - DNA, 1046 bp, Homo sapiens
ccttcctcggcctcccaatgtgcttggattacaagcatgagccaccttgcccagccgaagctggccatttaaagttcctcatgctgctgaatcaataaggatggaaggcggctactattatgggctaagtgtttgcctcctccccaaattctttttttttttttttgagatggagttttgactctagcccaggcaacagagttagactctatctcaaaaaaaaaaaaaaaaaaaaaaaaattaacactttgaacaaaaaagaaaaaaataataaaatttaaaaaagatttaacaattgggccaggcatggtggctcatgcctgtaataccagcactttgggagcctgaagacggaggattacttgaacccaggagttccagaccagcctggacaacaaagcaagactttgtttctactttaaaaaaaaaaaaaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaattatccccaacatttagcagcttaaaacaaaaaacatttattatatcacactttctgtgggtcaggaatctgggagggacttagctgggtggttctgctcagttctcttgggatgtttcagtcaagcagtggcctggggctgcactcttatctgaagactcaatcgggagaaaatatgcattcaaggtcactcattggttgttggcaggctgtagttcctcactgaatattggttgaagacttcattggcttactacctggacttctccacacactgcctgaatgtcctccccacatagctagagtgaatgaactaaaaaagagagagaacacacacagcccaggtaagagttcagtctttctaagtcattatatgaaaacgatttttttttttttgagatggagtctcgctctgtcgccaggctggagtgcagcagcacgatcccagctca

SEQ ID NO: 399477 - DNA, 362 bp, Homo sapiens
ctgccatgctgctgggtgacaagtaaaggagcaggtgctaggcaagacctcagcctcaaacatgtgtacactctgcttggagatctgagattcccagagagcagcatagtataataatccaggctccagagctggacattctgggttaaaccctactctccgctgccaactctgatcttgggcaagtcatttaacctctctgcttcctaatgcttatttataaagtggagataattgtttctactgatataagatataagtgagttaatatatctaaagtgtttagaatggtatgtaacatattctgaacactattgtattattatcatcaacactgggatcacttctttttacatgcacca

SEQ ID NO: 399478 - DNA, 409 bp, Homo sapiens
atctcattcaacaattcagagtatgggagtgtcctcttgagacttcttgcaggtgtttcctggaaacctctggctccccagcacctggccccgggctgcctgctacaaacattaatacctgtctgtgcaatgcatgcttgaaactttgtccgtgcagagtagcctggtagctcttcgttcatagctaagcttgtgtctgcctgtgtttcatctgttatccattttgatttctactctgccaagtttcactgtctgataaaatgatggccatactttctgcaaatgggcggtataaggtgcttgctggttacccagccagctgtgaaaaaaaatcagatattccaaacacaattgaattctagttcatttgtaatggttgcattttaaagtaaggaaagtttactattta

SEQ ID NO: 399479 - DNA, 652 bp, Homo sapiens
aaagcatgattctacctgaagccatcaaaagcctctttttaaatttttttctttttttaatctaagaggagaacagatgctaacagatgagatttcactggctgattcgtttgtttcagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctccggaaggtggaagcggggccgtggctcatctgcggagccagggctgcctgtcgcggacgttgctcacggtggttctttttcgtgaaagggaacgtacaaagcttaacagttttcccttccaagcagagactcagagaaagggaaagagtgagagagagcaaaggaggggggcagctgccccacagagaaatgaaatgaacacaacttcctgatgctggccagtaaaacaaaaaattaaaaataaaaataaaaagattaagcagacctgcctaaggtgggtatctgactccattccaaagtcctgcatccctagtttgcccgaactcccaaagact

SEQ ID NO: 399480 - DNA, 338 bp, Homo sapiens
ctgcaagttagtgtggtcgttaatggtccagaatctcactgctcttaagtttccaagccattcttatgattttaaactggaaggcagatcatcccctcatcatgactttctcccccatgtactcgggaaaaatgagggagagagacaagagaactttggggtgaaaactcacattgggaacaattacaagtgtgtctgatttggtagcttggatgttacaaccactcatcaattttcatgtggcttcaaagaccctcatttgaagctcctaagagcagctcacttcagaagagacccaggtaccaatttattctggagagttccagtgtttcgtccta

SEQ ID NO: 399481 - DNA, 621 bp, Homo sapiens
gggagtagagtcggaaggggcacggtaaatgaaggtgtgcccagttgctcctaaattcattctttgtcactcttgggaaaatagttcacctctgtatctttggagtgggagtgacacactacttcatttacttattgatttcatcatttattttgaagggcattatcctatcagtatggaaactgataatagcatatatttcatatgaatcacttgattaaaaatacacattgcttttgttagaatttgggtgaagttacaaaaaaagagaattaggggagctgaaaactggggcagaggaaatcgtaagcattggtaataagatcacccacctccatttatccagttacatgtcttaatatttaaagtgtatataccattcttgtctaaacataaattgataccattccgtaatcctagtttttgaaagcttaacaaccaaaaacatacatcctagctggcattcagttagtgctgtgcattctggagtattaattgaaactggtacttttgtactggaaataaaagtaatagattaggtttaaatagataatttgcttagttcatagtgatttcttctggtttttggaaattttcacagagaaagagttaaaggaaatt

SEQ ID NO: 399482 - DNA, 407 bp, Homo sapiens
tctggattccaattttctattttttttcaatgagttacatgactataatccaacatttttgtaatttcaacaaaaaacatttgaacatgcagtaaatcactggaggttaccagggaagaaaggacctgcagccttgaacaaagacggatttagaaatatgttcagcaataccagtgaatagtacaggagaatctaggataaaggaaacagactggaaaataaaccatcctagaaagaaaagttcagagaatgagaacccctggactgtctcaaaaaaaagaaaaaagaaaaaaacagaaacgcgacatgctctaaaaaggaatatttaacctggattaattcataaaataataggagaaaatttttgcagccagaatactatgaatttgagttggttgaaggtaaga

SEQ ID NO: 399483 - DNA, 627 bp, Homo sapiens
agtatttggataaagcaaaagtgctcaggagtgtgtttgcttcctgtaaatctaatttacctttgtaaattgttgggtttttccacatagacttttgttttgtatatttccacgtttgactttttagtgtagagtggtagtttttattatttatttatttatttatttatttatttatttattttgagatggagtctcgctcttgttgcccagactggcgtgcaatggcgtgatcttggcccactgcaacctaccctcccaggttcaagcgattctcctgcctcagcctcccgagtagctgagattacaggcatgcgcccccacacctggctaattttgtatttttagtagagacggggtttctccatgttggtcaggctggtctcaaactcccaacctcaggtgatccgcccaccccagcatcccaaagtgctgggattacaggagtgagtcaccatgcccagcaagtggtagcttttagtgttctagaaatcctaattgagaataatactagttattgttttgttttgttttgatttttgagacggaatcctgctgtcgaaactgaggcatagagagattaacttgctccaggatcacagcaggtagctagattctagatacact

SEQ ID NO: 399484 - DNA, 525 bp, Homo sapiens
acatgagcaatagaaaactaatatgaccatggattattaggggagagataaaatagatttcaagaaagaaaactctgctgtgatggatatgggaacactgaggaaagagaagaaagattgggtctaagaagagaaaaatgccatgccaatcaaacagaagagaatgtaagaagcaacaagttatcatccaagagaaatgaattatgcagtactaaagtaaacactgcactccacagggacacctctcattctgttccttttttcttggaagttcctgcatgatgaaccttttagaaaaccatcaataagtcccagggactgactcttgagaggatcttcatataccttctaaaacctacatttagtcatagaaaactaatgatatttatcaacaacattgtgtattaaagagcttgaccactgggcacagtaagtgtgcctgagaagaggagaactactaattgtgcttatggttttgttcttagatatacctcatgtatgaataaataaaatgtattaacagtt

SEQ ID NO: 399485 - DNA, 181 bp, Homo sapiens
acaattacggtggttattgaagtccttgtcatggatgagattacccaagggagactcagactgagacgttgtggagattaaggagccctgaggagcaccgacatttagagtaggggtaaggagaggagccagcaaagccttgaatagggaaggtcagaaggcagacagacacctggcagta

SEQ ID NO: 399486 - DNA, 425 bp, Homo sapiens
acggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatgatgagcattcttaattttcccttctgccatgcttaatcaatggctccctggaaaccactgcattcaggaaatgatagccaagtatcatggcaattgacaatcaaggaagaattttaaagaagctattaggttggtgc

SEQ ID NO: 399487 - DNA, 564 bp, Homo sapiens
ccaaagtgggagcccgggcagaggaggagcagagagcgagcgagggctgtgaggactgacagcacgctgtcacctctcacttggactttaagtccttggactatgaacattcctattttctgtctcttagacaattaactcaacctgcacttactattcttaatatataaaccccaggctctatattaacaatcatgagattacagagccttcaagcagcattgatttacccagatatattaatatttgggccaattctcaaagaaaaacaaacatattttccagaatcaagacaactcaccagaaaaaggactgagaactccttctggatgaagatacttcctaggtgcaagagagttgagttgtacgtttgaccttccccaccagctacactgccctgaacctaccaggcctgatgagtcatgtagcccagccaagaagtgagtcaaggggagacatgagtcatagacattcaatacacatggcactcccaagacacaaagacttttctacgtaaacctcactctcactgcatatccatgttctaagacttggagaatctgt

SEQ ID NO: 399488 - DNA, 296 bp, Homo sapiens
tccaacaatcaagggctctgcgttttcatattggatttttaaatacttccaatcacagcatcattacaaccacttgatttggttaaatatacatgttgaagtgtgcaatgttatgtatttgaggggcctttctaaagatcagttggagccaggcatggtggtatgtgcctgtagtcctaattactgggaaggctgaagtgggtagattgcttgaccccaggagttaaaggctgcggtgagctatgactgtaccactgtactccactgtggacaacacagcaagaccccatctctta

SEQ ID NO: 399489 - DNA, 1037 bp, Homo sapiens
  misc_feature (783)..(784): n is a, c, g, or t
tgactcacatgattacaaggtgaagtcccatgatatgctgtctgcaagctgaggaagaaggaagccaatagtggctcagtcagagttcagaagcctcaaaagcagggaagctgatagtatagccttcagtctgtggctgaaggcctgagagcccctggaaaaccactggtgtaagtccaagagtccagaagctgaagaacctggagtctgatgaccaagggcaggaagcatccagcacgggacaaagaagaaagccagaagactcagcaagccagctcatctcactttcttctgcctactttgttgtagctgagctggcagccagttggatggtgcacactcacattgaggattgggaggctgctgtgtatggataagatacctgctacagccagcttgacaccatgagaaggacaagagaattgcagagacacatatccaggattctgatccagttgaggcactgaaataatctagaaccaccttcaaatttcttataaagagagctatgctattaggatttaattaaatggatgccaacagcaagtaaaccatctccaaagatgccatgaagctctcctaattgcaggaaaatatcagaggcacttgatttgagtctttcaagtacggaaataacaaattcagtctcaacagacctatagtgaatgaggacattgagatctgctggttggagatcttagtgcccaaggaagaatgcttgcaaaaggagatggaacagtgtttctgttgcattggccactgagaatatctggttattttgannttgtcacagtctgcagctaaaaggggaacaggaacacagaagagagaaccggtaatttgaactgatagcagatttcacatcaggaaccaatgaagctagataagaatgaacatctttgatgtctaaaagaaaaaaacaggcaactttggaatactttatttagtgaagttacccttcagaaatggcggcaacataagatgttctgcataaacgaaatatgaagaatcttcaccagagtctatggtatcgaacg

SEQ ID NO: 399490 - DNA, 1141 bp, Homo sapiens
  misc_feature (887)..(888): n is a, c, g, or t
tgactcacatgattacaaggtgaagtcccatgatatgctgtctgcaagctgaggaagaaggaagccaatagtggctcagtcagagttcagaagcctcaaaagcagggaagctgatagtatagccttcagtctgtggctgaaggcctgagagcccctggaaaaccactggtgtaagtccaagagtccagaagctgaagaacctggagtctgatgaccaagggcaggaagcatccagcacgggacaaagaagaaagccagaagactcagcaagccagctcatctcactttcttctgcctactttgttgtagctgagctggcagccagttggatggtgcacactcacattgaggattgggaggctgctgtgtatggataagatacctgctacagccagcttgacaccatgagaaggacaagagaattgcagagacacatatccaggattctgatccagttgaggcactgaaataatctagaaccaccttcaaatttcttataaagagagctatgctattaggatttaattaaatggatgccaacagcaagtaaaccatctccaaagatgccatgaagctctcctaattgcaggaaaatatcagaggcacttgatttgagtctttcaagtacggaaataacaaattcagtctcaacagacctatagtgaatgagggaagatttaccacaagttactttatcatagctttgagtggcatcttaatatcatattttaaaagaaagaaaacaatagaaatgtattaaaatatcttctcaaggacattgagatctgctggttggagatcttagtgcccaaggaagaatgcttgcaaaaggagatggaacagtgtttctgttgcattggccactgagaatatctggttattttgannttgtcacagtctgcagctaaaaggggaacaggaacacagaagagagaaccggtaatttgaactgatagcagatttcacatcaggaaccaatgaagctagataagaatgaacatctttgatgtctaaaagaaaaaaacaggcaactttggaatactttatttagtgaagttacccttcagaaatggcggcaacataagatgttctgcataaacgaaatatgaagaatcttcaccagagtctatggtatcgaacg

SEQ ID NO: 399491 - DNA, 1077 bp, Homo sapiens
  misc_feature (823)..(824): n is a, c, g, or t
gctcattttgtcactctcatctcctacttgcttccagattgggaggctgctgtgtatggataagatacctgctacagccagcttgacaccatgagaaggacaagagaattgcagagacacatatccaggattctgatccagttgaggcactgaaataatctagaaccaccttcaaatttcttataaagagaggtttggttaagggtcagcaccatggatccaggaatccctggagaaaagcacaaggttgcaacctatatgatctgctaatgaggagatcatgttaaaggtgtgaagagccaatcattatatttcccacaagtccagttatatttgagagcatagagggggttcctatttctttgcagtgaaccctgatggataaagctcaatgtgtaagtgaagactttgaaaattaaaatctaattggtactgggctaatggactaaaggctggagatgtctagatgagcagagcagtgcttgttcacctgctcttcaggtggtgggtggataaacagatggctcccacttgctaggataagagctatgctattaggatttaattaaatggatgccaacagcaagtaaaccatctccaaagatgccatgaagctctcctaattgcaggaaaatatcagaggcacttgatttgagtctttcaagtacggaaataacaaattcagtctcaacagacctatagtgaatgaggacattgagatctgctggttggagatcttagtgcccaaggaagaatgcttgcaaaaggagatggaacagtgtttctgttgcattggccactgagaatatctggttattttgannttgtcacagtctgcagctaaaaggggaacaggaacacagaagagagaaccggtaatttgaactgatagcagatttcacatcaggaaccaatgaagctagataagaatgaacatctttgatgtctaaaagaaaaaaacaggcaactttggaatactttatttagtgaagttacccttcagaaatggcggcaacataagatgttctgcataaacgaaatatgaagaatcttcaccagagtctatggtatcgaacg

SEQ ID NO: 399492 - DNA, 406 bp, Homo sapiens
ttaaagtaactaataatttcctttttgatataaatgtttaattttttgaggttttaaaaaattaagcactcactttgttttgatataaaacaaaacatgcctaatttgtttttttataaaatgatattctttcaacttctaaattcacatgttagttttttgagatgatttaacaaagaataaatattgggtcactctaatatccttaacagataataaaaataatttctaagcaacactagtaaaaaccatttaggatacaaatcagcttctaagaaaacaagtttaaacaagtttctttccattccctcctcaaaacagtacgaagggtaaaagaaatttattttttgctaggcgtggtggctcacgcctgtaatcccagcactttgggaggccgaggcaggtg

SEQ ID NO: 399493 - DNA, 148 bp, Homo sapiens
tgatcttgttcttttttagcatactatttttatagtttaaataaaaactgcaaatacaagtgatgacttgcaaatgagtatgaatggaggaaaggcctgaatccagatgtatctaaaaggggtctgtagtcaggagcggtggctcaca

SEQ ID NO: 399494 - DNA, 439 bp, Homo sapiens
cagtgtagtacatcctggcattgctcttatttcacatcattcatatgataagactttttaaaaatttaaattagctctaatacaaacttagtctcttttggaaagataatacgtgatcaattatccgtgtagagtggatatgaaacagatatttaaatgttataaagaaatgttgaagggaaaacctcattgcaggtaaccacagtcatcccacaggccttgtggttctgatacccagcttgatagagcctaatgcctgttgcccactgacaatactaaatcaggctttagaactagggggttatgcctggcacagtggctcacacctgcctcggcctcccaaagtactgggattacaggcgtgagccaccacgcctggcctataaaatacatttttgacacaaaacaaatttaaattagttgtactgaaaaaaaaaaa

SEQ ID NO: 399495 - DNA, 548 bp, Homo sapiens
gactagagctcagcagcctaaaacctgaggaggaacagggcaggagctatccaggttgacagggtattggccaagggcctttcagctcattccttcctgagaatcaagaaaggcagggctagaatgcctgccccttcactcccacccctcctggttctccactgagctccctgcctgcagaatggatctgatttcttcctttcctgcgagcactatttattcctttcctgctaaggagagatatgttgaaaaagctgtctctggccaggtgtggtggctcatacctgtaatcccagcactttgggaagccgagatgggaggatcgcttgagcccaggagttcaagaccagtctgggcaacatagcaagactctctctctacaaaaaaatacaaaaaaattagcagggcttggtggtgcgtacctgttgtcccagctactctggaggctgaggtgggaggatcacttgagcccaggaatttgaggctgcattcagctatgattgcaccattgcactcctgcctgggagacagagtaagactctgtctca

SEQ ID NO: 399496 - DNA, 259 bp, Homo sapiens
gcaacaagacagaaactccatctcaaaaaaaaaaaaaagaaaagaaatcatggactccaaaaggcctgaagtggagagtcctgaagccatctcagaccatgaggccaccctaagggtagaaggaagcacactaagatgacaggaacagaagacaggagcctgggtccatcatgccagggagcctccacacctgccctggacgtttcatctcagacctcgtggataaagcagagaaataaatatctaccttgtttaagcc

SEQ ID NO: 399497 - DNA, 479 bp, Homo sapiens
ttttttttttaaggagctctacagtcagaagtcagcttaattaaaagctagttttcaatatatgtatttaatggactttctgcttcttctctttttggatcctgttttggggatttttttatttttttaggtgcccaaataacatttttaaaattacgtgtttggtccctctgtttgcttccttgttttatgaattgttttcccattaattctatttatctctactctttcttcctctttgccttttaaagtacacatgaaaggatctacagaggacgtctaatgactcaaaccccttaaggaacacacaaaaaaggcaccactcacctctcttctgccttttctgtcttcctgaggagtctaaagtcatggacagattcatctcaggtctaaaactctgctctcttttgtattacattacccgatcgctttggcttttgtgggtaccagagattactttgtactatgagagaacactt

SEQ ID NO: 399498 - DNA, 963 bp, Homo sapiens
cggttctgttgggcacttaattttccttcaaaaacttattttggcctctttcaaaaaagtagaacattgaaaagatcatcagatttatagcactaatcccaataaacttttttgggattttcattttgaagaacagcttttaaaacctactgcttaactcttaggaaatatttaatcttatttgaaactgtaacatgccctatactttgagatttgtggagagttaagctaggctttctcttttttttgcctttacaagggtaactttataacctccatttcttggcttttttctttttagtaatccctgtataattggaagaagttaggcaaattttgacattctcaaggtttaaagaaagtttagtacaatatttatttactaaccaaagtgtctcctgttctctttgtgcgaatatctgataagctgagtgattaacatactgttctactgggagtggataatggttgatatttaggtgactaaatagtccctgtaacccaaagtctggctcttccccagggaaatttaagtatacacacaatcgccatgtcttcataacattgtaacattttgtaagctatcaaaaatcagattggatttttgctaataagagcaagttgtattttgtgtgaaacttgagccattaaaatgacatttgcaggtttaatataatcatagctaacatctctcaagcactttttatgtatcagtgggcagtgtgatttagtgatttacatatactgtcagccctttctattcatgggttctgcatcagtggactctaccaaccatgggtcgaaaaaatacaataaaaagatacagtataacaactatgtacatagcattcacattgtattaggtattacaagtaatctagagatgatttacggcatacaggggggcatgcatagattttatgcagatactatgtcattttctatacgggacttgagcatctt

SEQ ID NO: 399499 - DNA, 432 bp, Homo sapiens
atacatgtgcatgaatgatactggtcatgtcctagaggatcacacatctgtagttgactttaaagctgagaaaaatgtgttcattttggaagagttaatgttttcaaatatgttatccctgggattttatacccacattaatcagtaaaagctcccaaagtgtcaggatttccatttgttaataaacaaagcaacaatgaaactttctcattttgctctagtattttttattacatattgtgtaatttttatgtcttgtttctgataagcttgtactgtcctttatgttaagatgtcctccattaatttacatggaagtaaacagtaacaacagagtcaaaggctgaaaacagttgtttcttgaagaaccagctactgccatgtgttaaaagaaactattcaaatatatgcagatacttggccaaagatgga

SEQ ID NO: 399500 - DNA, 461 bp, Homo sapiens
aactcttctgaaggcaagcattaagttgtttctctgtctttccctcacttgtgacagttttcatatatctgttggataaataaatcgcacaaagccatagcgtcaggtaggggaaatttcagattgactgcaactgactgatcttctagactaagggtatgcaaactttatgtgaagggccagataattttgttaggcttttgtggccatatggtttctgtacaactatctaactcagccatggcagtgcaaaaactagtcacagataacacatgaatgaatgaatgtgtctgtgttccaatgaaactttgcttcattttgttatgttaatttgttctacaaaaactgggttgactgaatttggcccaccagctgcagtgtgtcaatccttttctaaactcaccaggtagattaatatccagtggcatttcccaatgaaaagaaaatttaagtacttgttg

SEQ ID NO: 399501 - DNA, 406 bp, Homo sapiens
cctaatcagtaagaataaaaattcaacatctgagtcttgtgtaacaaactaaatattcaagtatgtattacataataaatgccagtttgcaaaaatatgaactcattcaaacttaaagacttaaatctggattgcactgacctgctttatgctgtgattcttactgtgctatctgcatttctcataagactaaacagatttttactttctcctcagaataattcttttgccaaaagggtcctagaatgcttgtgctgctataacagtggccaagccgaactcagaggtggaggtgggtgacaggaggaggtgagaaatttatggccttgagggtgcttaaaatggtcctaagcaatttcagagccccagggatccatgcccttgactctagaatctcaatactgat

SEQ ID NO: 399502 - DNA, 461 bp, Homo sapiens
ttcatgtatttaaagttttcagaaaagcacaaaatacaggaaaacacagcggtgaggcattatagagcatttctttatctggagactatcatttgacacctggaaaccctttatagggcccaacaaaggggttctaaactgtgatttgatcattcctggagttcatcatctatgtaaggaagccaaggtaccaaatgatactttggccatttcttctttccaatgtcattctctgaaaagcatacactggagtttttcagctatggcagtgtatacagctatactcggggtatctgaaatacttctatttaatttctttatagtacaaatcaataaaggcaaccacataagcaaatctatgttggtatgtcatcatatttatgttcattttgtatcagcatgaagagattttaattaattgtggtgcagtcataaaacaaatcaaatatgtggtgcagtca

SEQ ID NO: 399503 - DNA, 460 bp, Homo sapiens
aaagtgctggaattacaggcatgagccaccgcgcccggcctatacctacacttagataaattttcaggtatgtaacaaatgcatacaaaaagaactggaaggaaatgcgttacatgctttggggtcttggaagcatagattttactttcataattggggggaatcaaaccaaggttttcaggctgttgaccatcctaatcctcccctcaagaacttgtgggttaatgggggctttacaccagctaggaaaggacagagggtagggacgtagggtcttgagttctctctgtaatccaaggagtttatggggaattgctaagagaaaaactttagacaaattaaatttagcagagtttaattgaggaaagaacgattctagaatcagggagcccttagaaccagaataggcatggagaactctgacctgaccgtggtcaggcaacatttatggacagaaaac

SEQ ID NO: 399504 - DNA, 410 bp, Homo sapiens
aaaattaccaagcatatgatgtatggatgatcaacttttgaagaatttgaaacaattagaaattagaaaacagaagcccacatcctttgaaacccatagtgcaggtgagcccagtgtaaagacaaggattcttaaatgaggaagagggaggcagacaatctgaaccagagagatggcatctgaaaaagactccgtcagcctttgctggctttgaagatgaaaaggagccatgagccaaggaattcaggcagcctctagaagccagcaaatgcgaggaaatggattctcccctagagcctccagaaaggaattctgttcagccaacaccttgattttagcccagtgagacccattttggacttctgccctcctctggaactgtaaaataataaatttgtgttgttttaaac

SEQ ID NO: 399505 - DNA, 428 bp, Homo sapiens
gagtggttcatctcccactgggcagaacgcagggtccagggatggcccctgaccagggcgggacagtgctttgggaaaacctttggtatgtgaccacatgcacccctgtgtgtgctcagcccgagatgtcctggagtcaaagtccactggagaggctccaatccaccttcatgtccccccaggacctcaaaggtcccctgaggtcaagaagagcttgtggtgggaggagcagagggagtgaccagccccagggagaatggggcaagcagcggggctctccccagcctcctgtcccctgcctcgttttctcaggagtctcgagacattgtctgggattgcgtgatggtcatgcggcctttggatgggggctcagggtggaggagggcaggttggttgggacgggttctaaatccttctcctgcccctgt

SEQ ID NO: 399506 - DNA, 378 bp, Homo sapiens
gttttcttagggtctgatcaagggagaaaaggcaagaagacataatttccttttaacggcttctactgtgtcctgccccattttcatccttggtgatacatgagtaaaaaccctgcaaagccttgcagaggtgcattattactccacaactgactgttcagcaggaggacagtgtgtattgttgtctggaggagacatgctggaagctgatctcctcccttggaatggtcacacctgagaggtgctgtataccaactacttacacatccagtagcctccaatactggggcctcagagaggacaagcactttcagaaaagggtacacatacagtgtgaacgcgaaaaaatgtgacacagtttagggttaaagtagaaag

SEQ ID NO: 399507 - DNA, 434 bp, Homo sapiens
gggattctaagcacttcttcctcggggttgtgctctttttttccttcgttagagtagcaaagggacatggagtgtggtctttgctgctcgtgtggaagagtgctctgcctatgggtgaattcactttaggtggtgttagaactgagcactgtgcgatggagttttactcacgattcaaatgactctgttgaatgagtttttccgttatttacctgaagaatttggctgaaaataagcattttactagatgcaaagcaaaccttttccagtcatttttagattaccgtagggtatttcttcttttcctttctcttttgtgttattattaagatataacatacataccagaaaatataatacagacaggagaatgtgtctttcatgagcacacacctgatgaaaacgtgtgtcacactcagcacacctgggatact

SEQ ID NO: 399508 - DNA, 540 bp, Homo sapiens
ggctaatcttacacatttcctgcctctgacctgcaatataccatttctccaaggagccctggtttcagtaggtgggaaatggtattttcatctattggattttaagtttctgcactcatatttttaacatggagaagtacctttttcctcctgtaaatacgaattttttcctagcattccgttcatttttgtggatatcttttcttttctctctgaatatattattttcttaaaatgttttctccccttagatagttactgtttctaccaacttgagtttttcatcccatttgttttcatcatgaagatatctttcatatctttactcagctgtcaggtagtccttggttgtctgttcgtggtgcatgtctaaaagctgtgtggacactctaagccgttgagggtcacagtacactgtcgatgtcacatttcattaagggatgatctgggtggatgtttgttgggaaatctccattcttgggtatctttttatgaaatcatgtttccagaaagagccttccaatttcctgaatggggaga

SEQ ID NO: 399509 - DNA, 360 bp, Homo sapiens
gtgcgagctactgtgcctggcccgagtctctttttaactttatactgaccaaaggtgatatataaaagtattccatgataggctgggcatggtggctcacgcccgtaatcccaacactttgggaggccaaggtgggcggatcacttaggtcaggagttcgagaccagcctgaccaacatggagaaaccccatctctactaaaaatacaaaaattagtgggcatggtgctgtatgcctgtaatcccagctacttgggaaggctgaggcaggagaattgcttgaacctgggaggcggaggttgtggtgagccgagattgtgccattgtactccagcctgggcaacaagagcaaaactccgtc

SEQ ID NO: 399510 - DNA, 187 bp, Homo sapiens
cttggcctcccaaaatgctaggattacaggcatgagccaccacgcctggccaagacttggaaattttaagatagtaaacttaagagttaaaacgtacatttccaatgaatagttaattagaaaagtttattataaagcagtcatttttttctaattgttaaaagtgatatattctgaccacaaaaaa

SEQ ID NO: 399511 - DNA, 296 bp, Homo sapiens
aagtacaagatccaagtgttctcaaagaggctttcccctcctactcacccaagatttcctgatataagaatattactctctctaatgccagacctatttttttctgtgcttcttagagtacacggcaccttgtgattgccagcttccaaaataggcccaatgatcctccgccttcgtgtatttacagctttgggctactcactcccattgtaacaacattgttttaagtgtggaagaaatttgtggcatccaaatctagattataaaatattaaaagatgtgatgtccgccttact

SEQ ID NO: 399512 - DNA, 622 bp, Homo sapiens
aaccatatcatttaggcaatctcagttatatgaatctgagatacttatttgagatactcagcttctaaaaatgagcctcagagatgaaactcacacaaattcttcagtagataagctgtgattttcattttaaaatctggatgacctatatttacctagtgtaatcacctgtaattagaaatgctcgttaagtgcagtaaaccaccatggcacatgtatacctgtgtaacaaacctgtacattctgcacatgtatcccagaatttaaagtataatacaaaaaaaaaatacacattaaaaaaaagaaattcttgttaaaatgataccgtccctctcttcccactgttccactagtcagattacttttcttcacaggcatcactgcatgatcatgttgaccatttttccaccttctcatgtgcaaagctcatcccatgtgctctgttttcttgcaaatttatctcagctctcttttttgtagagttgctttctagattttttttaatgtattaaatcacagaattattgcttatatattttcagaaatatttaggcttctgttatttgtattgtgaaccctattttccatgttaattaacattctcattagcctaaatgaattt

SEQ ID NO: 399513 - DNA, 400 bp, Homo sapiens
tccactaatacttagataggttataggaaccctcctccttcccaataacatttatttgcttttttactcattcaaaaagtagaattcctgggcactgtcctagatgtcgaggatgtcagggtaaacaaaattcagatggtctctgcctttcatggttcttgtatcttatcattgtaccatattctatcaggttccttcattcactcttattcatctgtcaaatacttattgtacacttactatgtgccagaaattgttttgaaagctttgggatatgtcagtcaacaaaagaaagatttctgcttttctgggctctaacgaaggaagacggacaataagaaacatgaaaaatgagacaaattatatagtattttgaaaggtgatgagagctatacagaac

SEQ ID NO: 399514 - DNA, 287 bp, Homo sapiens
acatcttgcctggatttttgtcatctcatcctgcctgccctctaaatcacctgttctggacagtgtccctcaaatccaacactgtgatttttgtttgtttgtttgttttgttttgagacagagtatcgttcttgtcaaccagactggagtgcagtagcgcgatctcggctcactgcaacctctgcctcctgggttcaactatttgggaggcggaggttgcagtgaaccgagatggagatcgtacactgcactccagcctggtggacagagcgagactctgtctacca

SEQ ID NO: 399515 - DNA, 429 bp, Homo sapiens
gcacgagacttattaaaagggtgaggtcactctaaacatactgataaagatgtccatgttttcaattgaaaaacagccaagctgtagtagaggagtatggtgtaattgttacttgtagagaaacattattttaatctttgcataagatctggctttccaatgtggatcttagttaatactgggttatttcttgggcgtggtgttggaagggagggtgggagttttcagtttctactttgtatacttctgtatatgaattttctcattacaatcgttttacagtaaatttaaaactgcaacgtggacttgagaatgtaggcaagatttatcatcttttctttactaatgataaataccttctttggacctcagtttctttatggaatgtgctctactacttgacatttcacgttcccttttatgtaatta

SEQ ID NO: 399516 - DNA, 385 bp, Homo sapiens
aaagaagaaagaagaaagaaagagaaagaaagaaaggaaagaaggagagaaagaaggaaagaatgaaagaaaaagcaagaaagaaagaagaaagaaagaaagagagagagagaggaaggaaggaaggaaggaagaaagaagccacactttgaccatggaagatcaccaaagtaggggatgtataaggagcttttgctttttttgcacttctgattctggtgaactttatttttaacaggtatgttatagattgatgtttagcataatttatgtagccatttccctattctaagatacctagacttaatccttttcctcccgtttttataaatcacactacaaagaagaccttgtatataaaagttggctttttccctgctttggg

SEQ ID NO: 399517 - DNA, 473 bp, Homo sapiens
gcagttcagcaagccccatcctcattttcctagccctcactcaaaatggagtcgctctggttcgatggcctctgacaaatccactgagatattgtttgttatagcacctggcattattaatcctgattgacacacatttaaaaatgtgcagtggtaggactctattgtctaatttttgttttgtatactgaatttcctctttctgcttattaatttttaatttttattacctccttataatgtgctattcatgtatgctttttcaaaattttctaagtattatatgtataatttatatataggtagaatattaattgatagcaagtaagctaaaaatctcaccatatttcgattttgtttaaagaaatgtaaccagagtacacaattgcttcataatcattactgtcccaacattaaaatttaagtgtaaagggaagaaaaataaatactaaatgaattaaaataatttctgt

SEQ ID NO: 399518 - DNA, 400 bp, Homo sapiens
agaggctgctctgtgctccctggggatgaactataaggtgctttgtcatcccccacagatgcccactgaggtggttttcagcttttctccgcaaaaaccatactgtgaacagtttgtgccatatcttgagtgatttattactgggccaaggagtatacatattttataagcttgtggtattatcagcctgttttttggaaacttgtgttgttctatccagagcccagaactgtctgggaatgtccttgggccattattttcagtgtcataaagcttttgggtttttaggggtcttggttagtagatttgcttagtgttcagacaccaagctttacttctattaaaaataggcctgttgttagtcaaagatttcttagatacgacaccaaatgcatgatcc

SEQ ID NO: 399519 - DNA, 437 bp, Homo sapiens
taaatctcttatgagacttttactcatagatggctatgagtaaaactatgagtaaaaaagtctctttctttttgagatggtgtctcgctctgtcaccaggctggagtgcagtggcacgatctcggctcactgcaaccttcgcctcctgggttcaagcaattctcctgcctcagcctcccgagtagctgggactacaggcacatgccgccatgcctggctaattttttttttttttttttttttggattttagtagagatgatggggttttaccatgttgcccaggctggtctcgaactcctgagctcaggcaatctgcctgcctcagcctcccaaagtgcgaggattacaagtgtgagccactgtgcctggcctaaagtcttatttttagtaggtgttgtttttcaagctttcagaagtaatctttgttctacattc

SEQ ID NO: 399520 - DNA, 693 bp, Homo sapiens
cagtgcctgaaacagtacatgcagctggcaatccgagaaggatgtgggcctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggataatgacattttcctcagacattatgacaaagggccatgcaggaataaacttggccactcaagagcatcagtgatgtggaaccgaacacaggtggtggggattctcgtaggcttgggcatcattgccttggttacttcacccttgttactcctggcctccccatgtataatctgt

SEQ ID NO: 399521 - DNA, 531 bp, Homo sapiens
tttgaatcagattcacctgaaatactcctctaactttcttttggttagagatttatttcttgtttttaaaaaaatgacttaaaatgtgtctaatacttcccagactttaatttgcatctgtattcagtatcaaatgttttgtattttcgaggctgaaaagaaatttgtaactttttcatatgccacatactactgacttctacttttaaacagaattggatgacatctcccaattgcttgtgcctaccatatatttaaaatggttttactgagaaccacccccctgccccagggagtatccacatgtaatgatcttcctgctagatttgatgttatgccggtatatactggtatatgtaatgtatatattttttcttttcatgttagatggataatgtgcttatggtgtaaccaggtttgagggaggcatatctcatgtgactgggagaagccaatcatcatgcttatgaactacaagaggatctatactggtatattttcttggatttaataaagctttaacaatattca

SEQ ID NO: 399522 - DNA, 463 bp, Homo sapiens
ggaaagacggagagaatggaagagctcctgtccggtgtgccagcagcccggactggcggtgagcgcgagggaggctactgagaagcccggcgacggaggaacgcaggtctgctgccagggattgaggagactgaagaatgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagctatggataatgtgcttatggtgtaaccaggtttgagggaggcatatctcatgtgactgggagaagccaatcatcatgcttatgaactacaagaggatctatactggtatattttcttggatttaataaagctttaacaatattca

SEQ ID NO: 399523 - DNA, 904 bp, Homo sapiens
ggaaagacggagagaatggaagagctcctgtccggtgtgccagcagcccggactggcggtgagcgcgagggaggctactgagaagcccggcgacggaggaacgcaggtctgctgccagggattgaggagactgaagaatgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagctattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggataatgacattttcctcagacattatgacaaagggccatgcaggaataaacttggccactcaagagcatcagtgatgtggaaccgaacacaggtggtggggattctcgtaggcttgggcatcattgccttggttacttcacccttgttactcctggcctccccatgtataatctgt

SEQ ID NO: 399524 - DNA, 554 bp, Homo sapiens
ttagaaattgctccctttctcaccacaccacgcagttcaaagaaatcacttctcctaacaaagagcagcctgatctttcaggctgtaaaacacagataagcaactcgggcacagacttgggaggttcctgggtaatcaccaagccacatacatagatgggccccagtgaaaacagtgggcctaaagcacattcctttccctttctttaggcacactaagggaagctggaagcgcgtgggggagatgcctgcagctgcacgaaggtgcctgggaatgggcacagaaacactccctccccttttagcacacacagataagcagcagcgcagagcagcacaaacgaagggcctgcctgcagatcaaagaatgggtgggggcccggcgcggtggctcacgcctgcaatcccactactttgggagggtctgacaagtgaggggcccaggagctatgaccctgtggggagaccaagattggcaagagggaggctcggctcgcctcccctttccatgtgatcccacccagagctgccgccttcagctggctctctgtgccc

SEQ ID NO: 399525 - DNA, 1125 bp, Homo sapiens
tttttgaactgtggaaatcagtaaattgttgcagtactctgtactgcttcctattaagtagaagcagaatgtaacagaaaagtttttgtaaaatctctagccctctgtagaatgtgagtatactcttttggtggatctagatatgactcctttttcctgttggagagagacttcttccccttccccatttaatttttaatttaatatgtcaggttttcatgatagtacttttttgttagaagagaaatacttttcttataaccctctgtaatatagtgttccttgcctactgctctctgaaaagcaccctgtttatgatattttcattaatctgtctcctcctcaacagaatgtaagcccctatttgtcttggtttaagggtttatccttacagcatctagaacaaaagtagtcatataataaatgtttcttggttcaactaattatccctttctagctcttcccattgtttcagtgattttgatttaatttctgtttaaacaataaatgtatttgtgtggcatatttgcatgggtcaactccttacccacccctgattttttttgttgttgttattttgttttgtttttggtgcctcagctggcacctagtatttacttagcactgtgcttggtgctaaatatatagcaagagattacaatgggctttgtccctgcctttatagaacttaatatctctggaattacaaaggtccaggatatcattaacctcatgaataatctctcctcttttctatatcctggaagagatgcatatcattgccttgtgccttacattgttagtggtgtccttatcatagttaatgacatttttaaagcatacctaaaatgataagaatcttaccgatttggttttcagtcgtttttgcatatattgaattgttaaatattcagtagaatatagttatttagttttagaaatttctaactcatgtaaaaatgttttcaagaataatagttttgtattcatatttctattcagataatttcaacaaagtccaagtctttttgctgatctgtaggaattaaaaggagatttttcctctcgtttgatagaatttttcttcaatatgtaaggctctgacactgatctcagaaatgcctg

SEQ ID NO: 399526 - DNA, 438 bp, Homo sapiens
aacccagaaaccacaaataaaagatttataaattcaactacttaaaaaagctaaaatagcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgaacggagatcgcgccacagcactcccgcctgggcgacagaacgagactccgtctcaaaaaaaaaaaaaaaaaaagctaaaatatctgcacattaaaaccatcataaacagaaacactttgggaaaaatattgcaactcatggcactgaaaagtgactgatatttctgtatttatacctatctttca

SEQ ID NO: 399527 - DNA, 1122 bp, Homo sapiens
agctgtgtgtctatttctcgctgactgtccacagggcagcagcacctgcttgagaccaagcccggcgacctggcaaggtggggccccctaccgcgcaatctttgcggctggcccccggctctgagctccgagtgcagaggctgaagaggtacccgggggacacactgcctctaaccccacctatgagccgctctcctctcggaggacgaaggcaccatcagaaggtcgagattcgccctcctctcccgccacgtctacccactacctagaccgggagtctggacttgggagcgtgaactctcacccgagccggtccccttacaactggagcccgcccagcccctcagtccctccctgaagcccatgggtccccactgctccgtgcctcgtcgacccaggatggggagtgggaaggtcagcatgtgcccacagggccaggtgtccggcccagattcccaccctcagggcggcggcgcgcaaagggcgcagtccccgccgctgggcggacccgcggctccggctttcccggtgtctccagcctcggtgcccggaatcctggatctcggcctggcgctccggaagcgaggcagctccgtgccccagcagggacggggaacgcttggcttgagagatcacatttctgggtgtggagagaatgtcaatcacatatccagaatatcacctccttgggcacagccagggcatggtccattgaaaatgttcctgattgctggaagctgacggctcaccataaaagccaaaatggggacctgtcaaaaatgttttagccaaactatggcttggctcaggaagatgccaagaccaaaggctgctgaactttaagtataaacttgcatgaaaagcacattgcaggtctgagacagtggaggcttagtggtgagaacatgagctctggatagacctggcttcaagtcttggctctgtcattcaccagctgtgtgaatttgggcaaaccacttttcttctctgatgctcagttccctcacctagcaaagtgggttataatgatggcatcaactcataaggttcatgaggactgagctagataatgcaaacaacatgtttcatatacaataataaataaaaatgttggctgttata

SEQ ID NO: 399528 - DNA, 1507 bp, Homo sapiens
cgctgccgcagcctccgccgctccagccccggctcggcagcgcgtcccctccccgcctcgccgctccgctcgcgggctcgcgggctccctcgctctctcccttcccccgccgctgccggcgccgcgccgagcggagcccggccggccacgggctgcctctcccgaggtccctttcccgagggggggaggtggtgggggcgcggcgcaggcggggcggggaggagaggagagtccgggggaggcggcaaggctgcgccctcggctcccctccgatccccgcgggcccagcggccccaggccgggccggagagcgccgagccgccaggcagtggaggaagagaggaggaggacccggagtctcgccgcgggagggtgcccagggcgagggcgtgcgagggggagtgactccgcgcgcgaggggcagcagcacctgcttgagaccaagcccggcgacctggcaaggtggggccccctaccgcgcaatctttgcggctggcccccggctctgagctccgagtgcagaggctgaagaggtacccgggggacacactgcctctaaccccacctatgagccgctctcctctcggaggacgaaggcaccatcagaaggtcgagattcgccctcctctcccgccacgtctacccactacctagaccgggagtctggacttgggagcgtgaactctcacccgagccggtccccttacaactggagcccgcccagcccctcagtccctccctgaagcccatgggtccccactgctccgtgcctcgtcgacccaggatggggagtgggaaggtcagcatgtgcccacagggccaggtgtccggcccagattcccaccctcagggcggcggcgcgcaaagggcgcagtccccgccgctgggcggacccgcggctccggctttcccggtgtctccagcctcggtgcccggaatcctggatctcggcctggcgctccggaagcgaggcagctccgtgccccagcagggacggggaacgcttggcttgagagatcacatttctgggtgtggagagaatgtcaatcacatatccagaatatcacctccttgggcacagccagggcatggtccattgaaaatgttcctgattgctggaagctgacggctcaccataaaagccaaaatggggacctgtcaaaaatgttttagccaaactatggcttggctcaggaagatgccaagaccaaaggctgctgaactttaagtataaacttgcatgaaaagcacattgcaggtctgagacagtggaggcttagtggtgagaacatgagctctggatagacctggcttcaagtcttggctctgtcattcaccagctgtgtgaatttgggcaaaccacttttcttctctgatgctcagttccctcacctagcaaagtgggttataatgatggcatcaactcataaggttcatgaggactgagctagataatgcaaacaacatgtttcatatacaataataaataaaaatgttggctgttata

SEQ ID NO: 399529 - DNA, 498 bp, Homo sapiens
tgacctagcagagatctgaaggtgagcttccctagtactggcatctcacagtgaaagagcactgttcagtgggtcaagagacccagagcctactctcagttacgacacacatagtccttgtgtggcctttctgggcttgtgtcctgaactataaaatgagagggtggcactaaatgtttttttcagatctctatagaggctggaatggccacagagaatctaaatttgaaaacaaacatgtcctgagggtgtgctccaataccaccctttaatactctcctgagatgtgaaggctggaaatgagaatgccatattattgttacttgcaaacgattagtgtatctgggacatccaaaagaagtaactgaaaatttatttctttaaaaacaaaaaaaaccattacagtgcttttgtaaaaacattaatatttagaagtacgtagtggtaataaaaggaaaatagttgtaagaccttcattaaaaagaaaaacctaaaaaa

SEQ ID NO: 399530 - DNA, 2011 bp, Homo sapiens
  misc_feature (389)..(389): n is a, c, g, or t
  misc_feature (572)..(572): n is a, c, g, or t
  misc_feature (617)..(617): n is a, c, g, or t
  misc_feature (729)..(729): n is a, c, g, or t
  misc_feature (951)..(951): n is a, c, g, or t
  misc_feature (1109)..(1109): n is a, c, g, or t
  misc_feature (1400)..(1400): n is a, c, g, or t
  misc_feature (1576)..(1576): n is a, c, g, or t
  misc_feature (1902)..(1902): n is a, c, g, or t
  misc_feature (1972)..(1972): n is a, c, g, or t
tcagtaatgcagaggaggagaactaaaaatgaaggagtggctacctgggctatgtacataattgtttttcatttttatagcaacccggtaagtaggtattgttatccttatttagtgtggaaaaattgaacctaaaggatttacggtcagctacatagccaatgtgtgagggccaaaattgcacttaacttcaaaataggtctttacaccatttaaaaatcaaactaaattggatcaagtgtagataacagtagctacagggaagcatgaggtgggtgagaattagccactctccaacgtagtccctgccaggatataatgaaagcaagtttcagactaaattctccgcacacatacttttaaactgtatttattagcaaggaggcccnaagcaattcatcagtccgttctgtaaacattcatgaagtctcaagtctttattcttttaggttcttctaccaccactctgcagaaaatatattgcagtcagcttaactatattccccaataggattctactacccttaaattcagcatcaggcaccagaaatcatataatccaccagcagganacaggaccaatccagcctcaggcagcacaccaaaggcttcactcnatgactattccctgttcatacagggtcagggaagcctatttataccttgaatctcataagtagtgtctgtttttagaatttatttttctgatcaataagccattaatttcancaatgaaaactcatttctgccattcattaattcatatcttaatcaatggacagtggagttgcatttattaaccagtactatgtctgaccttcctgattagatactagctgttcactcctaaagtgtatatttctgactaccccaagggtttaataaacaaaaatctacatttgtatcatactgtttatgatgtagtaaattatacatgtcaaagcaaagganacaagcaaatccttagcccagacactagatgtagcgggagctcagctgaagactgaattactatcgcactagaattcagcaccatcttgttttgtgctttagttatctaattgcttcgtgtgttggatttggcttcttaatcagattatgaaattctnggaaagagagagttatatactgtttattcttctacaatagctagcacagtgctagatacatataggtctagaatcaatcatttttaattattaaaattcatagtaataccttacaaacacttggcccgtaggattctatagttgctttgagattctaaagtacctcagtggactacaaaccttaagaaattgcctgactgacttgagtgatggaaatggtatattttgtgtagattttctcatatcaattcacagctttgttctaacaattattaaacttcattgggatangcataaagtatgaaccataataaacaatcatgcacctcataacgatgttttggtcagctatggactgtatatgtgacagggatctcataaaattatactggagctgagaaattactactgcctagtgacatcatagcacaccaccttactcacgtgtttgtgatgatgctgttgtnaacatacctgccgcacttctggtcttataagagtatagcacatacaatcatgtatagtacatacttgacaatgatcataaatgtctgtgttacaagtttatgtatttactatgctatactttttattatttgagagagtacatcttccacttatttaaaaaaaaagttgattgtaaaacagcctcaggcaggtccttcaggaggtattccagaagaagacattgttatcatacaagatgatagctccatgcatgttattgaacctgaaaaccttccaataggacaagatgtggaggtgggacagtgatactgacaatcctggccgngcgtaggcctaagctaatgtgtgagtttatgtcttaccttttaacaaaaaggtttttttaattaaaaaanattaattaaaaaaggaaaaagtatatataataagactat

SEQ ID NO: 399531 - DNA, 443 bp, Homo sapiens
gttggattaacctccatttcagaaatgagggaagtgaggcttgcagaggtggcacgcccgagataaaggagtgactgagtggcaaagctgagacttgaaccctaaactgtcggctcccgtgttcctgtgtgccacggtgctgtgtgagaagtgggaacggtgagttccctgctgggctcagtatggaggcaaaccgctttctgcaacacattcctatgctctcggacagcttaattgacttctgtgccttaattttctcatccgtgaaagagtataataataacaacaataataataatagactagaaattggccaggcccttggtgaggactcggtgcgtgctacctctgatagatactaatatgtaggtatagtaggaacatcaatcatcaatattgttttgactcttttgacctctgataaaaaattttgaccatggact

SEQ ID NO: 399532 - DNA, 452 bp, Homo sapiens
tgctctattcctttccttggaattattatttatcttttatattattattctctcctcactttattctttctttaagccaaagggagagatgctggtatactctcacaaaaagtagaaaaagcagtaggcgcgaagtaacctgtcttcctccgcgtcccgaccctgacccagaatcttgatggcatccacttcacctccttgtgctcaggctctcgtgaagtttcacttaaagggtatcgtctttgaattcagcttagaattttacggaagtattagtgctctttctatgagtataacgctttttggtaagagttaaagataagtctgattaaagatattttttgagcgctagtatattccacgtgttcaagaaaaagccgtgaacagagcatacccccatttctaatgtaatttccattcagtgggaataaataggtaacaataaataagca

SEQ ID NO: 399533 - DNA, 638 bp, Homo sapiens
aagacacaacatttatcctaatagtcacaaataatgtgataaattctatgacatttacttaaagttgtaatcatagagatagacaaatagacggatggaacagaagataaaatatagcactgagtgcacacagacatggaatcatgatatatgatatatgtggcttgtcaggtctgacaaggaaacaatgtattgttcaacacatttctgtgggacaagtacttagccatatggaaaaaaatgaaatagaattcctacctcacgccatgtccaaagtcagtttcagagggataaagtacataaatgtgaaaaggaaaatttaaaaacttttggaagaaaacgtcttttttaaaaggttctatgattttttttaaaaaatagctaaccataaaaaaagtgtcagtaattcaacctcagcaaaatgaaaactgcattaccagagaaacttttaagaattctgtggtttagcagaaccacaaagggaattttaaagtaaggtttggtgagaaatgttatctagcatcttggtttagttgggagattccaaggtctttctctactggaatgcagactccaggagggggacgcctgttgtctgctatgtgcacagctgattcttgcttccgagaatattgcag

SEQ ID NO: 399534 - DNA, 127 bp, Homo sapiens
cctgtttacccatttgcgctcctagaatgtggcaagaagtcaatccttattcatcatttggcaccattttctggtgaggaacatcgtattctaccaatgaattagtaaaatgttggtgtttcttctc

SEQ ID NO: 399535 - DNA, 651 bp, Homo sapiens
gaaacactcactgaggtcaggagttacagactggcctcaagtgattgttagcctcccgaagttctgggattacagacgtgagccactgcgcccagcctcttggaccatttaatcaatatgtatttctttagcatgtatggggaacaactttccccttgtgagtaataaaatcgttacttataatacctactatggaagagttacagtctaatcaggcaagctgtggctagaaaccagaatgatgatttctagcttgtataatacaggaattgtagagaaggggaacaagggattgtgtgctgcagttgtcggggaaaacttgaatagtaggtgagacattaattgggggataagatttggatgttgggagagtgaggttctttggatatgttaccaaaagcacagatatgggattaaatatatgagatgtaagaatggaaagtctgggttagaaaaaatggagctgtattctgcaaaaggctttattagacttagattctaaacgctgtgttctttatttagctctttcctacatcaggcacattaacacccccacccgtctggattccggttttgtttttttgttatttaatcttggaagtgaggcgaagaaaagaaattaaacatttaattgaattcatattatatgcc

SEQ ID NO: 399536 - DNA, 267 bp, Homo sapiens
atgaagatgtatttctaattagtgctccaggcttgaaggctttgtgggttaattctatcaacctttcaaagaatagattaattcttacgttatttaaattgttctaaatctctagaaagggtagaaaacttgccagctcattctcctggggtagggttaccataatagcaacattggatgaagaaagtgtgggcttgtatatacgtgtatgtgtacaaacacatataacattttagtttcattgaaaaagatttattaatgctaaaa

SEQ ID NO: 399537 - DNA, 443 bp, Homo sapiens
agccagccaatgccagtgggttggagtccgcctaagacgggtgtgaattcctggagaaagggatggctgccatctctgcggttcagttaactcagctacttcagcctgccagctttggagaatacaggcaatccaagatgaggaatggtaccccacaatgcagcacacttcctctgccaaaaaacaggcagactgattttttgggcaggttcctgacactgttcttcctgactcggtgagacctcccaatgggggtctccaaccagcttctacaggtgtgtgcagggcagcaacaagtcagtacaccctgaggcggagcttcaagaggaacaagctggcccccatgtttgctgtttcacaggattcactggtgataacgccaggtatggaagaaactgaggccactagggtctggagtggaccccagcaaacagcaggatccc

SEQ ID NO: 399538 - DNA, 353 bp, Homo sapiens
gaagactctcactagttgcagcccttcggccttggacttcccagcctccagaactgtaagaaataaatttttttataaattgcccagtctcaggtatccagttacagcaacagaaaattgactaagacataggatcaatgctatgattaaagagttaatatatgcaagacacttaggacaagctgtacaaagtgggtgctacagaagcattagctattgcatggtggtggctgtgcgattgtactattggatagagtcaaggggtctggttctcaaccttgatctgcattaagcagctatggacaagttgcccccactgccccccaccaccaagggacagattcctcactgaa

SEQ ID NO: 399539 - DNA, 1196 bp, Homo sapiens
ggcacgaggtgacgatgaccaccttttcatatgcctgtttgccatttatgtcctctgtagcaagaggcaggacaaacagtgaggactgcaccaacactcaccgggtgacccctttgctttggaaacttactcagggtgaaaggaattccgattttaaacagcatctctttgtgtggcctgtttgaggcaccacacagagcttgctggagcagctctgttgaccgctgacccttggcctgctaactgaaacaagattcacaagtgaggctgctgccccagtttcatggatgctggcagaagacttaagatttctgaatcagagacagaagacttcatttatttgtcacagctaaagcaatggccagtgtcagtgtatttgcactggtgcctcaagccctgatgcccacggggtgatgcagagaccctatgactcccgcacatgcattgggtcaagtcacagtagaggaccactgagctgggcaccatgtggacctatagcaggcagcaggcaagccctctcctttgaggttcctccctgcaactacgaccccgaaaaatggatccagtaaagaagagtcaaggctttatagtcttggtgcacccagtaagacctgtaggagaacaggaagcctgtggaggactgtttcttccaaaagtttccaagtgttagctcttacacatgtataaacaacactgcaatttgtctccttgcaccgtacatccacgaagcagatttgcttcttgccaaattatttccctcagtgatttcaggaactgacaattcccagtcgcatataggaattttcttgcgtcttcttttcctgactaactcttgcgttgtcagacactttcatttgtgctaagctgataagtatcaaacgatgatgcaggctattcattatgtgtgtccttgattactgatgagtttgagcaattgtcatttgttggactgatcgttcaatttcctcttcggtccttggccttttcatatattttgccttttcttgtaggtgtgtccttttcaaattgatttttttggtgtttttggtatatcctgtgtactaattctttgtcatttatatgcattaataatatctcctttcactgtgtggcttgtcttctcaatttgtttttgggtttttgtttcagagaacattttataagctttaaataataaagtttatttatttttaatt

SEQ ID NO: 399540 - DNA, 484 bp, Homo sapiens
ataaaaaagtgaggagctatctgattggtcccccaagacatcttctggtgccaaaaccaatttggttgctcccagaagtgatgatgaaagtgatggtgataaaaataacaacagccaacatttattaagtacacaggggtcaggcgtggagagcctaagaaatctgcccaactgaactcagatctgtttgacttcatagtctaaggtagcacatcacatctcacagcattcttagtgatacctagaaaaatcccttgcaaaaagtagatagagatcattgggatcatgctattttttcacttaatataccacaaatatttgtcaatcaaccatttcttcacggctgcttaacatcccatcatttggaaaatccagcggtcatttcattaagggggttttctcacatgtggccatattttttttcctccctaccttctttcttcccttccgccttccttctttccaactcaagtccagctaatta

SEQ ID NO: 399541 - DNA, 409 bp, Homo sapiens
agacataagattacacaaatatctattgcatggaatggggtacacctgtatgtttttcttgacagaggttgtttagtcattccaataagggaaaaaattggtatcctataaacttacatagtttttaacatataataaaatattcaatttcattattatcaatcaagactaggaagttttgtttcgtgtttttaaatgtcttcttagggaatgttagagacatatactctgccttactcgatgctttatgaattgaagaatgaattctcctaagaataagcatccatgagaagaagaggtttctggtctttgtcccagagcatggctcgtatgtggaatctctgctctcaaaatcctccctggctgtgggttcagctggagcaggtctggggcttctacatgtgctatc

SEQ ID NO: 399542 - DNA, 374 bp, Homo sapiens
gctgtgggaaggaaagatttccacccccattttatagctgtgccaactgaggcgctcagaagcaaagggatttccttgaccaaggtcactagggagtcttctctcctagtctggtggtccggccctcagcggcctccaggcaccacacgttgggaagctctgcttgcgctgggcagagcctgcttgtttcgggtggggtgtggggaagtaggaaggggggcttctcttcctggctgagtctgctcatgcccccagggtctgactttgtttttatctgcaaaagggagtgtctcttcctgcaaacagatccctggggctcttagaccaaggtcaggggttgtgagtcccggcccagcccctccacccccctgcga

SEQ ID NO: 399543 - DNA, 293 bp, Homo sapiens
tttattgcttctcctcagcatcctccttggtttcctcctccaccaaaagagcttctagcttttccgccactttttttggcatgatcgtttttgcccgatcctttcttttctctccgatctctttcttgcattcttcaaactttgttttgaatttctgtgcattctcaatattcaggaagtggatggccagcagctctggcttggggcactcgttggcgaagtcggcgtgggtgttccagacccaggcatggtcactacccatgttgggcttcagctccattatcagcgtgaag

SEQ ID NO: 399544 - DNA, 710 bp, Homo sapiens
tcattgtaactacaacctagtttgcagggcagtttgggcagccccatatctaggcagccttccccagtactgtacgtacccacaacaaactcatcttgttgcctgtgagttacagcttattttctcctttttatctcaaagcatcgtgccaaaattatatatttgtccaattgccaagaagctacgtatatagattgtattacctaacccttgccctttcttccgaagtcttttttcaaggctcaatattaaaaatggggacaagaacacactgcacccaaggacatgcttgtggtattcagcatacctcccataaggagccacgggccacatccttcccagagctaggaaaaggcttctctccctgaggcatcctgtgccttctttggcttggtttgttaactggggggccttgttctatctactttggctgccaggaagctaatagccagggggtttaagtctgatttttggtttctttgctttctggcataaatcttttttttatcctctaagcctcttctttcttccttccttctctgcgctacctggcgctaatctttttactctagatcactgctactcaatcaaagcataatatgaggcacagataggaccttcatgtgtaattttaatttatctagtatccatatttgaaaaaattttaggtgaagttaaatattatatttgatttaaatcaatataccaaa

SEQ ID NO: 399545 - DNA, 466 bp, Homo sapiens
gagaatggagattctactcagaaagaaacaaaccctgcattcagggtccagcaccaccaagctcttcatttttcatacagtgacacagcttggtttacaggtgctggccttcccgggccagcctgctcccttcactgtcagcagtatgatgagctgtcatcctactgcctactctctaaggggccagctgaaacccatgtgggcagcagagaagcggcagccttaggagagaaccccatgctgcacctctacaggcatgtggtgatcaccagtgccaatgcccctggcctgcagaccactgtttgcctcctggatgcattgcatcaaagacattgattgaagccaggcaccgtggctcatgcctgtaaacccagcactgtgggagcgtgaggcaggaggatcacttgatgccaggcgcttgagaccagcctgggcaacatagtgagacctcatctctacaaacaac

SEQ ID NO: 399546 - DNA, 269 bp, Homo sapiens
gcatgtgtgcatgtgtttctgcatgtgcacgtgcgtttctgtgtcatgtgtgcacacgtctgttgccgtgtcacgcattgtctgttttctcctggatgaatgctgggaagcacactgaggcaccctcacacgccccggcacatttcacctcatgtcccgacaccccaccatgatcgcacccgagaaaagcagcggttctccctgagccccgtcctgtccgcctgtgtggcaatggctttatttcggtggtttgcacctgcgtcctcctg

SEQ ID NO: 399547 - DNA, 590 bp, Homo sapiens
tcctataagtacacaaagcaaaaggtccccctccaagcctcctataaaataagatccctccagatcaaactaggttccagataggctggagtgcagtggaacaatcttggctcactgcaacctctgcttcccgggttcaagcgattgtcctgactcagactcctgagtagcagagattacaggcgtgggccaccacaccggactaatttttgtatttttagtagagagaggggttcaccatattggccaagctggtctcaaccacctgacctcaagtgatctgcctgcctcagcttcccaaagtgctgggattacaggcgtgagccaccacgcccagctaaacagagttctttttgatgccgatattttactcggactccacatctaggtaggaattcatgttttcaagtacggacattgctctacacaatcctctcctttcctgatcactaaattagagtaaatcactgtcctgaagaaggtaccttgggagagtgggttggctgtcttccaccctttttgactctgcctcccttcaagcctcttctggctgtgtcaggtccagagctgcttaagactcttggtggtct

SEQ ID NO: 399548 - DNA, 1387 bp, Homo sapiens
  misc_feature (1)..(1): n is a, c, g, or t
nggctcagatgtcacagggtttctattgcctgggctggagtgtagtggcatgatcatggctcactatagccttgacttcctgggctcaagcgatccttccgcctcagcctcctgagtagctgggactacagagacggggtttcgctcttgtgaccaggctggaatgcaatggcgtgatctcggctcaccgcaacctccgacctctgggttcaagtgattctcctgcctccgcccatttcatcttattgtctcctttactgtgcaggagcttggatgtagtcccatttatttattttgagcttttgatatgatatccaaaaaaatcattgccaaggccagtgtccaggagcttttcccctgggctgtaagagttttatagtttctatttttatatttaggtcttttatccattttgagttgattttttgtgtgtaatagaagatatgggtccagtttcattcttttgcatgtggaaatctagtttattagcaccatttattgaagggattatcttttctccattgtgtcttcttggtaccctcatcaaaaattagttgacccatatgtgtttggatttgtttctggggtctctattctgtttcactggtctatgtgtctgtttgtatgccagtatcatactgttttgattactatagctttgtaatataatttcaaatcaggaagtgtgatgcccccaactttcttttcttcttcagcattgttttggttactcagggtcttttatggttactcagggtcttttatggttccacatgaattttaggattgtttcttcttttgctgtgaagaatgacattggggttttgataaggattgttgagtttctcatctttactttttttcttaaataaaactaagttagataaggtgctttgtggatagtgagtccgcttcattgctgtgctggtgaacacccttggtcagttggtgaggaggcccccaccagggtgggccaggaagagactggtgagggtgagcactgtgctttagcaagagcaaaggtccatggggtgactcgggatgagaaatgaggagcagggggcattgctgcttccttcccctctcccctccctgcatgtcccctccccctgccacatcccccaccccagcttgtcacaccccattactgcagactctagtctgctggtcttgccagagaatcctccgcaatagaggcatggggcaggggctgtattgcggaaagagagcaaacctctgcccttctctgagcctcagtgtcatctgtaaaatgatgacagggaaccaaatgatctcagagtatctggttggtgtcttgtctccctcagaaatgttgcatttagagcagtgcacacagtagacacttaataaatgccattgaccatct

SEQ ID NO: 399549 - DNA, 404 bp, Homo sapiens
caggcagcccacattggcttcattggagcagcaagtgagtgggcaagaaagagttcaagaaagatggttccaaatatatgcaagtcttagtcacctgtaacctaatatcagtagtgtcatcccatcacctttactgtgttctagtcattagaaccaaactactagttccagcccacactcaagggtatggaattacacaagggaaagaataccaggacgtaaagatcattcatgacaattttagcagtctgtctgctacaaatccttagctttccagaagtatacaaaagaattttagcccctcttcggtcatggagttatctatcaagattgagttactcaaataacctggtatattctatgatttctcatattaaacattcaatttaatgtcaataatcaaa

SEQ ID NO: 399550 - DNA, 464 bp, Homo sapiens
ctcagcctcgcaaataggtgggactgcaggcatgtgtcaccacaccaggcaaatttttgtatttttagtggaaacagggtttcaccatgttggccaagctgttgtcgaactccagacctcaagccatctgcccacctcagcttcccaaaatgctaggatttacaggcatgaggcacagcgcccagcctcttccaatggtgtgttaatgttatgtttgaattactgttgaattactatgttaatgtaatgttatgtttgaattactgttaagatattctagacactattctgtgtcacccagaatagtgtctagaatatcttgacaataattcatcaatttttaaaatgttatttgtcattgatattttgtaccatttccacctctaaggagaattcgttgtctaaatttttatgagaggaaaaatgctgcatgataatacaaattaaaagtatttatagacata

SEQ ID NO: 399551 - DNA, 803 bp, Homo sapiens
aaaagaaactaagtcaataaaagcatttacatttatttgcacactaaacacattgatttactacttattcccagttttcttatttacttatataggatccattcattcattttacaaatacagattttcagagtaagaagagagaataattcttctaaaaataaaggcattacaatagaatttgcaaatctaggtaccacgtggaaagtctcatccgttcccatatcattaactgctcattttcacactagtgacttccaagtccttattgtcagcatcctctatcttcccatctccactggagcatttccaacctcctgccaccaactcaacacattcagggagaagagggctggtctgggaccacagaaatccttgttttaatcttggaggcagtgctcagtatgaacttaatgaattgttaagtgaatttgttttttttgaaagtcaacaagtaatgtatccccaggcaattttatctgatttttgacatttagattggttttctattacttggcaaagagaatggcgtacagtcactcctctgggggttctgcatgaggaagtatccattatacatgccgttaagcagtgatcaggtagggagggaaaggcttggccacatcaactctcctttgtgaagccaacagctctcaacaaggagaatatagtgctctgtagagcagaaacatgaatagggctgagatccttcctggatgatcccaggcagaacccttaaccctcattctccaggcccacctgccctccatgggggctctgcattgctggggagagggcagcct

SEQ ID NO: 399552 - DNA, 749 bp, Homo sapiens
aaaagaaactaagtcaataaaagcatttacatttatttgcacactaaacacattgatttactacttattcccagttttcttatttacttatataggatccattcattcattttacaaatacagattttcagagtaagaagagagaataattcttctaaaaataaaggcattacaatagaatttgcaaatctaggtaccacgtggaaagtctcatccgttcccatatcattaactgctcattttcacactagtgacttccaagtccttattgtcagcatcctctatcttcccatctccactggagcatttccaacctcctgccaccaataatcttggaggcagtgctcagtatgaacttaatgaattgttaagtgaatttgttttttttgaaagtcaacaagtaatgtatccccaggcaattttatctgatttttgacatttagattggttttctattacttggcaaagagaatggcgtacagtcactcctctgggggttctgcatgaggaagtatccattatacatgccgttaagcagtgatcaggtagggagggaaaggcttggccacatcaactctcctttgtgaagccaacagctctcaacaaggagaatatagtgctctgtagagcagaaacatgaatagggctgagatccttcctggatgatcccaggcagaacccttaaccctcattctccaggcccacctgccctccatgggggctctgcattgctggggagagggcagcct

SEQ ID NO: 399553 - DNA, 391 bp, Homo sapiens
ttgaccggtgttatcgatgcactgtatcattcttatgctttgcgtcctcatagctaagatcccatatctgggtgagaacatatgatgtttggttttccattccagtgttacttaactttgagtaatcgtctccaattccatccaggttgctgtgtatccattatacatgccgttaagcagtgatcaggtagggagggaaaggcttggccacatcaactctcctttgtgaagccaacagctctcaacaaggagaatatagtgctctgtagagcagaaacatgaatagggctgagatccttcctggatgatcccaggcagaacccttaaccctcattctccaggcccacctgccctccatgggggctctgcattgctggggagagggcagcct

SEQ ID NO: 399554 - DNA, 466 bp, Homo sapiens
tatactattaatcacctgaatttttactttgtcttgtgttaatattgctaccttagatttctgtgtgttagcctttgcttagtatttttttattacttaattttcaacttttcaatttggttttacttcaaatgtatatcttgtaagcagcatataattagattttattttgttattcaatgtaatcattgtagtcttttgtgtgcttattctatttaaagatattatgattattgatgtacctgcatatatttttaccatgttacattttgatttttatttcacaactttttctcttaaagtatttttccctcctatttctcattggtgtgagaaaccattctattttcccttttatttacacaaaagaatatattttgttgctttgcaacttatagattacttatatcctttttgtaattatctataaaattttagcatacttagtaaactatgaatttcctac

SEQ ID NO: 399555 - DNA, 459 bp, Homo sapiens
ctcattttactcttaattttgaattttaagcagggtcagttttaactcataaggggtatatgataaaccagatggtaaatgagaagagagttctaagctcattgaattgactctttaagagatgaaaatgagtaggccagcaaagtggtcagatttattttaattgatggaaaccatcatggagctcaaaattaagttttccctgtattttctactttttgcgtgtgaattaataaagcagtcatgaggataattctgaatggaataaagattgccatattctaaatcagcagaaatgtgcaggtgatatatccaggagaaccaacctcatgaaagtgtgttaatatttttaatacaattttatagctaaatatcttaaatatcaggcatgaaaactaatatggcctgacagctccaaagcagtatctctcgagcacaaatgatagtttaaaaaaaaaa

SEQ ID NO: 399556 - DNA, 430 bp, Homo sapiens
cctgcctttccaatacctattcaggagcaaaaaccatgataaactccctttgcatcttttgtaagagagctagacaaacgccggagagtttctctgcagttgtgtgaccttgggtagtttcttcaactacagaaagagagttgagcagatgctccggctgccactccatcatatattggaaacagcattactttatagtaaatcatgaccacggtgtatggcaatgaagttgcatctgaagcagccggcaccctatgtgctagctggcttttagaccaggagactgtgaatctgtggtcaggatctctttagggctgctaaatatatactacccactatcactcgctggagctgcagaccctagttttagagtttcacttcttaaagaccttcatccttattaaaatggtaatatccttactgtcatcaa

SEQ ID NO: 399557 - DNA, 326 bp, Homo sapiens
gctcagaaggtcaaggctacaatgagctatgattataccactgtactagagcatctgtgacagacaaagaccttgtctcttaaaaaaacaaaaacagactaaagatgtgatgaattgctgtaatctcatgataaaacatgaataaatgaggaattgcttcttacagataggcaaacaagtggtttcttgagacagaatctacagttacatttaaaagagaaaagtataatatgtaagcaatattttaattactagctcctctaaagaggaatctagtataaatactgtaccctaaactttctagctaaaagagggtataaaacctc

SEQ ID NO: 399558 - DNA, 455 bp, Homo sapiens
attttcccccagcctgcctggcccaccctttctccagggacggtgcccagtgggccttatcttccccatgccaggtgtgatggttaatactgtcaatttaattggattgaaggatacaaagtattgatgctgggtgtgtctgagagggtgttgccaaaagagattaacactagagtcagtgggctgcggaaggcagaccccacccttcatctggtgggcaccatctaatcagctgccagcgaatgtcaaccagaaaaacgtgaaaaggagacgacaggcctcgcctcccagcctacatctttttcctgtgctggacgcttcctgccctcgaacatcggactccaagttcagctttgagactcgggctggctctccatgctcctcagcttgcagacggcctattgtgggaccttgtgatcgtgtgagttaatacttaataaactccccttcatata

SEQ ID NO: 399559 - DNA, 264 bp, Homo sapiens
ttccctgtggctaatggcttagagtgaaggatggtgggcgtgggcgtgccacgtgggctcagcgtccaccctgccccaggcacgcaggcacccatcacaccagggcccacacacaggctcccatcacaccctgccctcgaacatcggactccaagttcagctttgagactcgggctggctctccatgctcctcagcttgcagacggcctattgtgggaccttgtgatcgtgtgagttaatacttaataaactccccttcatata

SEQ ID NO: 399560 - DNA, 557 bp, Homo sapiens
ccaaaaaagcataaataatacttacttctcttaaccagaaaaataaattgcatttctccatgctatttaaaaacacttggtatgtggatttactttttcaacagagtttctctttaaacttccaaagttagtgaaaataggatgaacataactttatagaattgttaaaattagtgaaacctgaagaactacatcgttataaaattgctgaaaaggagtcattacggcttccacttggtttattaaacaaggtcttagacctaaataagcaagatcttcaccaagacacattaggttgggggcgagagacttctttttcttatctccatccctgctatggcatgtaggtttctctaaatatcagtgagctacgcaaaagtgctgatattctactgcttttaagatttccccaaacagaaattgcatgtggttccacctacagttaccaagcactagtgaaggataaataagatgcaggcacatccctacctcccacaatatggcaggtatgttaatgaaatctttgtgattcactgactatttaaatataccaggtg

SEQ ID NO: 399561 - DNA, 453 bp, Homo sapiens
aagaggagcagaagactaccaggtatcaggtgctttgggttgactatgaagagctagaaaagaaactcaatattcacccatccaaattttcaaggaaaaaaggaagaaaaacctgcatatgcacaacgtctaagacataacaaaacatgaatcactcatctgtcacgattgcctacagtacagtataaacttcatactcaccatcttgaccaaatagttgctatcctcttacttcacttggtttagcttcagagacattttctctgaggtgcagcagaaaatgtgaaagggagaactgaagcattcattgagaaactttgagctggtaacatgcaattgtgattccctaaatccttagtaaaatttacacagcactccaagtaaataagatttctaatttctccaatatctcttaaacttttcacatcatttgaataaatactttgacatgaa

SEQ ID NO: 399562 - DNA, 582 bp, Homo sapiens
ggatgctcactgaagtctgtgcctgaatgggtagaaatgtagtgacttagtcaaaagtgatgtattacaaaccaccggacactcacaaatagaggagggtcttgcttttcaaaggctacaggaatgagggattttctaatgcgatgttgaggtcctataaaaggtcactgtcttttcttttctttcctccgtttatttttatttttatttttcaatatttttttttcttttttctttttgaggtagggctctgtcgtctgggctggagtgcagtggtgtgaccatgtctcactgcaacctctgccttctgggctcaagtgatcctcccacctcagcctcctgagtagctgggactacaggcgcgcatcactacacctggctaatattttcatttttttaactttttgtagaggtgaggtcttgctatgttgtccaggctggtcttgaactcctgagctctggctttggcctcccaaagtgctgggattacaggcaagagccaatacacctgtccaaaaatgtcacttatgatggccaaaattcacagggtactggacattggaaccaggaatatagccccag

SEQ ID NO: 399563 - DNA, 622 bp, Homo sapiens
tattgtagttatgtttgttgtttgcttaagggtccttatcttatagaaatatactctggattccagcccaggcacattactagttctgtctgtggcaggaattttaacagctgtcctgcctaatcactggatataaagccaccacaaataggtatgaaaactttttaaaagctaatgcataatgcattgtacaaattcaacatgtgactaaatatcatgtactctgttagaatatatgtgaaattaaagcatcaaaactagctttggagttgaaacatacaggaagaaatcattttaatttatatatttccaagctctgctgcacctgaatattttgaaacacacaggtcacatttagcctcatgggataaatgttaacattgtcactagaattttccaacattgtcactagaatttttctggcttactagagcattccagacagaattttaaatattttcaaatattaaaatattttaaatcttctgaaatgctgttttaaatagttggaactgaaggtaatctaggaagggtgttctagcacaagaaaaatccattcccagtaaatccacgttgcggggatccctaagtgactgagctgaactgcgcgcctataaaaaaa

SEQ ID NO: 399564 - DNA, 171 bp, Homo sapiens
tgacacttgtctctaccacatttggcaatgtctgggttaatgtcttgttaatggtggaaagacgtagggtgatgcaacaaagagtaaggagagtgtgtggagaggagagaggtggcctggccctttagacagagtgttcaacaaagagttctctgaggtggtggcataaga

SEQ ID NO: 399565 - DNA, 450 bp, Homo sapiens
acaagattcttgcacaccatggagtctgtacactagtgtgtgatgactagttttatatgtcagctgggatggtgtttttggatgaaattaacatttaaatcacttaactctgagtaagcagattgccctccattatgtgtgtgagcctcatccagtcagctaaaggcctgaatagaaagaaaagaacagcttccccgagtaagagtgatttcccaacagactgcctttggactggaactgcaccatcatgccaaaaagcagaaggtaacacaagcaggagaaaaaaaaatcaatcaacagaaacagacccagaaatgacagagttgatggaatccacagatacaactttaaatatgtcaacaaggaaaaatggttatgctagactggtgcaattatgatttttttcttatttttctaaatatatgaaaattaaacaaaaagaacattaaa

SEQ ID NO: 399566 - DNA, 435 bp, Homo sapiens
gtatttctaattcacacttatatgtggtggtgttttttgaggtcatacctattaggttcccctcttggaacactcagagatttgacttctctctcccttacattacagtcacctaaactacagctgagtttcaacagagcatcaaacaagattgcctgcttctctgggttcttgctgtctcttagcctgtcagctcttctgtgcttttatgtttgaaaaacccatgttttttcccagcagaattgctccttccatttaacagcaagcatttttctctgtttagcaaatgaaaaacctaattataaatattgtattagttacctctactttgttacacattctacaatgttaagatttacgttgatcacatctatttcattggcttaaggtttaatttaaatgcacaactaccttgtagaataaattacatactta

SEQ ID NO: 399567 - DNA, 1218 bp, Homo sapiens
ctttctcataacatttttttaattaattaattttcagcgtttgttatatcagaatggacattatagcaatttccatggctgtgtcgctcctggcagattttaaagttcttccagcctgattcctctctctgtttgggtctctggcatggtgcctgctggagagtagatacttgataattatctattgggttctcaggggatctctcaaaggtggtattcaggcacccacaaggcaactcccatcacaagaaagaatggtggcctgggagtgagctgtaaggttccttcaaacatcagttcctgaagcctcttttattcattattgttgggacttgtttttatttctgtttcgttctacgtgaccccaaaatctgtatgtgaacactaggaactttatcatgggctgaggtgtatttgaagtaaactcttaactatgtctctgggatatgaaaggtgcttacattctctgttgggaatgtagagagaaggatttgcagtgtgtggcccctgggaatgtagaggcatgaatttctgtctgttttcctgctgttgaaatctgagtgctaggaacggacctcttgctctcagattggccttgaagctgaagggaacctgtccaccctctgcacagggcaagagccacgccaacaggaggaagttggagtgcatcctggcacctgccaatcggaagactgacaaacaaaaaattagtttttaattaatttaaaaaatgatcttcctacttatcagacacaatcacttttaaatatgagcagaaaaacgaactccatagccaaatgcaacattttgtgtcatactgctttacatcatctattctacctccattcactggtcaaagaagcgcagagttaagttggccagtgtggcgtggacacagccaggcgcagaccctcctgccagcgaagccagcgtgaggtctgttggctcaggggtccagtccctgggtccccgaagaggtaagccaaagacatagtgatacttggttcaattcggctccagagagtatcagatgggaaatagatgacttgttttacctggtcaaataagacatcactaaaatctaccatgactggaaattacttaatgcaaccagaggagacttcgcagtcaaattttgcttttcctaaaagacacgaaattaaatttacatgtcactgaatgctatttgaaactgtcatttccttgtatattaggggg

SEQ ID NO: 399568 - DNA, 510 bp, Homo sapiens
tcatcacaagggtcctcggaagaggaaggcacgagaggagagcaaaagatgctacattgttctctttgcaggtagaggagagggccatgagccaaggaatgtgggcattctctagagctggaaaaggtaaggaaacagtcttccaagtgcctccagaagtattgcagccctgcagacccattttagacatctgaccttcaaaaatataagataataaaactgtgttgttttaagccactaagtctgtggtaatgtattaatactgaagcaagaagaaatgaacatacccagcctctcatccatgtaaatcatcgcaaggtagaaacagcaggatgggcagagctaagcagtccagaggggtgctagttatatggccaatggggacaagtaacccgcatacttttgggacttgcagagggagaagcccctgctgccctatgcctctgctggtgcagggttgatctggccccctctgcagaagcaagccagtcccgatatctgaggatatgg

SEQ ID NO: 399569 - DNA, 527 bp, Homo sapiens
cagagttgaagtatacctgttaacaaatactcagaattcattgtagaatttttgtttttgttctcgtttttatcttgcctaaataattgttctcttccccattccctttataattttgccagtgacacacttattatgtttatttaaacttgaaaaaaacctcaagagttgtagggtaatacctcaatgtgttgtacatcctgaaaagctgttatattttcaacataagggacaatgcaggatgctgaaatcattgtatttaaactgtaaaaatgtctgccttatataattatgattttaaaatctaccctgaacttctcaaaagaaggatttgtttataatacaccgtacagtaataattttatcatttccaacagataaatggcagtgtaatcgatgagatcttgtacattcctttgtaatttgtgagcacttcatacggagagtcaagggggagggctcatctggagaattttgaatcccagtattctcccccaccccgcagagtaggttctttccccatggag

SEQ ID NO: 399570 - DNA, 565 bp, Homo sapiens
cctttacaaattataccctcctggccctttggtagtgtttttccaagaatgacttttcatgaatgcagtttgttggggctagagttctttaggtctctcatgttctagttccacacaagattcaggtgtttttcttttcttttttttttttttttttggtgaggcaaagtctcactctgttgcccaggctggagttgcaacctccacctcccaggttcaagcaattcttccgcctcagcctcccaagcagctgggactacaggtgcatgccaccatgcccagctaatttttgtattttcagtcgagacaggtttcaccatattggccaggctagtctcgaactcctgacgtcgtgatctgcctgcctcagcctcccaaagtgctgggattacaggcgtgagtcaccatgcccagccgattcagggatttttcaaaaagaaaattattaattattgtcaacatagtggaatcctaattattaaaggtggagagacttttgaagccatttaaatatttggtccctctcatgttattatttatgtaacttttaatatatttgtaaact

SEQ ID NO: 399571 - DNA, 588 bp, Homo sapiens
cgttggggtacatggcccatcatcaggcacagagtgaactgggtgaacgtggccctggtgtgtggtgctttctagcagcacgtgagccaaggaagcccagggaagccttcgcttgtgccacgtagcatagctcgtccttccagaaaatgtgagtagactcccctgagcctgataatgaaaggagagaagtcagaaagactgaccccagcactgggcagagccgagtgtgtctgatggacagcgagaggctggggcaaggaggaaagaaagaggggtcaggcctcgggaaggcagtgctgctgtgtgtgaagctgtgcggctctttattttcttctctttgcttatctgtagttttgaaattcaatagaattaaaacataatttgctttcataattatgaacaaaacatgcaagtgttactttgaaaggagaaaatagctgtgggtagagccgtctggactccagggttagaggcggagagtggaacttagtatgctccactcagcaaaacaacaggaaaggcagatggcaaaggtgcagcccagaaagcacagctgcacacactcctaacgcaaacaacaccctgcgc

SEQ ID NO: 399572 - DNA, 399 bp, Homo sapiens
aaggtggccatctacaagagggaagagagacttcaccagcaactgaccatgctggttccttgatgagacttctagcctccagaacagtgataacataaatttatgttgtttaagccacccagtctatggtattttgttaaggcagcctaagctaaagcacagttcaataataaagacacagtaatccaaatttttaagtagacaaacaagctgaatatacatttctccagagaagatatacaaacacccaataagtacaggaagcaatgctcaataatattagccattaggtaaatgcaaatcaaaaccagaacagataccacttcacacccagaggatgggtaaaatcaaaaggatagataataacacgtgttggtgaggatgtaaagaaattagagc

SEQ ID NO: 399573 - DNA, 473 bp, Homo sapiens
cattaataacttttcgaatatcctcccaatcctggctttggctaacgatttctaattgccagtggggtaaaataatatattacatgttcctctttttacatcttgtctcaatcctagattcctagaagacactgtagttttgactatacagcttaaatcatcggagcctttcttcatagtttaaacactgaaaacagtggagctttaaacaggtacaagatggcaggtgacagcattttccttcctccatgtttttcaaggctgcatgattattagggtgaagcttgtggaagtccaaggcagaaaccaagtaaaggaaaacgtagtcaagttaaaagctagtaagatgagtaagaagagtgataacagaagaccaagaagaatgcaatggatgggagtgatctagaagattcttatatcagggagaaagaccattcagttgtagagaggaaaaagagaagggtgtagttaga

SEQ ID NO: 399574 - DNA, 650 bp, Homo sapiens
ggggtacatgactgggggttgcatgtaccggtaattagaacagaacagaacaggacgggattttcacagtgcttttctatacaatgtctggaatctatagataacataactggttaggtcagggctcgatctttaaccaggtccagggtgcggcagcgctgggctgtccacctctgccttttagtttttacttcttctttctttggaggcagaaattgggcataagacaatatgaggggtggtctcctcccttaatcccagcactttgggaggccaaggaaggcggattacgaagtcaggagtttgagactagcctgaccaaaatggtgaaaccccgtctctgctaaaaatacaaaaattagtcggacatagtggcgttgtgcctgtaaccccagctactcaggaggctgagcaggagaatcgcttgaacctgggaagcagagttgcagtgagcctgagaatggaccactgcactgcaggcttgggtgacagagcaagaccctgtctccaaaaaaaaaagttatacacatgtaattattgcatgttccttcattattagttttaacaactagacttgttaatctcaatagcttaattagcatttgagtttattgctaaaattctttatgagttttaataatgaggcttgg

SEQ ID NO: 399575 - DNA, 519 bp, Homo sapiens
cagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggacgatggaggctggtggcaggggcattaatgtgtggccatggtggtctgtgtgatatggtgaaaatgcaaaggagatgaactcccaagacttttgggagacatttataggaagatgggtgctaagtaaatccaaggcagtcttttcagacagagggcttgataccactaattaggcagcttggatgagtggcaccatggaactggctggtggttttcttgtcaaaatagacacaaactcccttctctccatgtccttagaagatgtgaatttagaggtctccacattgcctgacaaagtctgttttaactgggtaaaataaaaaaaaaattaccattga

SEQ ID NO: 399576 - DNA, 385 bp, Homo sapiens
taaaaatcttgctgagtctctgaagtggaaatgaaggctctggggcctgcagctagtgtggaccgggaagttgttctcccgatttagccaggcctttgggtggtggcaaaggcacaggcattggggcattttactccaggggaaacctgtcccagaacttgtccttccccggggctggtgtgacctaaggacctgtcagccccatcatgccaggctttggccaagatggctgttgcctgacctgtggcttcccggaacctctacctgctgaagaccacatgatggaagacaggtaatgctcccttctatccctctaggcctttggccacagacgtgcacacacacacacccagaccctcagccacacacacacacacccccctcc

SEQ ID NO: 399577 - DNA, 350 bp, Homo sapiens
gcccctctggtgggcgaggacctccacgtgtgtcaccaggccaggtaactctcagcaagcccctttggtgggcgaggacctccacacgtgtcaccaggccaggtgacttttcagcaagcccctccacacgtgtcaccaggccaggtgactctcagcaagcccctccggtgggcgaggacctctgcacgtgtctccagaggccaaagcagaagaaaacgttagcacaggagtcacttgacttcaccaaacgcagccaggattgcggtttctccggctcggctgtctcagttgtttaagagagttcatgcttttgagatcaaagttaaaagaaggcctgtgcctcgcaggga

SEQ ID NO: 399578 - DNA, 414 bp, Homo sapiens
aaaagttaacctaagaacattcaaggcaacaagatagaatgatttttagagaaaatctcctggtcagatcatccaaaaatgctagataatatattcaaaatatttattgaaagcatggttgagctggcagtaaagtaagggaaacaggctgaaatgataaggatgcttgattccacaagagtaagcaaactcaacgttctcctggagggcatcctctggctcacagtaagataggtgcttggtttacaaaggttgtgtactcagaggataggagacataactgagagctcatgcagaatgggaggttgtatcagacatccatatataaatctagaacccttgaatgggacagcatacttcctgagagaactggaatgaaggaagtcatgagatgcagaaaggaatggtagacaa

SEQ ID NO: 399579 - DNA, 459 bp, Homo sapiens
catgatctacatacttctggagtactcataatgcaatgtcccttaatttgcatttgtctggtattttttcattattagtctagaattgtgggttaaggggaagaacatcagattggcaaagtgtcctccttgtatcatcatagtaggtgttacgtgatgtcaagatgactaaaatggaccaggcacggtggctcacgccctgtaatcccaggactctgggaggccgaggcgggtggatcacaaggtcaagagatccagaccatcctggccaacatggcgaaaccccgtctccaccaaaaacacaaaaattagccgggcgtggtggcgtgcaaccgcagccccagccgctcaagaggctcaggcaggagaatggcttgaacccgggaggcggaggttgcagtgagccgagattgcgccactgcactccagcctgggagacagagcaagactccatctcaa

SEQ ID NO: 399580 - DNA, 512 bp, Homo sapiens
cagtcttaagcatgcatatggccttctagattccccagaatatgtcagaactttgcaaagcccctcagacatttcattccccagccattcctactaagctttttggtgagtttattgtgtatcccttgtatcaggcagcagcagctaaaacatttgcccgtatacgttttcaacaaacatccctcaacatcaactttagcactgggcaggtttgaatcaggtgaaataaagttagcctttcaagtggggtcttctagggaaccaccagacagatgatctgtctgtgaaataataactattccttgggaatagggctttcaaagagttcaacccattcttcctcctcaagtcctggaactgttatttttcaaggttactgctgagctaggagcaacaggatgatattagggtaagttaaaataccacaatgcttactgttcttaccaagattcagccacctttcttaaataaatgctcccaattccctttagtgaatttctgaaaatctggga

SEQ ID NO: 399581 - DNA, 507 bp, Homo sapiens
cccaggctggagtgcagtggcgtgatctcggctcactggaacctccgcctcccgggttcaagtgattctcctgcctcagcctcctgagtagctgggactacaggcgtgtaccaccacgcccggctgattttttgtattttagtagagacagggtttcaccatgttggccaggatggtctcgatctcctgacctcgtgatccacccgccttggcctcccaaagtgctgggattacaggcatgagccaccgtgcccggcctgcatccattatttcttatcagatattctgcgttctcttctttttgctcgctgccattgccttactctccaggctgcttcatctcatagactattgtcacagccatgtcaacttccccagcccacatatgcttacttcttttttttttttttttttttgagccggagtctggctctgtctcccatgctggagtgcagtgctacaatctcggctcactgcagcctccacctcctgggttttacgccattc

SEQ ID NO: 399582 - DNA, 211 bp, Homo sapiens
agcaaggctcagaaagatcaagtggcgtgcccagctggacacagactattaaatggggcggcgacgacgaccccagggcttcctcactctctcaggcagtacaggacagtgattaaacgcgtcgaccacattgcctgggtttgaatcctgccgctgcttttgagtagctccttgagcttggacaagtttcttagcttttctgtacctgttt

SEQ ID NO: 399583 - DNA, 335 bp, Homo sapiens
gtaatattctttgagttatcttgcaaggctagcctccataggagaaaatttctttagtgaagcctcatgggaaagctcatttaggcagatgtttctatgcttctgctatgtttgatttgaatactgctttagattataagcagtttgaaatcagaagatctcaaaccacaggttaaaaatatttggagaaattgaaaaattattataataaattacaaagactccattacaaaaaaaaaaccatttcttgggttggatgggctctgttccctggttttgttaaaatcacaccatgtacacataatttacagataaaactgttattaatttacaga

SEQ ID NO: 399584 - DNA, 213 bp, Homo sapiens
taattcattggctggaactcagtcactaggggaagggaacccaagaagagagcagcatgaattctggtgaacacctagtaagctctgtcacagcagggcaagtgcagagcattgtagcaacatatataggggcacccaagactctaagggacagacagccttgaaaaacttttgaaggaagcgatgcctaaaccagggctcagcaaacaatgg

SEQ ID NO: 399585 - DNA, 662 bp, Homo sapiens
  misc_feature (34)..(34): n is a, c, g, or t
  misc_feature (64)..(64): n is a, c, g, or t
aagcaatcctcttacctcagcctccaagtgctgngactacaggcacatgcccaacatgcctggntattttatttcattttttttgagacagagtctcactgtgttgcccaggctggtgtgcaatggcatgatctcggctcactgcaacctctgcctcccaggttcaagtgattctcgtgcctcagactcccgagtagctgagattacaggcatgcgacactacacccagcgaattttttggatttttagtagaaatggggtttcaccatgttgaccaggctggtctcgaactgctgaccttaggtgatcctcccagctcggcctcccaaagtgctgggattacaggcatgagccaccgtgccggccttttctttctttttaaaacagaagcactgtataacttttattttgcatatgtccacaaatgcttacacaacatacagtggctacatctaaaactttgagcattttttcatagtgcaaagagacagaaaggtagtgacacacttcactgtgttacactgactttgggtagagccctaaaggcagcacgcacttcagaggtagggctgagtattgctcacactcaggtctggaagatttaattttagaaatttttaaacttagtgaaaatataagttccgagagcagagatcttgtct

SEQ ID NO: 399586 - DNA, 472 bp, Homo sapiens
catgaaactagactcagagtagtttctgagtcactctgagtgtctacttatctgtaagttcaaggatattccaaaatatgctttccaagagacagtctccctaaaaatgtccctctggctttacaccacaaaaatcaccctagcagtaaagaacaatagaaaccatttccacccacagtgataacctccacgtaggtgcagtttcagcaccagccaaatggcagcaacactcttcactacagcttcccttgccatcagttgtctcaccagggcgtgcatgtggtgcttttatatccccgcagtgtttaacccaatatccacgtggtagagactcagtagttgcctctcaagtgggaattagacttcaaagactctgattaaatcctagagcaggggtcagcagactatagcctgtggagccaactccggtctgtttttatgaatatctgactctttttgtaaataaagtttt

SEQ ID NO: 399587 - DNA, 280 bp, Homo sapiens
ttaaacagtgggagatcaggcagtggtgcttccagaaaggtggactattgccatagtgtggaagaatgacagggtccacgtggcaacacagagctaggagaacacccgtctctcctcctggctctgtgttatgttgggcatgagatgacgaacaggactcccagagcaggaggatgcagggagttaacttccagaacacactgtggaagagagagggagtaggaggttgggagtaggataggccagagtgaaattggaaatcttattattttcacctcca

SEQ ID NO: 399588 - DNA, 372 bp, Homo sapiens
cggcctcccaaagtgctggggttgcaggtgtgcgccaccgcgcccggccaccaccttaaccctttttaagtgcacaggtcagtggttcaagcacattcgccttgttgtgcagccatcaccagcatccatctccagagctgttttctgtcttcccaaactgaaaccctgtcccctttaaacactcccgattcccctctcccagcccctggctattgtactttctgtctctatgaatttaattaccctaggaaccccgtatgagtggaatcatacaatatctgtcctttagtctggcttattcactcagcataatgtcctcagggtttgtccatatcacagcggctggcagaatttccttcctcttcggggctg

SEQ ID NO: 399589 - DNA, 264 bp, Homo sapiens
aactcctgaccttgtgattcacctgcctcggcctcccaaagtgctgggattacaggtgtgagccatcgtgcccagccttttccctttctttcttggagagaaatgatagcatctgaggaggcaggagcgaggggtgtcttgtggaggtgggtagtgatggcagcctgctctgtaactgaacatgcagggcaacgtggggagaggggtgctgcatggatgggggcagtggtgtttctagtgtgtgaggaagcagagcagaggatg

SEQ ID NO: 399590 - DNA, 522 bp, Homo sapiens
atgtccaaggcgggaacgtggcttcgcgcgcaactctctgagacgcgggccggctcacgtgtccgggccgcaccacgaaaacaacagccacaggggagaacaacctcttgttttcctcatacagccgagctttgctgcaaacgatccctttccttttgtttccacattgcgttattcagaagtggttatgcggcgccaaacacgcgctttctgccccacaggtttcagccttccccaccctcatcttccccgcgctcccctcccgtcgttgtagcttcctgctcgcccctctcatctcagccaaccctgctgagctttcgcgtgggcgtcacgagtttctaggcagatcaggaaaatccgctctccggccgcaccctcgcgcgcccccgcctggcggtgtagaacaaacggtctgagcgcttggcgggcgactgagagcggagcgggcgaggccgaggagcggaggctgaagccgtgaggagcggcccggcgagggcgaggggcgtgcgagcgggcggccgc

SEQ ID NO: 399591 - DNA, 462 bp, Homo sapiens
gggaagaggagccagtgtaaaagcctgctcgacttgggtggtcagggctgaggctgcccccaatttgcctcattgctgatgcatgcgagtgcgacattcccagcgataatgttgttcctaatcaatctgcccttatttacatttgtaagcattgtcggctttaatatgcatgccctgtgcaggggactgctgtgccacaccgggtttgttaacttcaactaaccacaaggattccacagatctgagatgcagactggggcagccagacctgctaaggtgtcctccgggaagacagtccctttaaatggcccttctgcctctggcaccccttgtgacagttaccaaataaaaataagtgagaacttggggccttatcagccagcaggagttgccagcctttatgaagcaacagctgagtgttccatttcccctttccaagtaaagttcatctcaatgcataaa

SEQ ID NO: 399592 - DNA, 424 bp, Homo sapiens
taatccccgacccaccaacattacaaaataacagggatttggaactgtattgctgtccagaaaacagatttagagaaaaatttccctgaaattagccctagcagaggtggcagagttgactaattcatctctcctttcttcgagtgtcctttgtttgcctgtttgcttgggaagggtagttgatgtttactgctaaccactatctgccttaaagaaatcctgcaaaataattaacttcacaatttactgatgacagaaactatttcatgtgacttggataaaagtgattatgtttctgtttttctaaaaacacaggagagatgttaaattataataaccttggacagcagtattacttttaacaggaatatattatacataagctgcagtgaaagaataattacctcatatgttcatatgaata

SEQ ID NO: 399593 - DNA, 389 bp, Homo sapiens
ttatcatgactcagcccatcatcttagttttgaaagtggaactcgcaacactgctgtccccagttgtgtacttgtctttgtcttcaccctggaagtggactacttacctgtgagctgtactggccatctccagatgtgggactcggacacagcacggacaggcttttgtgtaggggtgtggcttctcttccgttgtttgggattagccctgcatttaattagggtctttgtaagtgttctagaggcttttcttagaaatccttctcacacctagctttgctttgctttttcttttcttttcttttttcttggtaactcacagaacaacaccattgcactccagcctgggtgacagagcgagactccgtctcataaataaataaataaat

SEQ ID NO: 399594 - DNA, 507 bp, Homo sapiens
gccaattaataatatgttttggtctgggggatgcttgggaaggccccattgttcaaaatatctctttcaggaacctggaacaccaccatttgagactcacttctttaggtcttgagggctttttggtctttgagatgcttttgtgtaaagttaatgcacctccagtgccctctgaacaaaggccggtgaacgtggactaagcttccctggccatccttgtctcctgcagcttaccctcctccccgccccaacctgaaggagtagctccctccccgttgagagctccatggctacgcctaatttacatcaccctccccaagctggaggagtagttccctccccatcccagagctccatggctttgcctaatttacatgaccctccccacgctggaggagtagttccttccccgtcccagagctccatggctatgcctcacttgcctcactgggcccaagctgtcctggaagggaggaagctgcggatgtgtctgttcccttccttggg

SEQ ID NO: 399595 - DNA, 123 bp, Homo sapiens
cagattcttgaattataatagctatatgtggatataagttaaaatgttacaaccaacttcctttaccagaatttcactcatttctcagtttttatttacataaatattaactctagaaggtga

SEQ ID NO: 399596 - DNA, 531 bp, Homo sapiens
ttctactcccttggggctccccagttgggcagaggtgcctggaaggttgctcctgcccagtttgaatcctggccagctaccacagggagtggtcaggggtccactagggactggagctcatgcattccttagcacaacttcccaatcaacccctgcgtgcccaggtcacagacggagtcagacctggccctcagagaggagataaggagaggtggaggtgcttagagctcccctggcccatctcaggggttggggaggggcttgtgtagagggagggcattcgggcaggatagaggaggcagccctccctgggggtctggggtcgcctccaggagaggcactgctccattccccactgcaccctccaggcccactccctgccctgtggcgaggacagctgtagggggaggggaggggcagcgccgtgtcaggacccccaccccctcctccaaagcaggaaaatccctctccgttagtatcacattgttgagaattaactttgttgaaataaaaattggtcgtggtattaac

SEQ ID NO: 399597 - DNA, 463 bp, Homo sapiens
agtgtgaagaatttaaatgaaaatatgcccgtgatgacttaagggtcagcctgcttgagggaaacatgttatgctttgttttaaattgattttaaatccatctgaatgttggtactcattataatggtacagatcacaaaggaccatttaataggcttcctgcttgatagatttaattaaatttgagacacatgtgatatagacaataccaagattcagttttagttactgtagcatgtcagtttatctcattcatacaacaaacattgaatacctagtacgtgccagataaagagctaaattctgggaatgaagatgaggccagtttcacacagtataggaaaaaggtcagacctgggaattagcagttaacaaattcgttaagtgctaaagtagaaatataaagagtcctgcaggaatactgaagacagaaaaactaattccactagaaaagtaaaaaaaa

SEQ ID NO: 399598 - DNA, 476 bp, Homo sapiens
aaaatgttttctctctggggctttcatatgtctgttctatgtgaatgtcgctttgccatggctccctctttgctaactcttcctaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaac

SEQ ID NO: 399599 - DNA, 332 bp, Homo sapiens
attacaggggtgagccaccatgcccggcctcatacaatatttttgaatgagctggattcaaacattttctctgtaggaatggtgaaaatgtcattatcaggaaaatgatctagcagtattatctataatacagccaccacgcccacccctgaagtattttctttaatgaacagctctgtcatgactatagcttttctgtataatttaaaaaattactacaaaaattaacattgttttcttcttggcttttcctcccacatctctgaagttcctgtctggtcctctgccctagcagccttaaatttcctacccagctttctgaccgtagtttc

SEQ ID NO: 399600 - DNA, 756 bp, Homo sapiens
atgcacaaaataagcctggctgtggaaatgcttatttgttgggagggtgcttgtttggatcgatgatgagaataattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaacaaatgaaaaaatgaaaaagtttcagtcaagaaaggtcaaggaactgtgatgtatagtgaaggcagggaacactgcatgcctgtattaaatattgacaaaggaaccaattttagtgctttgttatttttactgttgagtattttctgagaccatttctttttcttctattttgttttgctgaggtagaggagggctggaatgaggtcctccacttcagaaaataggggtgagtagttaaaccaacatcctttggaattcatatacgtcatgcgttccatgccacatcctgagatctttttgttgatttttttagtggcttactggataatatctaaatactgtatattttactttggtgagtctctccaccttcatttctgaatc

SEQ ID NO: 399601 - DNA, 352 bp, Homo sapiens
aagtgaacagaactgtgtctggcatgtgctaatctagcctagactgtgagtgaggtcgggaagctggagccctcttgtactttactgtttcattgctcaccagctcccttccaacccttaactgagtctcatgttaaagagaaaagcttcagagttgtgtgatctatattagaatcttcatcgagattctctgtgctgtgtaatttcacctgctgagattctggctatgtgcatagtcagggaaatctttgtcttccttttctttccatcctcttcctcctcatcagccatctcttctacctttttgccctttcgttaggttataacttggagcacatacagccagaggaca

SEQ ID NO: 399602 - DNA, 227 bp, Homo sapiens
agaagagtctggcatacgtgagcgcgctacaaacattagctaccgtggtccaagtgatccacagcacctctgacagtgtccactgaaccatgtgcttctgatccagccagggctcccaatttcataggtcgcattctcaaaaccgacgttggctgaagcgtcaaagttgacttagtgagtccaccaagaggagcaactgggccaccggggttcagttaaaggaagca

SEQ ID NO: 399603 - DNA, 683 bp, Homo sapiens
gtgagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttcttgaattttaatagtaactccaattcagtaaatgctatcactgtttaccccttctaaagatatgattagacttcgttagtaatgttcaacttttcacaaagatggtgagtgcc

SEQ ID NO: 399604 - DNA, 604 bp, Homo sapiens
agagtataagaataaaacctttgatgattgaacggattatcctcaggataacatctgtgattcttcatgagagttatgtcttcttaaacccttggaagctgtcaacactacagatttcccaaagcaccaagctgcaaacagcagattgctctcaagcaatgatgctgaagcatgaagcaagaatcatgttaccatatcagtgttttcactgctctgaacccagcacctagcacagctcctgatagagctgtgtcaaacatgacagaactcctgatagagctgagagtcaacatgtccgttcaatgagtgaataggagtgggctatcccaatgcaaatttcaaagctctcagcaagacaaggtggagatgaattaccatgtgcatggagagaagccatggcccaaggatgggaattgcagatctggaggctgaagccccgcattggcatcctggctctactcccactggttctgtcaccctgggcaaggcacttctcccaagctgcagttccgccaactgagaagcagagacaatgacacttgttccgctcaccttgcagggttgttgtgagaaggaaataaagtatttggaagcactttataaa

SEQ ID NO: 399605 - DNA, 476 bp, Homo sapiens
aagttagataatccagagctatgctttgaacatatgcttattaaatatccaggtgaatattgagtaggtagttgaatatatgaatcttgagttcaggtgagaactctaggttgattattaatttggaatgaatcagcatatagatgtttgtatttaaagctaacacccagggtgagtgtagcttataaaaatattaataagaggcaaaatgctgagcattccaatattaagaaaaaggggttatagaaagaaaccaatgaaggagactagaagttatggtttgtgatatagaagtagaatcaacagaaagagcatggaagctaactgaagaaaagattttgatgaggagtaagtgatgaactgggtcatcatatactatggctatgttaagaaagaggagatctgagaaggaggaccttgacaaggttgtttaagtgaagtaattgtgactaaagtccaactggattgcattcaac

SEQ ID NO: 399606 - DNA, 175 bp, Homo sapiens
ttttgtgttaaactgtatgaagatcttagaaatgtaaaaatttaatcacttactgtcccaccatatgattgactccaatccccctgggagttaagtaagaaaaatcttgtaaattaaattatcattaaaagacttgtttcttttctaagttaagtaaactaacacaaagatcact

SEQ ID NO: 399607 - DNA, 357 bp, Homo sapiens
gtgtgccaggcatgtcgttaagcactctccatgtaccttcctactcagccttaccctgaaccttgtacgtgaaagatatgctagggttatctctgtttttagatactgaaatcagctaagagagtttaacttgttaaagggtgccttcttgggaaacttgagaacctaatggtaatgactcatgacttagctatggaaagggctgctcaaaattatctaaactagtgatctctatttttttttaaatttcactatgaaatcccctcccccccttttttaaaaaaaacaatcagaggccaaaatccaatatatgggacatcctggcactgctctgtttggaggagttagaaccccctt

SEQ ID NO: 399608 - DNA, 555 bp, Homo sapiens
ccatttcagagtttcttattggtctgttcagggaatcagtttcttcctggtttagtcttgggagggtgtatgtgtccagtaatttatccatttattctaaattttctagtttgtgtgcatagaggcattgatagtattttctgatggttacctgtatttctgtgggctcagtggtaacattccgtttgtcatttctaattaagtttattggatcctctgtcttttcttcttaataaacctacctagcagtctatctgattaattttctcaaaaaaacagcttctggattcattggtcttttgaatggtttttcataactcctgagctcaagtgatccacccacctcggcctcccaaagtgctaggattacaggtgtgagccaccctgctcagccctagaaaaagttttttattgataatattaaacaatttatagattggtaatattagagggaacctgtaaaaatataaaagatagaaaacattgaagaatgagaaacgcttctttcctcctttacctttttaggtctggaaggatggtgtttaaaaaataaga

SEQ ID NO: 399609 - DNA, 456 bp, Homo sapiens
gtgccattgaaatgtcagatgtcaccgtcttcatcagcactcttggaattttggccaaagtggcttcttcttttgctgagacttgactcactcccggcagagggatgatagcggccttgccccgagcgtttatccggctgcaggcgtcattcttggtcgcctgtgtgtccagagccccagcgcaggaagggagcgcaattcccaccgcgcccgctgggtggcgctagcgccgcaccgtgtcccgggatgaggggaaaccgcgctgcccagtcagtaccccgacgcccccgcgcccccgccgggccccgcgcgctgcagccaccgcctcttctcggcttcctcttgctttacagtaactctcctcctggggaaaaggcttttcacggagcaggctcggagcctacggggctggcctcggactggatgggggtaaggacgggtggcggcgctcgcgcc

SEQ ID NO: 399610 - DNA, 352 bp, Homo sapiens
cccccctttctccacatcctcgtcagtacctgcagttccccgtcttacaaatgctagccatcctggtgggtgtgcagcactgtctcactgcagctttcacttgcacctccctgaagactcacgacattgagtgtctttccatgtgtctgttgcccgtttgtcttctttggagaaatgtctgttcagagcctttgtccatattttaattgggttgtctttttattgaattgtaggagttcttaggcgagtcccttatcagcgatggaacttgcagatattgtctcttgttctttgggctgtcctttcactctcttgatgccatcctttgaaatagaaaaggttttcatcttga

SEQ ID NO: 399611 - DNA, 407 bp, Homo sapiens
tcaccatgttagccaggatggtctagatctcctgacctcatgatccacccaccttggcctcccaaagtgctgggattacaggcgtgagccaccgcgcctggatactctagcgacatttaaggcaacgggagatggtatagaagtccctggggccagcacatacacccaggggctttgaaaatccaccctagtaggtttcttcaagacccaacaggtgctttggctgctagaaactcaacatggcatcatgaacaattggataggatgagagagctatgaaggagagaacttaagcgtcataaaacgttccatgaaaaagctcaggtgaaaaaagaatgagggtcactgcagtggagcgatttcaaaagcaggtggaaagcctaagtgttaatggcaggaggtcaggg

SEQ ID NO: 399612 - DNA, 347 bp, Homo sapiens
cagaagagatgaattcttaagatatttttctgaaggttgcccagggcacaaacaaattggacactttcactgctaaaaagtacactttaatattcttaaagtataatttctttagagcagtatccctattgctggcaagttctgctttcataaaatatgcagataagaagtgttaaatgggattcaagaattatggttttatttgggactgtttgcatactcacaatggttttgttctcattgtttttaacaaaaaagcaatgaagtttggggtggttttttgaaaacgaaactgaaaaaaattatatgtgaaaatgagaactgggtaaataaaattatattttgca

SEQ ID NO: 399613 - DNA, 552 bp, Homo sapiens
ccattctggtggcccaatctcatataatcacttgaaaggaatagcacactgactaatcaaagccatcagctcatcagccactgttccggaatcgaggtccacccatggactcccagaagaaccccttaagtattagtactggaactcctctatgcacttgatccacataaagtacgtgtgtgtgggcagggagggcttgtagaggatcagaaagtgccttacaggagagaaacagagaccaagactagggaaccctttctgctggaggggcatctagacattttgaagaaacacacgaaagaatagagcccctgaggtcacatccagatttcagtttctcttcgggagtctaagagactgttgtgagcccagattttcacattttcttcctctggctgaaatggttggatttagacagtgtggaggcaaacttactgtatggattaataacttttgtgcaagtaacagatatttgtctagccttccttaagtcaaataagaatgtatcataagagtgtagagatatctaataaaaatccaagggcagaaata

SEQ ID NO: 399614 - DNA, 657 bp, Homo sapiens
ctctataactaactctataactctataaatctatgactctataactctataactaactctataactctataaatctatgactctataactctataactaactctataattctataactctataacaactctataactctataactccataactctaactctataactctatgactctataactctatgattctaactctataactaactctataactccatgactctataactctataactaactctataactctataactcggacttcccaccctgcctggagcaggtgggtaaacatttctgagcacacctctgagtggggccctgggcgagtgggccgtgggggtctctgcagttaaccattggtgtaacttgcttctctggattccattttctgaatttaggaaatgaagactcgatgaactcaatggtctcttctgtttacataaactcagtcacgtagaagcagaaccgccagacatgaaacaaaagcccaaagtgacagattttgaaataaaaccaacgaatgagaggatgtggttttccatttgaaaagtgagctccttggagctccttggttgttgatttttcctcccctctcttgttctttccatgcctttctttcattcctgccaacttcctgaatcgaattcgtg

SEQ ID NO: 399615 - DNA, 446 bp, Homo sapiens
ttaatttaatttttatttatttttatttttatttttttgagacagagtctcactctgtcacccaggctggagtgcagtggtgcaatattggctcactgcaacctctgcctcctgggttcaagcgattctcctgcctcagctttccaagtagctgggattacaccacacctggctcatttttgtatttttagtagagatggggtttcgccatgttgaccaggctggtctcaaactcctgacctcacgtgatccacctgcctcggcctcccaaaatgctgggattacaggcgtgagccactgcacctggcctagaatccaagttaaaattaaagagggacacacaaaaccattttaaacacagaagcagaaaaccaaatattttgacgatgttaactacagacagaccctccacacacctacatccactggcagaacttcacgttcta

SEQ ID NO: 399616 - DNA, 448 bp, Homo sapiens
caaatgactattgataaagaatttattttctgtcacctttaaggagagcagagggtggtacagcctttgtattattttttcttttttaaaaaaagtttgtttgaagcctccttcatgaaaacttcagctgtcaaatcttggcaaaaaatgtgtgttcatctatatgatagttcttaggagaatcaatagctatatttttctttcttttttttctaccagagaagaaacttcagaaacagcattaagaaagttttgtgtgcagtcttttagcagcaactttttggagtcacagaacatgtatacattattgtatgtattgcctgaattgaatcgagatttataggcagttttagaaaatagctcctcttgcctttgtactgttactcatatggtatataccctgcgtgccaagttttctcttttccctctacctgcacaccaacccata

SEQ ID NO: 399617 - DNA, 241 bp, Homo sapiens
ctttttttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgcagataatg

SEQ ID NO: 399618 - DNA, 402 bp, Homo sapiens
ttagtctcacaattctctgcatccatcatcacatacctgacgggatgtttcacacactatcaggatttgagtatgtgttgcgctgatttacaaagagttaacactaaaactgaaataaacacttagaaaatatcaatggcctactatagtttatactgaaagacactaatagagggggttaaatgctgttttatgttttcccagtaagtaagattaaagaaaaaaattttaaggaaatgttaagtagggacacaggcgatgctcagtgcttttctcctgtttctaaactagtatggaaagcagaaagccccccgagtttctcccaactaaaacgctaatttgcatttgaagtcatttgattcagacagactggcaccaaatttttagagggaaaaaaactag

SEQ ID NO: 399619 - DNA, 334 bp, Homo sapiens
agagtcaagggcaaggtggcccagcccgggctgggaggcgcgggctgggcgcagccgagcatttcctccgggaggcccagacagcgggcgggtggggcgcggtgggcggggtcctcgcagctggtggcgtttgaagcccccccgaccgcggtgggagaggggcagcctagaagagttggcagcgggcctgcggcgggatggggaggaaggggccccgcgttccctcagcagcggcgccggccgccctggcacgtagttcgcttctggaggcacaggccgcggtgggcgcgccacccgggctgccaggctcaccgccagccgaggccagtcctgc

SEQ ID NO: 399620 - DNA, 505 bp, Homo sapiens
gacaaccactaatgtggaaaaaaacaaaacaaaacaaaaacactccaatatgcaatacaacttcacagctagctcagaactagttctctgcaggtctcataatttataataatttctgcttggaagccagaaggcccgttcctttattgtcaccatagccgaaaagcgtaatcttcaaggcctgattcatccttacctcctccaggaagccttctctgcctgttccagcctatttttctgtccccttattgtacttcctgccagtgcttgcatccctgctttgactcatatccctttggcccttctctcatatcccttgtgcccttctcctttcctttcctgagcctccaccacactccaaattgaatactctaaaaggtttagccctgcatgtggtagaggtgctttgaaagggttttttaggagacagtctaggagatgacccatcctgtgcatgtctactcaccaaaccctgttttataattgcctgcccatttgtatgtct

SEQ ID NO: 399621 - DNA, 412 bp, Homo sapiens
ttgcccaatatgggtcaggagaccctcatccatctttggcatgcacgtactggcatcatgtccaagactgctgtgtaaggggaggagataaatgaggagacacaacaactattaactcccatattctgggaagtgacgtgtatcatttctactcattggccagaaatggtcagctggccctaaggtaatgcagaaagatttggaaaattaggggagtaaatgaaatatttggaacactttcaatccaagcagttcttaatgtttcccccactatcatgctagcccattccaccacctttgcctgaaatactgcaagtatcctaattaatcttccttatcctaatcatgctccaatatgatctattccttcttccattcttgctacctccaactttttgttttccaactatca

SEQ ID NO: 399622 - DNA, 1384 bp, Homo sapiens
caaatatggaaaattctgatgtttaagcagaattagttatatttcaggtagatggatttgaatctttcaaaaccccacatgaggtaagtatatttcttcagccctgcttttcagcaaatagtgggactgcagagcaggctgacatttgtcttagctacccaagaaggaccaaaattgccttcctgttaggttttgcctgcatgtttagttatgagacagcctgagaccctgtttttctttcgtattagctgacctcggtattaacctcaccttccctcctccccttctttttttggtttctggttttccttttcaatttgttacaagtacgcttaaagcacgaaggcgttgcagttgttagagattattttgttctctggcggtttcagttatcttgactttaagctttcttcctcttagacaaataatataggcagctgtcatatctgagggttttaaattcttgttaaccttttaacttattgtgattaagatgaatttgaaaagaaagccatttcctctatttaagaattgccttggcaagaagttggaaatcctagaaccttgttgcaaaggaatgtgtcgctatttgttatgaatgagtctggttgggtccagtgaaaccttcctattgctaatgtgcaattaggtatcttcagtgagggagagactgtcctctaagcaaagcagctaaagctccaggggcaaagggcagagcgaataagcaggggcctgggtcatctattttgttctctggcctgaaagcatttgactgctcatctcacatcccttctttgccctcagtcgttagatattaggtctactgtggttgaatgagactgtctacaaaagggttccagtgctcaccaaaagctgtttgtaaatacgaagtattacatattatctttcctaaggttgtgagaacctagaagaactgcctttgattaatgctagaaaacagctcttatgagacataaagttcatttaataatcccacaaatgcttacgagcaactattctataccaggcagttttctagctttttggaaatagagtggtgaacaaaatagatgaacatctctgccttcatagaacttagattctagctgggcacagtggctcacgcctgtaatcccagcactttggctgaggcaggtggattacttgagctcaggagttcaagaccagcctgggcaacatgttgaaatcacatctctaccaaaaatacaagatattagccaggcgtggtggcggacgcctatagtcacagctactcgggaggctgaggcagggaaatggcatgaacccaggaggcagaggttgcagtgagctgagatcccaccactgcactccagcctgggcgacagagcaagactccgcctca

SEQ ID NO: 399623 - DNA, 495 bp, Homo sapiens
tctgaaagtggtatactcagaaattttcctccagactgcctttgggagttaaataaattaactttcttatgccaagttaacatgaacttagcccttaaaataactttgtgaggaaaactttactgataaaacagtctgatatagtctggttgtttcttctctccaaatctcatgttggcatgtggtccccaatgttgagggtggggcctagtgggctgtgcttggagaatgggggaagatccctcatgaatgatttggggccctctttgccgaaatgagttcatgtaacatctggttgttaaaaaagagtctgggacatctgccctgtctctcttgctcccgctcttggcatgtgatatgcccatacccccttctccttctgccatgagtaaaagctttctgaggcctcaccagaagtcaagtagatgttggtgccatgcttgtacagcctgcagaactgttagtcaaataaacctcttgtctttataaattacc

SEQ ID NO: 399624 - DNA, 136 bp, Homo sapiens
ctttcacaaagtgatgctctaaaaataccaagtctccttagattagaatataagctcaatgtaaacccatccaaaaatctatccaaatatatatggtagaattaatataaagtatatatatatatatacacacaca

SEQ ID NO: 399625 - DNA, 429 bp, Homo sapiens
cttgaccaacatggtgaaaccctgtttctactaagaatacaaaaattagttgggcatgtttgtgtttgtctgtaatttcagctactcaggaggctgaggctgaggcaggagaatcgcttgagcccaggaggtggagtgcagtgaactgagactgtaccactgcactccagcctgggtgacagagtgagactccatctcaagagaaaaaaaaaaaatttgcctattcgtagaataggcaaaattctgttttgcattgctctaagggaatgcctgagactgggtaatttatgaagaggtttatttgacttacggttctggagacaaggtatggtaccaacattttgttggcttctgatgaggccgcaggaagcttttactcatggcagaagatgaggggggaaaaggcacatcacatggcaagagaaagag

SEQ ID NO: 399626 - DNA, 290 bp, Homo sapiens
ggtgccagaagtgggggatggagtggtaaggtggtcttcctctggagtcgggctgcccagcggccagactcttctatggccactcctggctgaactcccctcagcatccacgtcgttctgccatcgctgctctgccagtgtctgctggtatgctcttcttctcctctagacatccagccatttgtatctgtgtctgcttaaggtctctgatttatatgggcacagtatggggtgcgtggctggccagagtgatctcggaaaatgcaacacttgggccacttcgtgggcag

SEQ ID NO: 399627 - DNA, 402 bp, Homo sapiens
catttctaacttctatataattttaccttttcatatattagggtcatcattatgaacctcagccatgtattatgctagtcctgtaatgcctttgtgctaatgatttgtgtagaatgatggcagtcccattgcttagcacctctcacttccaccctaccactctctgcagaaatacagactgttaagaggaaaaagtacatgcacagacaatttctctgtagcatcattggaagctccttaattttcaataatgtgggaagtgaattataattgagtagtttggtgattaatattcagtcattaaaatgatggtcatagagactacatagcaacatagacaaatgcttcgcataatacagggtaaaattgtgataagaattatacaaatagatgatacagaag

SEQ ID NO: 399628 - DNA, 454 bp, Homo sapiens
caagcaattcgtcagacaccgcctgggtgatccgtaatttcagtcaagttgacactgtctacttgaagttagcatcagatcccacaggttgggggctcagttccacaaggctgccgctacttcacgtgctggttgtaagttcctggttgggacctgaacttcaaccaaacatctaaaaattgaagattcccttgaccctttgctcagattttattaatttgttagcctcattcacagaactcaaggaagcattttgcttagttttacccatttgctatgaagaatattgcaaaagatacagatgactagcccgatggaagaaccctcctagcaaattaatcaaaagaaggggctttgggataccctgattttttttttcttttgttttgttttgagacagagtttcactcttgttgcccaggctggagtgcaatggcatgatctcagctcactg

SEQ ID NO: 399629 - DNA, 824 bp, Homo sapiens
ttgattccccttcaggcaaagtgagtggttcccttctctatgttcctgcaacatttttttcctacctcagtcatagtttttgtaacattatgttgtaattttctctctctgtcttcctccatcatactgggaacttctggagggcagcacttcttgtgattcatcactgtgtcctctgtacccggcaacaacacagcatagggccagacacgtagtggttgccttactcatttattgaatgctctgctaattgtcaggtgcgctgctaaaaattttggaggcattaattcaccttctaaggttggtactattatcccttttgtctttttttttttttttttttttgagacaggatctcgctctgtcacccaggtgggattgccgtggacgatgacagctcactgaagcctagaccttctaggctcaagtgatcctcccacctcaccctctcagagtgttgggattactggcatgagccactgtgcccagctgttatcccttttcacagatgaagagactgaggctcagaaagatggaataacttgctcagttacacatagctaggaagtagggagctggaattttgtgtatttttttttgtttgtttgtttgagatggaatcgctctctgttgccaggctggagtgcagtggcgccatcttggctcactgcgatctctgcctcccggattcaagcgattctcctgcctcaacctcctgagtagctgggactacagttgtgcgccaccacacccagctaatttttgtatttttagtagagacgaagtttcaccatgttggccaggatggttttgacctcttaacc

SEQ ID NO: 399630 - DNA, 514 bp, Homo sapiens
tcatctttctcccatgctggatgcttcctgcccttgaacactggactccaagttctttagttttggaactccgactgactctccttgctcctcagcctgcagactgcctattgtgggaccttgcaattgtgtaagttaacacttaataaactcccctttatatacatatcgattccattatctctgtccttctagagaacctggactaacacagtgggagaagaatgcaaaaatagctctggatcttcatgtagttataattaatagtaacaagtgacattttgtgagcactaactatttcaagttactgtgcttttcagatattgtctaatataatacttttggtggtcctatgagaagagccatcattatctctatttttagaagagaaaaaatgatgtttaagcaacttgctatcttagcccgggttccatagaaaacggagcttacatgtgagctttttattggagaggagaggtagtaatcccagggtagtgagagtaaggaaaaaaac

SEQ ID NO: 399631 - DNA, 1794 bp, Homo sapiens
  misc_feature (863)..(863): n is a, c, g, or t
  misc_feature (1119)..(1119): n is a, c, g, or t
atttaaaacatgagcttttcttccatacttgtgatactattctagttacattacaaaaattaatcttaggtctctacctcacatatatataaaaatgaactcagaaattgatcaaagacttaaatataaaaccaaataaggccaggctcaggggctcacgcttgtaatcccagcactttggaaggctgaagcgggtagatcacctgaggccaggagttcgaaaccagcctggccaacatggtgaaaccccgtccctactaaaaatacaaaaattagctgggcgtggtggcatgtgcttgtaatcccagctacttgggagggtgaggcaggagaatcgcttgaaccaggaggtggaggttgcagtgagccaagatcaagccattgcactccagcctggtcaacaagggcgaaactccatctcaaaaaaaaaaaaaaaactaaaaattcttagaggaaaacaggccttaatttgtgtgactccttgattaggctgtggcttcttagataggtcattaaaatcgtaagcaaccaaagaaaaaaacaaatttattggacataatcaaaatttaaaatgttcacaataaaaaatttaagacttataattcaaagcacattatcaaaaaaagtgaaaatacaacccatagaaagataaaaaatattttcaagccatgtatctgataagggtctagtatccagaatatataaagcaccattacaactcaataaaaagacaaataacctgattaaaatatgtgcaaattatttaaattagatatttctctaaagaaaacatacaaatggccaataagctcataaaaagacgctcaacctcattagccattttggaaatagaaatcaaaggnacagtgagagatacaacttcataccactaagtttggagttccttagaaacttaataaaattaccatgtgacccagcaattccacccctaggtagatacccaaaagagattaaaacatatgtccacacaaaaacttgtacataaatgtttatagcagcattattcataatagccaaaaagtagaaacaacctagatttccgtcagctgatgaatggataaataaaatgtgctatatccatataatggaatataaagncataaaaaggaatgaagaggaataaagtcatgaaaagaaatgaagtactgagtcatgctacagcatggatgaaccttgaaaacattatactaagagaaagcaaccagacgaaaaaccacatcttgtattattccattcatgtgaaatgtccaggtgaggcagatctataaacacaatatagattagtggtttccagaattttgaggggaaggataatagggagtgacagctaatgggtatgggatttctttttggagtgatgaaaatattccagaactagataatggtgatgattgtacaattttgtgaatatagcaaaaaacactggattgtgtacttttaaagagtgaatattatggttatgtgaattatagctttaaaaattaaaaactaggccgggcgcagtggcttatgcctgtaatcccagcactttgggaggccgaggcgggcagatcacgaggtcaggagatcgagaccatcctggctaacacggggaagccccgtcactgctaaaaatacaaaaaattagccaggcatggtggtgggcgcctgtagtcccacctactcgggagactgaggcaggagaatggcgtgaacccgggggggcagagcctgcagtgagccgagatcgcgccactgcactccagcctgggtgacagagcgagactccgtctc

SEQ ID NO: 399632 - DNA, 728 bp, Homo sapiens
ggagcaaccacatatacttctggggtaaataagttggtgcaaccggtactgaaaactgtttgctagtatctactaaaaccgagcacatgcacagactacaaccaagcagttccactcccagatacacactcaacagaaatgcacacactcactcaacaaaagacgtgtactagagtgttcatgtacttactattcataatagtccaaaaatgcaaacaaccaactgccaatcaaagtcaaatgtatatctatattagggatatatacaatggcatatacacagcaatgagaatgaaatgaaccagctcggcacagtggttcatgcctgtaatctcagcactttgggcgggtaaggcaggcagatcacttgaggtcagaaatttgagactagcctggccaacacggttaaaacctgtccccactaaaaacacaaaaattagccgggcatagtggttgcaggcctgtaattccagctactcgggaggctgggttgggagaatcgtttgaacccgaaagccggaggtcgcagtgagcggagatcgtgccactgcactccagcctggacgatagagcaagactccgtctcaaaaaaggaaatcaaaaatataaaataagatgacaggaataatccgcaaaagatcagtaatcaaaataaatataaatgggctaaagctacctattaaaagacaaagatttcacacccataaggatagctactatcaaaaaaa

SEQ ID NO: 399633 - DNA, 394 bp, Homo sapiens
attttcagccccaatccctctcctggagaggagagaggagctagggattgagtttataatcaatcatgcctatgtgatgaagtcttcagaaaaatccctaaacaatagagttaagagagctttcaggtggctgaacacgtggaggtactgggagggtggtacacctagagagggcacagagctcctcactcctttccccagatcttaccctttgtacttcttcatctggctgttcatctgtattctttaccaaataataaaccattaagtgtgtttccctgagttttgtgagtcattctagcaaattattgaacacaaggaaggggtcatgggaacctcaaattatagtcagtcactcagaagtacaggtaataacctgggacttgtagttggg

SEQ ID NO: 399634 - DNA, 424 bp, Homo sapiens
agggaactgcccactaagagtttcaggtatctgccttggaatcccctcatgttttcggctaactgttaagcagtgtgtacgctgactgagactttatgattcaagctaagaactactagggggctgtaagctgacaactcccaaaggtttaaaacagctgggagacgttcacattctgacaagtcagaggggaaagactttgtgaacacccagggtattcacttagacctcagagaagctatgccttagcagtggggctgtataccttacccaacaaacctttgaaaacaagtcttgaatggatcaagctgatccgccaatgaattaactgccgcaaaatgttttgcaggcagaccagaaaataaaagaaatccagacaacattcaaaagcccagaatccagttaaaaaataaatagttattaa

SEQ ID NO: 399635 - DNA, 427 bp, Homo sapiens
ggaaacattcagggacccctacaagttactcaaatctacacttgtcccgaaattcaggatatccatttgtgttggtgacatcctattttttttcattcaacacagaagccagagtggtcagctatttttgaggtgaaagttaaagcaggcataactgtgctgttgacaatgttggcgactggccccagtgaagggggttatgcagacaatacccctaagtacagtggcagattgggagggtggaggtctctcctcagtcacatcactccagatgagccatcagcggctgcaaggcaagatttctactaacaacgtagagatgtgccacttccaggaatctacctacaaatgagggcaaaaccagagttaacctaccatagcagaaacacaacaaagaacacaatgagatacagtgaaagggagtcta

SEQ ID NO: 399636 - DNA, 420 bp, Homo sapiens
tggctttcatctgagcaggagggagacagagtgaaccagtgaaggggacctgggcagcagagccaggaagcgactcgccaaggccacctagccaacacgtggtaacatggggctcacaggaggcttttctgactctgcgtcaaggcttttcatcatgaggagctgtcacttagcatctgttcccatacattcagcctagagtgcacagcaagcaattgtccaagaggcaggcttctgacactttggaaccggaggctttgcctgcatgtgtcacctgtgggatctataagggtgcccatttcagatggttattggaagaaattaagtgagataatatgtgcaaagttaggcagatcacaaggtcaggagatcgagaccatcctggctaacacggtgaaaccccgtctctactaaaaatac

SEQ ID NO: 399637 - DNA, 195 bp, Homo sapiens
tcttaaagaaagttcatcgtactccttttcttggggaaagtttattatttacaatcaagaactttcgaattaatcccaaatttataccaaagtattgtgaaaagcatttatatttcagatctttttatctcttttttcctcctctggattgtatgcaaggtacacacacacacacagacacacacacacagacac

SEQ ID NO: 399638 - DNA, 597 bp, Homo sapiens
ggttctagtttcttataatgacagagtaccatggttggaccaactgtcacacatgtaattataaaagctgaactaaacatcaatgaactaaaaacgaaaaaaagaacaggtatactgagccaggcccagtggtttgtgcctgtaatcccaactactaaggaagctgaagtgagaggatcacatgaggtcaggaatttgagatgagactgggcaatacagtgagactcctgtctccaaaaacataaagtaaaaattagccaggtatggggcatgtgcctgcagtcccaggtacttgagaggctgagacaggaggatcgcttgagcccctggagttcaaggttgtagtgagttataatcacaccactgcactccagcctgggcgacagagtgggacactgtcaataaaaataaataaataaataaacaaacaaacaaacgaatgaatgaatgaacaccagagagaaatcaaagaagagtctacctttccctgcctgccaactgtctactgtcaactgtctactaatcagaaagcataactttgaaaaaatacatgtaagatttttatttatgttttgcctaagggcactcccccattca

SEQ ID NO: 399639 - DNA, 503 bp, Homo sapiens
ttggagttttatcacctgccaggagaaacaggtgtaaattaacctagcaaacgtccagttacagcccaaagtgctctgaggagaaggagcagggtgaagtgacagaagatgcaactggggctaggggaaggggccttccaccaattgagcttggtcgctgatagggctccttcgcttaagaataagttcttccgctcccttccagttccctggagaagagtccctgaagctgccacctcttttacaggggcctgcctcaacttcattctggaagaattgcctaacggacaaataggtggcaggaagcactgagaggacaggtacctttctcttcaaggcttatctgccgtgtcgggctctttaaagaagcaattatctgcccagcggtggctcacacctgtaataccaaaactttgggaggccgaggagagaggattgcttgagctcaggaattggagaccatcctgggcaactcaacgaaacttcatctctactaaaaatta

SEQ ID NO: 399640 - DNA, 393 bp, Homo sapiens
aatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaa

SEQ ID NO: 399641 - DNA, 341 bp, Homo sapiens
gagacggagtctcacgcccaggctggagtgcagtggcatgatctcggctcactgcagcctctgcctcccgggttcacaccatgctcctgccacagcctcccaagtagctgggactacaggtgcccaccaccatgcccggctaactttttgtatttttagtagagatggggtttcaccatgttagccagggtggtctcgatctcctgaccttgtgatccacccgcctcggcctcccaaagtgctgggattacaggcatgaaccaccgcgcccggccccattttattcttttatcattttatgaatacatgtttttaactcaaaacccttctgtcgtcttctc

SEQ ID NO: 399642 - DNA, 427 bp, Homo sapiens
ggggaggaaacggctcacggtacctggattcggccaagcctgttacatggcctggaagtaccagggaaaagtctgctaggggttcctcccaagacagagggatatatttcaaggtcctctagcatgcggaccaggtgtcatttttacattatgtgtgggtgcaaatgtgctagcacaatacaggagagagtcagtctgaaccttgatgcagagatgggttaccccagccaatcccttgtccaaaccaactcacacatctaaaaggaaaacaccactgaggatgctggcgatgaatttatgccttcattcttgccagttttaattcttattcttcaaattaaatttcgttgcttgatggcatttgtaactccagtgtgttgttcacttttcataacaccttcctctctctcctctttctctctccctg

SEQ ID NO: 399643 - DNA, 1820 bp, Homo sapiens
aaaggtcagctgattagcaaccttaattcttctttgtaccctaattacgttcacaaattttggagattaagacctagacgtctttgggagccattattctgcctaccacaaagctcaagaaggttaagatgaaaagctgttactgccacttgatgacaggtggttgaggatatcattgcatccctgctgaaaacttcatgctggagtgtgtgtgattagtgggccgaatgcaatatttctctaaggcatagaatgagactcagtactttcccctcacctcgctacaggctaggatgcctagcagctaagtctgtgctgaatgttattaatgagttaactactaattatatgagctgattccatcagaatatacctgaatgtatataagtagtaggcagctaatatattcagataaaaatcattttgaacaaaactgaaaatatagccaaattcaaaatatagtttatgtaaataccatatccatttttttcctttcaacaccttgatatctgcattcaaaaattttacttttggcaatcactatagtagttaagttggaaggtaatttttttacagaataaaatatactgatggaactcctatgaaactgacaaataaacctatttgagtgggcatatgaggtaatactaaatatcttttttttgcttttatagaaagctagtcaattaattgtttcctttacacaggttttcatgacaaatcattgagattagtcatgccaactgttgagcaggtggctctcctccttggcatccctgttccttatgtacttccacccatgtcattctttactcaagagagagaattcttggcagtgaaacaccatgtggcttctcaataattgtgtggattaagcatccacaatgtacacataatgtgaaacacactgttggatggatataaatgcccattttaccttttatcttttcaatttcttcccactcctaaattatccctcacctgccaaacatagccccggattcaaaaataattaggattcagattctgaaaatcatagcttctataatttagccttaccagattttcagctttcactaagtataaatacattctaatttaaatgaacactaaatttcatcaaaattggtggaaaacactctggaaaaactatggaaaacacttagaatgtcgcctgtacagagtaagcattacatagagctagtagtagtagtagtagaaaattaacactttaatattattttgataatataataactcctgaattcctatatgtgtttctatttatttgtacttcctttgaaaaattgtgatttctattcttcccatcaaatattacaaaaagaaagtatgtattttatatttggccatgtctaacatatgtcaaacagctaaaattgattcaacttttagcagaattttattggaaatgttatcctttgttttcataagaaaaaatactaaatttaattaatgattaaattgacctaggacatataggcaagtgataatgctagtaaactttctactttccttgctatctcagttgtaaaaactaaaataacctcgtatctgatgactccatcctatattagacataatgggagagatctattgtgacatataaccctttttgccacttgccttaggactcattatgaaagtgttttgcttaactctttgttaaaattatactgaaataatctactttattcatgtccccaagctcatgtacgtatagcaatctttggtttaataaccgttcagttctcagtaaatagaatatttgttgtagcaatcactttaatgtaatgagaaga

SEQ ID NO: 399644 - DNA, 289 bp, Homo sapiens
gatcagcactgaacaaattacaaaatatctgccctcatggagcttatacttggttaaattcctatcagttattttctaaatacttggacatatcaaataaccattaatttttttttttcttaaaaatcctccttccagagacctctgctttactgccattttttctgtgggctttttcctttatatctgttcccttacagtgtacttatttggttctatttgcttttttactctctagaagattttgggattaaaaaaaaaatacttggttgctaaaatttcacactga

SEQ ID NO: 399645 - DNA, 457 bp, Homo sapiens
ccctcaacaatgcagctgcagtggtcctccagcctctatctccagtgataggaacttgcatctcttcagaagtccattgcatctgtcagatttcaggaagacaggaggatgggaagaagaggcaggggaagaggaaggagaaggagattctgccttcttatagaatccagccacatgtcctatatctggagagtgattataacgtagcggctcctaacacagcggctccaggaccagattgccttgagccaaacctgggtctgcctctttctggtttgaggtctgtggcaattgaatcaacctctgtacaactcagctcctcttcaataagatagagataattataggacttaccttgtaaggttattataaggaataaataagttaatgcaaataaagtgtttgaatactgccttgtacataggaagctctcaataaatattacctaattctacta

SEQ ID NO: 399646 - DNA, 456 bp, Homo sapiens
gccacggtgcccagccggtgatatccttttcttttgaatcaattgttctgttgtaattagttaatacctcgtgttatttctgcataatgtcagctcaggaggtttttcttttctcttttaagcctcttctgttctaggaagcctagaacttttctagagcagcagttcttgaagtgtgatccctggaaatatttgagatcctctcaggagatctgcgaggtcaaagcttcataataatactaagaaattacttgcctttttaactttcaacctcttacaagaatacagtggagttttctgtaggcaacatgacatgtgattttgtaacagattgatgcaaatgcagctcttaggagtcactgtctgctattaaaccatacattacattgaggagacttgcaaaaatgtaaaatataccactcttctcaccaattttgaagggagattggaaaatac

SEQ ID NO: 399647 - DNA, 634 bp, Homo sapiens
cagcgtggtcggctttgacaaaagctggcttcgtgtcttcaaagcactgaggccggtgccgaaactcatagaagtagacaggtgcaccagcatctgacaaaaggtcagggaaggtcaggcatgcatgcagcgcggagcagggggctggctctgtgtccccacctatcaagtcttggatgtatagacccaggggtgggacagctcagagacagctcacttcccccttcctcatttgaggctggaatttcctgctacagcagtgctcatatccctagtgatgaagagctcacgtctgagaaggcagtagttctgcttctcaaaagaagtcctttacccattattggaaaatactttcttttcattactgaactgtaagggttcttctattctggatatgattattttgtcaaataattgtactatgaatattttcttccagtctgtggtctgccttctcattttcttaacaatatttttaaagcaaaatgtacataagtgaaatctgccccttgaaccattttaaagtatataattcagcggtttttagtacatttaggatgttgtgcaactatcaccactatttaggtccagaaccttttcatcaccccaaacagaaacctcagacccatttagc

SEQ ID NO: 399648 - DNA, 546 bp, Homo sapiens
agtgcagggcagagacctaggaatttggataatgggcaactctgagatgtcaggcaatggggaaaggagagctcaggtgggactaggaggggcaggaagcccgagggctgcagtcaccatcttcagaccactccagagcttcctggggagcaggaacagaggacaggccatgaagcccagaaaggcagatggcagcagaatactaggaagacacctccaatagtctgtccaaagagggtgaggggattaggaagtacagacatatcctgagttacaatttttctattttaaaatgctatgaaagctatatgcatttggtaccctcctcaacttatgacgcagttgtgatggggttataaggttacttcggataaaccaactctatattgaaaatatcgcaagtcaaaaatacacgttcgggccaggcgcggtggctcacacctgtcatcccagcagtttgggaggccgaggcgagcagatcaggagttgaggagttcaggagttcaagaccagcctggccaacgtggcaaatacccatctctacta

SEQ ID NO: 399649 - DNA, 651 bp, Homo sapiens
ttccactgtaatcaactcattacagaatgccatccttggagtccagggttgggtgctgagtattggcaaatgatgtattgtatactgttcttatcattgcttccatggacacttaatccatgaacttgttgatgaggaacaagctagcttagttactccactgatttaggtggattatggctgcatgtaggtaatgtgagatgatctccatttaaattgactattacttacagtttcttaagataatagactcactctacattttatcttttttaagtgtgaatggagtagcatctagaaaaatttagtgctgctgccagtatttttatacagctgcaaatagttaataaagcatacccttcagggaaatttaactaatttgacaatttttttattcttatagcaagacatttatgaaaagaattgtagcccagcacttatggatataaaagatcttaacagcttgaggtgcaatgaattgtacatactctaggaaagcaattctacattataaagtattaaagtagaaaaaatgagttataaccatgatctgtcctaaagaaaaagctaaagaattgtttgagaatgatcaaaacttggttttaaaaaatacgtaacttttaaaaacctttgcactatgcatgtttaaag

SEQ ID NO: 399650 - DNA, 164 bp, Homo sapiens
attcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcatcaaaaaaaaaaa

SEQ ID NO: 399651 - DNA, 635 bp, Homo sapiens
gtagagatgggggtttcaccatattggccatgttgtttgccttttttagtcacctgtgcatggttggatattggccatggtaattgttttacagctgtgactttttctgtctccttctcagaatttatgtctccatttacccatgaatagtatctccagagtatggcattagctcagttctcttctcactttatttagtcttcttaagtgcttcaactatcacatgaatgcacccaattttctgtctttagctctgatttttctcctaagctccagactcataatcacgtaaccactacctgctagtcactgccacccgccagctagatgtctcacagacatcagcaactaacttaatatggcattacctaacccattacttactccctaaacctgcttctcctctgttacttcataccttggttaatagcaccatgtcatcctttcgtgaaaaccagaaatctggagatgcagagtaagacattacatagctttgccctcaagaaatatgctgtcttctaggatacatatctctctctccttaaaaccaacagtattttctccttgtcactcttatgaaacttagaagtttacattttgataagagtagaaattctttgtatttacaaagttat

SEQ ID NO: 399652 - DNA, 456 bp, Homo sapiens
tgagcctggaacatcttgttattgtcacaaggtatggacatgctgaaagaatgatgggagcctgtcacaaggacacagtgctagcttgaaagtgctttgattggccaaaccagggaccatgtggacaccaaaataattatggacagtaaggaattatatgccattggagaaaaaataggaatttacacatccatattgattactaactaataagtggaaagtagggaggctatgcttacagcggcatgctcaggctcaccaatatgcgtggaggggatgggtgctgtgaaatcatcctttcatggccattgtagtagagactggatcaggggagaatcatccatgagtgtcacgtttaggaggaaattgtgataaggaacgggacatttgcgatgtcttaaaagtgtctccccacaaattacaagttcaaaaaatacatacagtggagaaatcaaa

SEQ ID NO: 399653 - DNA, 366 bp, Homo sapiens
gcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactgaactcaaaccaacttacgc

SEQ ID NO: 399654 - DNA, 600 bp, Homo sapiens
gggggatgaaggaacagaattatgtcatagttcgtatattttttcttcctcttactattggtacctcagtaaacataatttggacaaattatgtcaatctcattgaaggattttgggggtaaaattagttgcatgatttttgatggtcatcgttacatgcatgcatatatttccattgtgtcagataaaaggtctttatgagatgacccctagatattatattgatggggcttaaaatggagaagcacaagaattgtgcttataatgtccttatagccatgtggctaaaccattattgaggtatggcctgtcatttggtacactactttcataaactgtagtatggctattttgataagtgttttattcacatggaaaagaccttgtaggaatcattaaataaattaaaaagccatatctttatttttatttgtcagtcaaggttataattctcagaaaaattctccttaggaaaagttagatatcttctgcttggctcatgttttcatgatcattttatttttaatgtaataatgtaaaacacagcatcctccattcttataaacaatatcatagtaattacagttccagattgtttga

SEQ ID NO: 399655 - DNA, 468 bp, Homo sapiens
tcctatccaagaaaggaggtgctggccaccagcaggtgaagggacagcttacccccataactggagggacagaggagggtttctgtgtgggtacagctggggaagtaggtttggttgtgggaggataaagtagccctgctttatattctcaaatgagaatcaaggtcatcaactgagagtgaggagcgggaattggaaatttgggtgatggggaaggcagataataaaatagctagccctgaatgtgggagcgtgagttgactagagtaatgtgggagaatggtgaaacacacttgagatttatggttacagatgaaatgataactgtatatctttatccagattcattaaatagcctggggataagaacagagaaggcagagagctaggtccaaccagctataaggaatgacaggtgagtttgtttgatgaaagacagcagcaaagggtagagttgtaaaaaaaaaa

SEQ ID NO: 399656 - DNA, 170 bp, Homo sapiens
gctcttggatttggcaagaagatcactggtgaactcaaaagagaaatgttggtagattagtgagaatagaaacagagtgtaggagttaggaacagaatgtgggataggaaataaaggcaactcacacaaatctcagattaggggatttaggaagcaaaaggaggatggca

SEQ ID NO: 399657 - DNA, 387 bp, Homo sapiens
cctcgatgggacagtgtcagtgattgtgaaaggagagtactggtaggtcagatgaggctgggctcctggccatcagctctttctgtctcttaccaattaggtctgtgccaaggcatcttgggctccgccaccaacttgtcccactggctcttgctaaaaggtaggcaaccatgtgagcgtgggcactggtgctggtacttaccatatgcccgcttttcctggaactgacctaggtcccatgaggaacacattgggcagtcaggcacaatctttaccctcaagaacactgtaggctgaggagatatgtgtgctctaagaatatggttgagagttgatgattccatagaggttcagaagagaaggatactctcatgggccctaaggtag

SEQ ID NO: 399658 - DNA, 499 bp, Homo sapiens
gagtaactttgaaaatttgataagcgcaaaggagtgaaaatagtcatagtacaaacaaggtctttgtgtcatatattaaatgtagagctttcttgttagtcaagttaactatatggattgtgtattttaagaatacatattagaatacatattgcaatgtaaatatatccagtaaatgatcaataaatggggttatcttcatgtcatatagtctttctcttcatcaaaatgaagttattcattgactacaatttaatagcaacaactgtacttggattagttttgcaaacaaatgtgttcatattagtgaaaattacattgaaataaagcaacacgattttgtttcttaaaagcaacctttagcatatggcagcctgaggtctatagcaattccatttgttaaactcacagggctctatgtgccaaacccagcattaagtccttatttagtataaactttgccaaaactatcagtaactctgatttaattctgcaggta

SEQ ID NO: 399659 - DNA, 267 bp, Homo sapiens
ggtcgaaagggttctcctatggaggtcgtctgaactctaggaagtacaggagcaggacaagggatgagcatgatcttacctgatctcacccatgtttttctgcctatcaatttggaggaatgggaaagtgtgacaggtggccactaggtggcgttatcaatgtgaagaaatcaggggtgtgttaatacatcacctgtcctgtacagtagagtggaagagcagataaacgcctagctggagaaaataaagcttctcatataaatgctt

SEQ ID NO: 399660 - DNA, 323 bp, Homo sapiens
ttagtaacttttttttaagctgctccttgcagagcagggctaacttccaggcagcgcgcccagagccgccttagtaacttcttaagctatactggtacatattttaatatagaagattatttatcaagtacaagaattatattctgccatgtggtgacaaatgatgccaagtataaacctaaatagtgatttcaaaagtcaaggtcagacatggtggctcatgcctataatcccagcactttgggaggctgaggcgggtggatcacttgaggttaggagttccagagcagcctggccaacgtggtgaaacctcatctctacta

SEQ ID NO: 399661 - DNA, 534 bp, Homo sapiens
tctataaaagcataaatcttactctcttatgttaaaaaggtagattccataaaagatgctctcattcatctttgattctggatgcttacaatccagagatgaacatctgtgtgtgctataaaactagtagtgccagagaatggcaacatccgaaatcagaaacctccaaaaaaatccctgcaccttcttaaaggcaatgggaaattggcaacacttcctttaactttcaaactaatgctgcaactgcacatccagaagtccaagaacacaagggagtaaactggaatgggggatgacaaagagtcctggagcttcactgtcaacagttgggcataagaatgccaagcaaatattcagactgactcacttactgggcctggaggctgggatgtaaagcccaaggaagcctaatggtaggaggaagaactgcagaggacactgctatttctgtggtgatgggaagtcattttaatgctctgcttgtatgaaaaggataaaattgctttggccttttgtctgaagcttagtagacca

SEQ ID NO: 399662 - DNA, 344 bp, Homo sapiens
ttaaaactagtgcaattaagaccaaaataaaaaaaaaagattttgagaggaagtaccattttataattatttgcagtagacatagtagacataattgtatctttgtaaaatcaatttaaaaaccctttaagaattcagtaagatacgtggttactaaattaatattaaaagtcactagtgtttttctctacaaaaaacaaacacctggaaacactacaaaaataaagtaatcaaagtagcatggtactggcatactgacaaacatatagatcaatgaaataaaatagacagcccagaaataaaccctgccaaaggatttttgacaacagtgtcaagaccattca

SEQ ID NO: 399663 - DNA, 367 bp, Homo sapiens
gtcttgctctgtcgcccaggctggagttcagtggcgtgatctcagctcattgcaacctccgcctcccaggttcaagtgattctcctgtctcagcctcctgagtagctgggattacaggtgcctgccatcatgcccagctaatttttgtgtttttagtagagacagggtttcatcatgttggacaggctggtttcgaactcctggcctcaagtgatctgcctgcctcagcttcccaaagtgctgggattacaggcatgggccaccacgcccagccactgggcagattcgtgaataaaggagccatgtagaaaatggggagatgggcattcctggcacagggaacaacagcaagtgcaaaggctatgtt

SEQ ID NO: 399664 - DNA, 219 bp, Homo sapiens
acttcaacacctcattgtcagcactggacagatcatctagacagaaaatcaacaaaaagactttagatttaaactgcactttagaccaaatagacctaaaagacatctaaagaacattttatccaacagccgcaggacatacattcttctcatcagcacatggcacattcttcaggataggctatgtgttaggccacaaaacaagtctcaatacatttt

SEQ ID NO: 399665 - DNA, 242 bp, Homo sapiens
attctctttctcgttttctctgacaaattggcagcctgaacctcggggttgtgtgtgtacccagaagcagcctcttagcccctttacccatctctctcagttctgtaccagaccaggaatcttggctgtcctatattcaagggaaagaagagcctggaataagaggctctcttggctctctgtggtgctggaatcttcaagtctgattgttttgagagggattaagaagctctctcttctct

SEQ ID NO: 399666 - DNA, 412 bp, Homo sapiens
aatataaatgtgcaaaagatttgaacaaaggcttcaccaaataaaatgtaagaatggcaaataagtatatgaaaacatgctcaacaccattaatcattagtggccaggcacagtaactcatgcctgtaatcccagcaccttgggaggtcaaggcaggaggatcgcttgagcccaagagttcaagaccagcctgagcaacgtagcaagatctcatttctactaaaaactaaaaaattagctgggtgtggtggtgcaagcctgtggtccaagcctgtggtcccagctatgcaggaggctgaggtgggaggatcccttgagcccatgaggagcccctttcagtgagctgagatggcaccagtgcactccagcctgaatgacagagcaagaccctgttacaaaaaacaaaaaaaca

SEQ ID NO: 399667 - DNA, 593 bp, Homo sapiens
ctgatccttttgtcatggctgagaggggaaaggggttcccgattaagaataacaaacatctggacgttagcagggcttggaacctagtcacccactacaattttttaagcttgttaacaggaaacgaggagagatgtgtagtttatgtggcaaacataaaggaggtccacaatctcttccttattgttcgaaagaagtctggggaactaagtcattagctgaacagcttgcagcttcttagtcctcaaactgctgtcttgtacattgctgctttccacataaaacctcccagcacagccaccccaaattctgcctttggaagtccttaggtaatcaattaaaggccagtgtctgggcagggaagctgtttgcagaggtttggatagggattatttttctcgagtgcccctcatacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaaggaaaaaaa

SEQ ID NO: 399668 - DNA, 518 bp, Homo sapiens
gaggccattaatacccaaataccaagaccaaaagtaaagtatcataatcacattccaatatctcttatgaatatgtatgccaaaatccttaacaaaatgctagtaaaccaaatcagagatgcataaaaagaattgtatcccatgactaagtgagataatctcaggagtataaggttggtttaacatctgaaaatcaattaatgtaatacatcaacagaatgaaaaacaaattatatcatcatctcaatagaggcagaaaaagcattttatgaaacaacacttttgataaaaacattcaacaaactatgaatcgagtggaacttcctcaatctgataaaaggcttctagctattactttttaactgtgttattttagtggttacttttatctttaacgtatgacagtctgccttcaagtgatactatacaatttcaggatcttctgtttttgtttgtttgtttgtttttttgaaggtggagtcttgctctgttgcccaggctggagtgcagtggcacaa

SEQ ID NO: 399669 - DNA, 479 bp, Homo sapiens
tagggtcagacatcctgcttgttctagctccatcacttgcttaacctgtgagctccaggttccttaatctctaaaatgagaatagtaatagtagtaatctgctttataagattgtcacatatagcccttggtacaacagctggaccacagaaagcattttttgaaatgttagctgtcactagaattactgccttatttctcctaggagaaggaaagtttcccaggatctaggccagtttgactttgccctttttaaatatttatttatttatttatttatttagagacagggtctcactctgttgcccaggctggtgtgcagtggcgtaatcacggttcactgcagcctcagcctccctggactcaggtgatccccctacctcagccttctgagtaactgtgactacgggtgcacaccaccacacctggctaatttatatacacacacgcacacacatacacacacacacaaaatctta

SEQ ID NO: 399670 - DNA, 437 bp, Homo sapiens
ccactaggactaggttctttaaaaataggaagctaatttgattgtgaaaactagtatttcattttaatagcataaaggacaaaatttaacaaggaaacagaaaagtgagtcttccctctagttcttttcccattctcatcttagccatcagtcactaataaaacaaatgtaagtgtctgttcaagtgtcattaactagtgggcagctgagctatggtcctagacatgtaatatgaagaaagtactaggagtaactgaaaaaaagaacaacaaatctataggtatttacttgggcccagctgtgcacaaggcaatgagaaagttgtgatggggaaatgcagacattagttcttgtcctcacacagctcataactgtcttatggtgacttgccccacttcctggaaataatgaggaaaagcaccagtaagtgacaaatg

SEQ ID NO: 399671 - DNA, 405 bp, Homo sapiens
atgatttgatcctgggtttgcctcttctctccttcttcctccaaagtatattccttaaatttaacaacccttgccttccttttctgtctaagggctactggtaggtaggataatgactccaaaagctgtctatgtcctaaacctcagaacctgtaaatatgttaccatacataatagaagataattaagtttgtagatagtttagtgtgctaattagctaaccttgaggcaggaagattatcctgacttatgcaggtgggctcagtgtaaacacataggtactcagaagtgactatggtgagagtgatgtgagaactttacctgctgttgccacctgaagataatgaaaggggccatgagtcaaggaatatgggaggcctctagaagctagaagagaaaaaaaaa

SEQ ID NO: 399672 - DNA, 379 bp, Homo sapiens
atactagctgcatgcttggaaatttcaccttaacattctgagtttcagagttttgtgcaaaacccacgtattttctgcattaaaattcactataatgatgtttttaccctccttgaactgcagtagggctccaggagtatgcaccatttaaagtttggcttcctggacctcctggcatgctgccacatacctttgatcttttcaccacatggtggcacagaaacagcactggaaggcatagccagggtcggaatcattggaaggcctccaaggagatgagatacattttctttttattgttactgattgaatgtaatttccatcctattttgtgcccagcctcactgctatgtgaacatataaacagacctttgaaatc

SEQ ID NO: 399673 - DNA, 433 bp, Homo sapiens
gctccttctttattatttcccttattgagacctataatccattcacctttttacttcgttcctatcaatgcgatccctgccaccctcattccctgacctatttgtcttagaatgcatagtccagatttcagttacttctgtgataaaatcctaccctttcccccgactacctttttaatttgaaggaggatggcttttaaaaaatgttgtaataattcagaattccagaagtgcaaagacaagaaaacaacaaaaatttatgtcccacccacctctgagatgtatttggtacaggtgctttttcttctgaacttacagcattgtatgtacagttaaaggcttaattctccaatctcattattttccatccttattgtaacctctgtaaaaaataagtgcatctttattcactatgcttttctccttttactaa

SEQ ID NO: 399674 - DNA, 540 bp, Homo sapiens
cacaccatggacatctccaggggtaccattcacagtgggacctttgagcccatcaccacctgaaattatataccaagactgattttagggaagttgatgtgcaggtttttttcttagcagcctcagtgctaccagatgcagattaaattctgatgatgaggctggagaggaataccagtgaatgaagaatataatcactcatttgagaaatttacagtttaatatgtgggctgtgggaagcaagaaaagggctttaagcagagcagccagatgatcagatttgcattttaaaaagataactatggtttaaaatgtgaggcatgaagtagaaactggcaagaacagggacagggaagtgggctgtcagcattttccaggtgggagattctgaagcttttgctagaggtggcacatgggagttgggcaagtactgcctgaatccatctagtttctgcatcctcagcgagggacttggtgactgaccaaatggagaagatggagcaagcaaggggatatccaggcttcaggcattagccacca

SEQ ID NO: 399675 - DNA, 306 bp, Homo sapiens
cggtcatgcttactgatccagacctgagtccttcaagtggtgtcctctgtgcacgaaagctacatgcacatactgcaggcagtgcatgagtgtggtatgacattgtgcctctggactcctggagcccctctttcagttgcagccccttcaacctgcccttgaacaatgatcggcagaaagatgagaatgaaagagaagaaagagaatttcttccatacctttcaaaacttcaaagaagttgtccccagtctggttctgatgattcatgtctcagtgcaaagcacatataaatatctgaaatctgca

SEQ ID NO: 399676 - DNA, 361 bp, Homo sapiens
cagaaggggacaccccagccctgccccacagcttggggggcagcaggcagaggacagaagcccacccaggctggcctggcgtggtgagccacgccggtaatcccagcactttgggaggccaaggcgggcgaatcacctgaggttgggagttcaagaccagcctgaccaacatggagaaacactgtctctactaaaaatacaaaagtaaccgggcgtggtggcgctgcctgtaatcccagctactcgggaggctgaggcaggagaagcacttgaacccgggaggcggaggttgccgtgagccaagatcacgccattgcactccagcctgggcagcaagagcaaaactccaactcgaaaaaaa

SEQ ID NO: 399677 - DNA, 621 bp, Homo sapiens
tcaagcgattcccctgcttcagcatcccgagtagctgggatttcaggcacgcaccaccacgcccagctaatttttgtatttttagtagagacggggtttcaccatgttggccaggaaggaagcattacttttaatgcctgcacaatgaccagttgaatcgaaaaggcacaggtgacttatccacttcccagcatgggcatgtgggctgtttccaacctaggttattataaataatgccacaataaatatcttttccatatttagggccaataggacggattcccaggtgtggattgacatctcaccaaatgccagccccaggtcatgcccacagagacgcctgcagcagcgcatggctggcaggaccacctcagcctctctagcagcaggcaggtgggttcctgatcctaaactcacactttaatctgatgtctttgatttctaggacgcacgtagtgggtcaagagcatagctctcaagtcaggggctgtggacttgaccctcactctggaactgtggggcctttgcctcagttttcccaggtgtgaaatggcgatgctgacagtgcttaaccccacagggttgccaagaacaagaaccgtaatacgtgacgtcgtaagc

SEQ ID NO: 399678 - DNA, 491 bp, Homo sapiens
acaagtgcattgagatgggtacttcaaatttgcacatttaaaaatatgtagttatacctggataaattactgttaccatgaaaatgaaaaaagaggatgggatcaggaaatacagtggaaggtctgttagccaatctccacttgaagcacagtcccctcctaatgcttggtgagggctgccatgtccactgtgtgctccagcctggagggtgggctgcttcttcgacccctgcatacacttgctgcctccacctaggagatatgtctaccaagagccagttgtgtttgctatcatgcatgtttatgtgtttgtgcttgttttcaagtttaatttaattatatttaaaactacttacatcaaatacatgtttaaagagaatcagttttgtaaaagccacgtttaatgctctggaatgtctcagtaaaggtgaattactacaaagagttatagtcacttagatgtgggacggaaataaaagtaataaaaatca

SEQ ID NO: 399679 - DNA, 577 bp, Homo sapiens
attttatgtatttttttctataattttaaaaaatgaaaaacaaaaatgaagaatgagagaactaaaaagcaaaatctattcaaatgattagttgactatttctgaatctaaatctactgcagatgacaattcaggccattactcagggccagtctttgttccactgataagcagttggggcagtgaggcaggaaagccacctgctgagaacagggtctaaaagagaccagaggtgggatacatgcaattaacccttaacctcttcccggctcaccatgatggagcagctgatttgcctggctctcctcctctctatattttcatctctatatgcccttaaaatgtagctgccccaaattcacctccttttttggggaaagtaggtatgtatggatcttcatattctgatcgtcttgaaatgagttaggagaagcagtatttttcttttctggttaacagtcaaggagatctctggtttatgagagtaaacttggttacattttcagctataaatgactggctctcttaggaaatacaaatggacagtacttggaggctggaggagtatggaaaatct

SEQ ID NO: 399680 - DNA, 142 bp, Homo sapiens
gatggaagaacaaggagttcaagaaataccccaagtatcctgtgtgtgatgagaaggaacactattacacaaacagattaaatgggcatttgtggaacaacaaatttccccttattaatcaatatttggtgaatctttcttt

SEQ ID NO: 399681 - DNA, 534 bp, Homo sapiens
atttagtcacagctcagtcactgtcatagaaatgtctctgacttcttttaaacattatttgctacttcacgttcataagtttaggtaatcattttcctgaccagttatataaaaataatttttaaaataatacatctcaaagatgtttgacataatagaaaatggggctggatgtgtgtttatatacatagtgtaactgaaagagcttatttccagttggcagacctgcagcaggccacttaacatttctagaactatgattccttacctgcaaaatttaaaaataaaccaaattaggtccaaagccccactctccttctcattaattttttaatttatgtaataatctgatggcgtctcacttacagcattaatcagatctgacttgtgttttaggcatctgagtttgtcatactttacccactctctctacctcccccaagttcaggccctggaagccagggattttgtttcattcatttgtatgttccctgctatacccagaaagtgccttgaatgctcaggtgctcaaga

SEQ ID NO: 399682 - DNA, 537 bp, Homo sapiens
gcacgagagtggcttcacaggcagaaagtcctagcaagaaatggcagtccttgcagaagccctttgtcccttcagccatactgtttgtgagtttttttactgaaggattttcacacagctacgtggcgaaggacttgcgagatttgattatatatcccatgagtcaggtttcgatgggttacagattgcaataaaatcaaccacaggctttggaaaaactttccatgaaaggcattttagactaagaaatattggctttggatttccccatctagaaaggtagagagtaaacatgtactgacaaaaaagcaccacattcgggatcccgaaaataattgtgaaacaacacaagaatgcttttcctcctccctttccttcctttccacgtcacagagtttgtcatttatgacgattttgtggttgttttaacagttctgtgaaaatgagatacagagaaagtatttttaagatttatttaaataatataaggtcacagatattcccccctctcctcttctagaacatcttgattcatta

SEQ ID NO: 399683 - DNA, 274 bp, Homo sapiens
cattccagatacaagaggattcactccaaattgtacaccacactcaggcatgggactaagaacgatctacaatcagaaagtgattcaaaagactctcagctaagtgctacataatgagcaactcgtactcctcaaccaaacggcacagcaagaagacagccattggtgaaacaggaagaagaccttcatcagaacccaatctttgtggcaccctaatcttggacttcccaacctccagagttatgagaaataaatttatgttgtttaagccatt

SEQ ID NO: 399684 - DNA, 584 bp, Homo sapiens
aagccaaatgcacggaaacgcttgctggagaactgtttacacatagccatggatcacaatatcttgggggtcctgaaaataggatgatgcctgtcttgggtttacattctttcctttatatcagagcctttcttcctgagtttttctctgtctgtgttaaatgagaaacacgcagctctcccatcaagacttgtcgttcccatccacagctggggccacctagtcttcatcttcacttaagcatagtgcaggggtaacgacaacctacagctctccccacagcagaggatttgacaagtttcttatcccattattcctttctcatcccctggtatgggaaatccacagagaaatgttaatgtggaaattcaccttggggagcaatagctgatactttagtgttagagtttcagattccatttttataccaattatcagagagaactttgttattcagaatgtgttttttttttcccctcatgcttggtctgaagaaaggaaataaaagaaacagaaaaaataggatctttcaaaaagttgaacagtattttttagaatttattgtgggatggggtgaactcaga

SEQ ID NO: 399685 - DNA, 555 bp, Homo sapiens
tttaaacatgttaaacatccttttacagatctccagaattatagtgacagtggggagaaggagggaatgacccatcccccatcccgagcttgctagcccagctcctggaagatcagcccctgggcagtgccagcctgcatgaccgtcctgatccccgactctgccctttctgccaaagagccagcagagcacatgtctcggagaagaccccctatcaccttctaggttgtcttgccacagaacaggagcacccagcaatacagcagagcttcccacgggtttctacagtgtcttcagagaaccgcaaggagggtcagcccttgtggagtctctgacccaaattctgacattacctctatgacttattcacaaagtgacctcacactgcacttttctgagcctcagattgtgcatctaaaaaccgaggataatgcttacctcactaggtggttgtgaagaaatgtaaataaaccgtgtgtgaaaatgattcctaaaaccagaaaaccccacataagcctcagtgaggaaagcaacacagtgtagtaatcaaagcta

SEQ ID NO: 399686 - DNA, 396 bp, Homo sapiens
gtcagtttactgttgatttaaagatttattatggtgcctaaatttatcttgaccttaacaagtttatccgtctgaaaaagctggctggcaaaaaatgtcccaagttgtcacagtgtcactgacccttatcttgtctctcctgaaaaaactataactttgctttttcatgtaacatttatgtttatagacttatgctaaatagacgagtagagcacacattatttcagtaatagtttattgctacaggcttctgtggtagcataaacagaattgaatgtgtagtaagagttgtaggttccagtcccagcttttttttttacttagacaagtcactctccaagcctcattttcttcagttcagatatagaaatattatgtaacacacaggattcaaaa

SEQ ID NO: 399687 - DNA, 295 bp, Homo sapiens
aattatatcatgaagaagggaactaattttactttttccttctaaagaactggccagtttagtactattgaatagtttcattttttccccactgatctgattaaaagaaaatttcccggtatcttttatgtatctagttctacgttttgaggctctctacagttttgcagcaaatctggctatctggtaatgtgtatttgcatcatgccttcttccaaatttcttgctgttggtcctttatgtcatgtgaacttttggatctgtttctcagctttcattaaaaatactgtaggca

SEQ ID NO: 399688 - DNA, 248 bp, Homo sapiens
ggcacctctgcggccgttggagccacacaaggaaggcctcacacgaaccacacgcactacagagccaactgcgacccaagcacgatcgaggctgtgtgtttctgaaaggatctgaccgaactgagcactaagattgttcagaatctggccaacgcagctccccatccatccccagccaggtggcccatggtgagtgaggcagagtcttggtttcctcagctgtgagatgggggcagcggcacccgaca

SEQ ID NO: 399689 - DNA, 114 bp, Homo sapiens
gcgagatgatgaacattttaagagcaactaataatacaactatttcaaaaataattttagtcatcacacaattctttctagaaagactattcactactgaaaatgttaatacta

SEQ ID NO: 399690 - DNA, 835 bp, Homo sapiens
ggccttgaactcttgggtgcaagcgatcctcctgctttgacctcccagagcactgggattacaggtgagagccacaacacctggccaatatccaacttcttacccctcatttccacttggcagtctcattggtatctgaaagtcatcatgactaaatggcgctcttgcttttcttctcagaacctgcttctcctccactgtttcccatgatggcaatggcaccaccacttacccaggcccactaggcagagctagaaagcctgagatcatccctattttgttcccctctcatgccccgcatcaattctaacagaaagtcactctgttttcaaaatagatcccttcctcccctctttatcctctgccatctttccagctcaaaccaccatcttggtctggatcattccaatagcctaccaactggactccctgcttccagtcttgcctttcactaattctccacagaacagccagagcaaacattttaaaacataaatcaaccaatgtaatggggtgtcctaatctggattctggaacagaagcaaaagtacattattgggaaaactggtgaaatctgaatgaagtctgtagttttggcagtggaatcatggttaggtaaggggaaactgggtagagggtatttgagaaccctgtgcacaatcttcgcaagtttagtatacatttttttttttcctgagatggagttttgctcttgtcaccccggctggagtgcggtggcacaatttcggctcactgcaacctctgtctcccaggttcaagtgattcttctgcctcagcctcctgagtagcagggattacaggcatgcaccaccac

SEQ ID NO: 399691 - DNA, 429 bp, Homo sapiens
gggtgtggggagtccctctctggatcctggtgggtttggcacgcggaccctacatggtggatgtgatggacagtgtcctcctttgggagcggggcctgtcctggtcctcttgtgaagggtgggggacaggcactgacctgtcaggagggttagagggttggcaccagcaggtggcctggagcgctcagagcacgcgcgatcaggaaggcccgagtctccagtgtgccctccctggccttgtgaagtcatcttaaagtctggcttgagcgcctctgacttggattctgggaagctgacacagcgcggccggggtcgccacatcctgttgagtagccgctgggtgctaggcgcctgggtggtagaccaggtgtcagggatagggcccatgcctggcctactggggagaggacagaggctcagaggggtcac

SEQ ID NO: 399692 - DNA, 385 bp, Homo sapiens
gccactttcagacagggcaatatgtgtgcaaggctttactctgccatctcacaatgcaagaagatgactctgtaaaagtccctggagtgaggtgataaggatgaggcaaagacggagaataaaacctgaaacaaagtcgtaatttggggtcagaaagtgtgcccacaccagtccagaaaagcagagaattcttgccctcttttttttatccccaaagttctatttctttatgaagtcattaagaaccacaacctatccaaaatgaagaacagaaaatccagtctcagcatttatttttaaataacacatctagtcatattatggggagtcataaatacatataaattaaaaatccaggcatttaaaaacatgtgtgtagccttct

SEQ ID NO: 399693 - DNA, 305 bp, Homo sapiens
acttactgcagaaaaacataaaagaagcaaaagaagtcaccagtaattctaaccagaggcaggcagccacggtcaccattttgtcattattttgatattttcttgcattttttatacaggtccatataattttgttacatacaaatttgtatctgactttttaaacaatcaagtattatgccagtcatggtggctcacacctgtaatcccagcactttgggaggctgaggtggaaggatcacttgaggccaggagtttgagaccactgtgggcaacatagggaaaccccgtctctacaaaaaaaa

SEQ ID NO: 399694 - DNA, 451 bp, Homo sapiens
aaactaatttgagaacttgatgatgactgctgggatatttatattcttgtcactagaagagtgagataagccaagattagagttgtcataacacaaactgaaacagtgtgagactgagacagaaatatgatgccaccacttctctttgcacaaattatggtaaattcaaatgaacaattacaatggtgaagtattacttttggttaacattggaaggggagtttcttttgagttgttccaagtaataaggagaagcttgggtttagttgttgttaaaagagctttgatgaacctgcagtctctagaaaatgttagtatagaagacatttttatattacacagagaggagtcctattcacagtaaataaattatatacttgcaaatggacattttcctgctgttatatttgcatttatggctcaattgaataaaatccataaagtaggaaac

SEQ ID NO: 399695 - DNA, 464 bp, Homo sapiens
tcctaattagtgtggacacttttagaaattaaagcaatttatgtttctcttctcagttctcatatatttgaatttattttactaaacttagtagttctccaaataaccatattatctaaatattcagaaatgaaatcttcagtcagtttagtgaaatatctaatataaaacagtatattaaaaaaatctgagttgtttaaaaggtttaaaaacacttcttaaagattcttgtcagtggttacagatgagaaatataattggcaaatgtgaaatttaatttagttcacttaacaaaatacaccgtaagcaatttaaaatttggctttcaagtaaaagtcacatttgtcccaaacaatagagaaacagaccttgaagaaagacaggcacactttgaaaatgctgtaaaataatttgtagttgtccatgttggtgggtaacactgggacctatcttttctttttgtt

SEQ ID NO: 399696 - DNA, 507 bp, Homo sapiens
tgacaggttgatgggtgcagccaaccaccatggcatgtgtatacttatgtaacaaatctgcatgttctgcacatgtgtcccagaacttaaaatatataaaaaaaaaaaagaggccaaaagtgaaagaaaagcttcaatcaactagatgctaagtgcttgcctaaattaaggcagttgcaatggggaaaaaagaggagatgcaataatgaagaaatttttttaaaaagcaattgactttgatagttggtggcatgtgtgagctaaggaaggtaagtctaggatgattccttatttctgaattgagggaggagtaaatagcagttccacctatcaagatagggaataaagagaaaaagttggaatttaattcacatcaactttattttaatgggatctcatatttaattttgttctgagttttcccactgaatttccaacaactctattatcactgacttcattggataaagtgtctgtcaaatctgtatgctgagactccacagtaag

SEQ ID NO: 399697 - DNA, 514 bp, Homo sapiens
tgtatctcactgaggaagaaggaatgtttcaggatgtattttatagttttattgagtatagtacaaattatgaatgaatatattttctttaaaaacatgttattgacagaaatctatcaataataatgtgggtattgtcaagggcctgtcaatattaacgtaattatgattaaggggataacatggattttagctataataccatgtaacatctcctacatcgctgctatcaatatacacattattattgacctgttccaagactctcagtattagaggtattaccattaggcatatttgtcaatgcatactgtctacaaaattctgcatttaaatttacagtcctgtaaactttgtcagcagaaacgtgattctcaagtaatctctactgtgtcatacccactcatgcaccccctgccaggctattcttttccatctccacaataataaactaagttttagaatgaaaatgtcactgccacaccatcttaaatgttctggcaatcaaagtgga

SEQ ID NO: 399698 - DNA, 165 bp, Homo sapiens
attccctcctacgtaaaaaactatgatttcaaggtagttttattcacttaagctttctaatttctcttggttccctgaatctacatattccatctaagaaacagttaacaacattttgctaaatgcaggagattattttaactttttgaatatttattccccaaa

SEQ ID NO: 399699 - DNA, 294 bp, Homo sapiens
cacagtgtatcaaggtcaagagaagctgccctcagcagatggaaaactttcaaagtaaaaaagcttcctttacgtttaaaatatattgagttacacatgatttctaaggaatacttggtcgttctagttataaccatggctcacttttgttatcatgtgtcaagtaactgactcgtatattttcctggcagatgttttctgtggaaaggcaggaaaagagaggtgaaggaagaaggcatcccttaatatcgtgcaataaacccactaggggtcactactttcagtaggactgtg

SEQ ID NO: 399700 - DNA, 441 bp, Homo sapiens
tgctcaaaataaatatcttcaaatattttacagagtttgactctttgtcaacaaagaaaacaatcattataattcatacatctcatacatattggaagtagttgctaataaaaattataattgagtaggttttcttcatttacaagaatttctttacaggccttcctgagtgaagtgtatactggagttccatctgtggtcttccatagggttgaggatgctgttgcatcagtgatgggtggaaaaagagttgattggaaagagacaaaactgtaagatgttatcatttcaaagaggctctcctcctactatgatcagaagaaaattaaaataacaggtcagaatacataaaagcagagctgtcagcaaaagggcaagctgagaagctgcagttttggcttcctgagagatttaagaccctgttaatttttaaaccacaaa

SEQ ID NO: 399701 - DNA, 432 bp, Homo sapiens
gacttataagctataactctttattgtgttattttattggttgctttggggtttaacttacaacagtccaccttcaaggtgtgttacactacttcacacagtttaagaactttacaatagtgtacttctgtttatccccttctgttattgttgtcatgcattttgcttttacatagttataaatcccataacacagttattttgtttatatgacatataataagattaatagagacccagccttcaagtaggatttatcctaggagtgcagggttggtttaacatttgaaaatcaataggccgggcatggtggctcacgcctgcaatcctagcactttcggaggctgaggcgggtggatcacaaggtcaggagttcgagaccagcctggccaatatgatgaaaccttgtctctactaaaaacgtaaaaaatt

SEQ ID NO: 399702 - DNA, 405 bp, Homo sapiens
tgcctttttgtcttataaaaagcttctctcttaacctggagtgtgctttcccttcatttgtacagattcttgggctatgaggtttgggagagattttcaatattcatgctttctgattttcaagacccagaacatataatcctgtctctgatttctagttgaaatgacttctttcctctgactttctatgtactgtattcatactcccttaagacagcattgactacattttgtcatatttgtagtagtttatgtacctgtcttattcctctaatagattaaaaattgcttggggtgagggttgacattttattttattttttgaatttcttgtactagcacagcactgggcatacattaacttatcagtaaatgtttaaataaagatgtagtattgagaaatta

SEQ ID NO: 399703 - DNA, 352 bp, Homo sapiens
tcaagcaatcctctggccttggcatcccaaagtgctcggattactggcgtgagccaccacgctcagcctgcagaatgcgctaacgatctttgaggaagagatgccagcaagcttgatatgaaatgctacctgaattttagaaaagattatacagatggtttttaaaaccataaagatgtggcaaacactggacactaacatacatttatacattcataaagaacaatgcaagccaaaccatcttcgtagtgggtagaattgtggcctctaaaaacatatggccatgtcctactcctcttcagaacctgtgaatgtgatcttacttggagagggatctttataattaaacatc

SEQ ID NO: 399704 - DNA, 563 bp, Homo sapiens
ctcattcagaatcctctttatatttatcatagagggcttccaccactggctttgcatagttgatctttttgcagtaggtgctcggtaagtattcctcaagttgaaatggaattggaatttaacacaaaaaatcaccatcttctggagcaagactggggaaattactgtccaccagtggctggtttttgcgaaacctcagctctccctctctatatgtgtgtgtgtgtgtgtgtgtgtgtgtgtgtgtgtatacacatttttaaagggttgttaaaagaaacaaagattatacaacagagactagatatgtagctcacagtgcctaaaatatttactgtttggttcattacagaaaaagtgtgttgacttctagagttttccttagtatccaaaaacagagtttgaagcagttttaaccctatcaccttctcttccaaggttacaggaaacttctgacttttatcgccccattttaccatctctatctatcccttgcattcagtttccagtctagccatggagagtttaaaaggtttctgttctacctcctgaactcacatttc

SEQ ID NO: 399705 - DNA, 454 bp, Homo sapiens
taaactctccagctccctacatccttcctctgcagcccacagaatggaagtggtaaagtagccctcccatctgacagcagaggccagggctgggcctctctgttctctcagcttttcacaccaggaaagggaggcagaactggactgagtatcttgatagtcctcaggctacttgaatgatcgccctcagtatgttttatttggtcactgtggaacatggaaggtcatcaccgaggaacttctgcattggaatcctctacctcggaagaggaataaaaaagtacgtctctggagcgtcttccctccgacgttatccggcagttgtccccccctgctgctatctccaaggcaatcagggccagtttatgtctacagggtccccttcactgacgatctgagacactaggcaggttggaaagggtggagtggtgctaggagcaaattattcacctga

SEQ ID NO: 399706 - DNA, 370 bp, Homo sapiens
ctttgagtaacagggggccagagaaaataaactaaggcttattgtaagattctccccgggggcctgaaagcttaaggagatgaataactcctcccttctcaggcccagtcccaaggcacaaggctacttgcaccagcagtgtgctccagcaaaatagcagaagcaggaagagagccagccggaagacacgtacccctgaaaatcaagaaagaggccatccgggtacaacatagcagtaatgtcagactaggacacttcctgtttacaggagactataaaactttcgccctgtcctcacttgggggctgacgccattttaggcctcagcccgcctgcaccctggtgctcattaaaacagcatgttgctcca

SEQ ID NO: 399707 - DNA, 2142 bp, Homo sapiens
cttttaagtgaaaatatcttgacccccaacttttggggccctcagccatgggcattccctagtttccaaacaaacacggtacccgtccctcattccacccccaccaccagaaaacagttctgtttggtttatagggaggaaaatgattattatggaattaggtatgctagttattgaatacttggaattatattgtttgcttttaaaattaccttaaggaaataacttcactgtctgcttctaataatgtttagtcatttatttggtaagtaattaaagcaccatcactctcctgccctcgtcttcaggtgataatctagacatagagggagtgagccaacaagttgctgttagagttaacttgttccctaacccatcttgtgaatatcaatgctaacaacagtgtcttgtgttttttttttttcttttcttttctttttctttaaatcaatgtgcttttttcctatgtgaataattatatgtctagaaacagccatggagtgattttgctgttctgaatgggggaaagattaatagtgacatttggaaggcaagtatattgtcagatcttagatcatttaatattttatcctttctgcatggctgtggctgtatatttttcttctttgtgaatatcatgcattctgcagggacacagtgatcgggcttcttgctaggggcattcagctcacactcctgttgcctttttttggtgtctcccattgtgaatgccctaggttccccgttgttttgtaagaacaggagtttgcaccagtcagcattcaacagtccttgcatgcctttctctgcctaagctcacgtacactctctgcctcttgctgggaagacgtttctcccctttgatatttgaggcaatgaatggtcttctcccccattgtacattaacaaggttctattttcctctaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggtaagtggcatgtagaatgatgcacggcaggctgtttacgttctcctgcatttcaggaagccccacagctcagtgacacatggtactgaggggctccgaggtgttcatcaggtgccttttcccattaatgcaggaagtgtaggcatggtacccccgtgtgactgatcccttagcactgccagatgccagtgaggactggggcctggagagagagcgtttctcagtagctaagtgacacagattcatgggtgagctttaggggcccagaactcccctaaacatgcctgcaaaatgggatgtgccagtgtataagagcagttttgcagactggaagaaggacctgtattctcaaaggggaaggtgacttccacacgtccacacaaaaatgttgatgcctctgctttaaaagttgacaaattattcttttataacactcttctttacttagcgtctgaagaatcaacattatacatgaattgtggaattgatatttatatacttctcccttttaacagagtgattccattttgaaatgttagttgagataatttcagaaaggaaaaaataagtacagataccaaatgtgtatgaaactcacatcaaaccggaaaagctgtattcctggtgtgctctgagacctgtggaaaaagcattttgggagcatcttggaatagtgtttgctacatgaatagatagatgttgttctctctgcttctagtgaacagagcagtggtagaaaagtttgctttttggttgggctgattgggactccactcacattttctcctagcagcacatcccaatgggaagtaggtttccaagcctttccatggtggagtttgtctccttaaagtggagctgaatcactgcacttcagcctgggagacaaagggtaaccctgtctcaaaaaacatttttgtt

SEQ ID NO: 399708 - DNA, 576 bp, Homo sapiens
ggaaggctgaggcaggagaatggcttgaacccaggaggcaaagtttgcagtgagccgaaatcgcgccattgaattccagtttgggcaacaaagcaaaattccgtctcaaaattaattaattaattaaattagtaaattaaattaattaaaaaggatgtcaggaattcgagacctgcctgaccaacatggagaaaccccgtctctactaaaaaagaaatacaaaattagccaggcatgatggcacatgcttgtaatcccagctagtcgggaggctgaagcaggagaattgcttgaacttgggaggcggaggttgcggtgagccaaggttgcgccaagattgtgccactgcgctccaacctaggcaataagagcgaaagtccatcccaaaaaaaaaaaaaaagtgatctgaggaaaggcaaaggcctgggctcagaaggtgggatagagagggtggatgtgagagtgtggccagagcgggacacacagcagtggcttggggatgaggaaggaagggagaatctcaacggagatgcaggtggctttggccaaggtaaggaatggggctaaaaaaaaaaa

SEQ ID NO: 399709 - DNA, 319 bp, Homo sapiens
gttaatttaagagtgagcagtgtagacacactgctgattggtgcaggaagatgaaaaaaatatttatactgagaattctagccaatgcaagaagataagaaaaataaagatataaggattggaaaagaagaaacaaaactgttctttccagattatatgattgtctacctagaaaatgcaaaagaatctatcagcatatacaaaaataataatatataatacataatatataatatgtaatatataatatgtaattatatttctatacaacagcagttagcaaatataataaaaagacatcatttttatatcaaaaaaa

SEQ ID NO: 399710 - DNA, 771 bp, Homo sapiens
caattttctgtattagtctgttcttgcattgctataaagaaatacccaagactgggtaatttataagaaggtttaacggctcatagttctgcaggctgtacaagcagcatagtggcttctacttctgggcaggcctcaggaaacttataatcatggcagaaggcaaaggaaaagcaggcatgtcttacatggcaagagcaggaggaagagagtcgggaggtgccacacactttaaaaaaaaaaaaacagatcatgaccactctcccactataaaaccagtactaatgaggcatggtgctaaaccactcatgagaactctgccaccatgatccaatcacctcccaccaggccctacctccaacactgggaattacaatccgacatgattttgggtggggacacagagccaaaccgtatcaatggccatgctcatgttccagtttctgtggttgtaggcaatgcttggtgttccctggtgtgcagctacataactctaatttctgcctccatcatcacacagcaacttttcaaaaaaaaaaaaagaaaaaaaaagaaagaaaaagaaaagaaaaaagtagtaaggaagatagagttgtactcatgtaaggctcaggttttgtcagttataagttaatgacaacagggcaaaaggagtttaagatattgccatgatagtggcagaagtattaagatgacagatctgagctggatggagaggtaagtgaaaaggttactaatggaactactaatgagaattaaaaaactggcata

SEQ ID NO: 399711 - DNA, 500 bp, Homo sapiens
cctttttatttttaactaagtcattgtgatagatgagtatggttttttaaaaataatattcatatcgtggcaaaatttaaaaatagagggatttttttaaaaaatcaaaaagtttagggatcactggcatagttaaaagagtgctgctttagaaagtaggagacctgcattttagttctatttagcccgcaagctctttctgtaaccccaagtatgatctcttggaccaggtgtggctcacacctgtaatcctggcactttgggaggccaaggtggttggatcacctgaggtccggagttcaagaccagcctggccaacatggtgaaaccctgtccctactaaaaatacaaaaattagctgggtgtagcagcaggcacctgtaatcacagctactcgggaggctgaggcaggagaatcgtttgaacctgggagacaggtccagtgagcggagatcatgccattgcactccagcctggacgacagagtgagactccatctc

SEQ ID NO: 399712 - DNA, 490 bp, Homo sapiens
ccttcagaggcgcagttcagtcttctttcttttgcattctgtgttctgccagtccttcttataagcatgtctgctccccaatggaaaccagcatcctctacatctgatcttccaaagggctacttttccagagtttgaataacaagtgtatgcattattgcaggttcaaagatggagaaggaatcatgtggcgagactttcactaagccaaagattaagtccctaacatgaaaaggctaagttgtgcaatacacactgaacagtgtttcagtgaaccagcctatgcacagaaaaccaactatgtacagaaaatccagacataggccaggcacaatggctcatgcctgtaatcccagcactttaggaggccaaggcaggaggatttcttgagaccaggaattcaagattagccaacaaattgagatctcatctctaaagagagaaagagggaaagagataaacagagaaagaggaaagaaagaaagaaaga

SEQ ID NO: 399713 - DNA, 524 bp, Homo sapiens
aagtgggagcttctgggggcacatttgtgctagtcctagccttctatctatcttatcccttgtgtgcgatttgctactcttgccaattagcttccattttctattactatctcagttacagttgaccatgcatatattctcttcagaatacgcgaataagccagtcacagcaatcagtgctatgcacatgcagactactactatggataactacagtgcgattcgttcatgactgagcgtggagcagagtccacacagaagttgatcgtggtacccaaggctgcttctcactcattctggaagcagaccgcaaaagtgaaaagcacacatcaggggaatacattcagttttcattattgacagttgtttttaaaaaagtatgatacgaaggcatttatacatttttgtgataggcattattagaaaaaacaatatccaggcactcctgaaccataagtttgtgagaactattatactgttagattaagaagcaaaagtatttattagacagataaatgtgaaaa

SEQ ID NO: 399714 - DNA, 758 bp, Homo sapiens
ggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaa

SEQ ID NO: 399715 - DNA, 999 bp, Homo sapiens
  misc_feature (248)..(248): n is a, c, g, or t
  misc_feature (356)..(356): n is a, c, g, or t
cgcgaaagggcagcgccgagaggaacgagccgggagacgccggacggccgagcggcagggcgctcgcgcgcgcccactagtggccggaggagaaggctcccgcggaggccgcgctgcccgccccctcccctggggagaggcatcgctgttctcctgctgcgtcgtcgccatgcagctcgtcgccggctcggacgcgtcagcgataacgcgcacctccttcagcacgggcgtcgctgcccgcgcgtcangtcacccgcacaccccgagccagtctgtccggcgactcataagcaggccagacgcgcggcgtggcgcaaccggtgcgcagcctgtgtcgtgtgccgcactggcaaacnaacagagccagcttgtcatcactcttctccgcttgatccttcgtcaccgatccatcggccttctgttcgtatgtatcaaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaa

SEQ ID NO: 399716 - DNA, 623 bp, Homo sapiens
aggccccgctctacccagtgcagagctgctggagttccacagaccctcagcagccccgtgcccacagcagaggtgtagaggtcccccgcctgcccctcggctacatgaacaagacaggggcctaaacttcggccctggccaaggcttagatttgcccaggaaggaccggaaaggctagaggggccagccccccacaaccatcccaagcccctgtggacactggagaagcccataggacagtcaggcttctgaggatcccaggacagggccaccagcaggggaggccctcaatacctgggccatcaggctcaatacctgagcccaaacaacaatgagcagattcccaggctttgctttcactgggtggcccagggacagtgacatggtaggagacatgcaagacagagactgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaa

SEQ ID NO: 399717 - DNA, 762 bp, Homo sapiens
ataaagtcaatcaatacaggacaaaactgaagaacttacagagaactggagttggagccctgattaaactctgcctgaagtcctccctatctctgaacttctgttaggtcatccaataactccctttaattattttttagttcaatgactctgttgcttgcaaacaaaattatctttactgatgcatgtggtaaactggagcagcttacagtgggagaaaatcaccaagtgcagctcaaatgtaacatctactttttaaaaagatttgttgtcctctagcctgtaaaatgacttaatctgtatttcataaagtacataaaagtcatactttccagttgttccctacagaatttattggagatattatattctgtcaaaattataatgaatttgatggttcatcttggttcatcttgactacaaatgtttagtgtttataaaattgcctgtacaaagtcatgataaacctgacagtggcagggatggtaaagctggcttcttgaatggtttcttcatggtgaatgatctctccttactttttttttaaaatctcatcctttatcctgtgtgtttccttttgttcttttcttggcagctacaatctctggtatcttgaaagtcagatctaattgaataggaaataaatgcatgctggtaactctgtggattttatttccctaatttctgctattgctgcaaataaaaaaaaaagttaccaattttctagcacaggcattcaccaagcaataacaaaaaccactt

SEQ ID NO: 399718 - DNA, 956 bp, Homo sapiens
attgataagctgatcctaaaatcatatggaaattcaaggatccagagtagccaaaacagtcttgaaaaagaagaggaaagttagaaggctcacactttccaacttcaaaacatactactttagagttacagtaataaaaatagagtggctgtgtcagaaggataaatatatagatcaatggaatagaattaagagtctagaaataaactcatacatctgtggcttactgattttctacaagagtgccaaaactatttcatgagagaatagtgtctcatggtacttggacaactgtatacccacatgcgaaagaatgaagttggccccttacatcatatacaaaaaaattaaagtggattaaagacctaaatataagagctataactgtaaaactcataaaagaaaacatagggccaggcgcacgcctgtaatcccagcactttggaatgccgaggcaggtggatcacctgaagtcgagttcaagaccagcctaacgtggtgaaaccccgtatctactaaataacaaaaaattagccgggtgtagtggcgtgtgcctgtaatcccagctgaggcaggagaattgcttgaacccaggaagcggaggttgcagtgagctgagatcacaccattgcactccagcctgggagacaagaatgaaactctgtctcaaaaaaaaaaagatgggcccggcgcggtggctcacgcctgtaatcccagcactttgagaggctgaggcgggtggatcacgaggtcaggagttcgagaccagcctgaccaacatggtgaaaccccgtctctactaaaaatacaaaaattagccaggtgtggaggtgcacgcctgtaatcccagctacttgggaggctggggcagaagaattgcttgaacctgggaggcagaggttgcagtgagtggagaccgcaccattgcactccagcctgggcgacagggcaagagt

SEQ ID NO: 399719 - DNA, 269 bp, Homo sapiens
ctctgagaagatttctgcgaggcggtgatttgagccagaaagatgtacagaaagtggataaaagggggcaggtgagggttagaacagaatcatgatggcactgagaaaggactggagaaggcctagagatacaatggtttagcttaggatagtcataacggctttacgggggctgtccaccgtgtggtccaacttcagatctcagctgtgcccatttgtttcaaatgaactagtctaaaatggaagaaacgatatctggctcaaatcta

SEQ ID NO: 399720 - DNA, 536 bp, Homo sapiens
cacccaatttggtgcttggcctgtccggtggtctccatctctcactgctgctttccaaatgctctgcctgccatttctagaaggggaaatgggaggctgagggaatcagtaaggcacccaccaaggaaccatgaaggacgctggattcttgctcatgcccttagctgggtgctgagctgggcccaggttgcagtaaaacagggctcctgacccaaaggtcacaggcacagtaatggaggctgaacggaccgctgtggggactccacccttcaatttcaaaagctcttccgcacctccctcccaaacttaggtttaaatttgaaccgcctcatcccttggggaagaacccccttactctgcctcctcctcctcccatgcgtggaatgcaagagcacagagggtaggaataggagacctccttttctcaaatccaggagagcacagagctctgcacacccgcatgcccactcagcacccccaagtcccgggcggagaacggccagggtaccaaggcctgggacagggacgcggccgca

SEQ ID NO: 399721 - DNA, 573 bp, Homo sapiens
tggcatggatttgggaaggatgcagggcagcaaacaagcaagctggagagggcagcgggatgggggcccaagaggctaaatcggaggttctcaaatgttctcagtccatgtcactctggcgtctcaggtatttttttcattatacttctaggcagagaggaatacctaacagttccatgagttaaataggtagatccaaacaactcaataaatatttacgtcctaacaacttagtaactatttgaaaagaaaaagatataaattgatgagaaggtggtatttttatttcattcttatatagccaaaattttcaatgagacctatgtgctgctgggcactatgcagcttttctaactttggaattagatgggattctgccaccccatttcctgcttcacattgatttttataccacactggctatttatcacagcatcccctgaaagcccagcttttcacagatatgacttcaccgaaaggaatgtagtgatctagtgttaaaactatgaactaccttaagcccgtagttcacatggtagctgacagatgttgattgtttcagtgtttgcctca

SEQ ID NO: 399722 - DNA, 734 bp, Homo sapiens
ccacacccagccctgaaggcttttaagcagggaggtaagtgagctggtccagcatgtgtttttaaaaactctttctccagcctgggcgacagagcaagaccagttctacctggctagggtggccccagagtcatggcggaaggcgaaaggcatgtcttacatggtggcaggcaaagaatgaggacacccaatcttctttactcattcatctaacactgactgtgtggcctggcacccaccaggaatgtccctgccctcaaagtctttacaggctgttggagatggggcagatgcccaaataagtcattgttgtcccaggtagtgccatgccaggggccatccagggagctgagggcccagtaaaaaggcacttaaactcaaatgcatggagaaggggacagccagggtgtgattagggaagacttcctgaaggaggtgctgctccgagaaggttgattgggtggtttttgtaggggttttcttgtttccactttttaaataactacttcatgccacatgctattaggtgcttttcacatacatcgtcatgtttaatttgtaccaacaaccctgtgagataggaaatagcttccgtatgttagcagtgagtaagctaaggatcagagaggggaggttgcttggacaactggcttagccatgattagaactccaataggttcttaaatgatgatagaaaaggtgtaggaggatgggagccgaggctggcatacctg

SEQ ID NO: 399723 - DNA, 700 bp, Homo sapiens
tacctaaaaacttgtgatctctgtggagtcccagttcacactccagcctgggcgacagagcaagaccagttctacctggctagggtggccccagagtcatggcggaaggcgaaaggcatgtcttacatggtggcaggcaaagaatgaggacacccaatcttctttactcattcatctaacactgactgtgtggcctggcacccaccaggaatgtccctgccctcaaagtctttacaggctgttggagatggggcagatgcccaaataagtcattgttgtcccaggtagtgccatgccaggggccatccagggagctgagggcccagtaaaaaggcacttaaactcaaatgcatggagaaggggacagccagggtgtgattagggaagacttcctgaaggaggtgctgctccgagaaggttgattgggtggtttttgtaggggttttcttgtttccactttttaaataactacttcatgccacatgctattaggtgcttttcacatacatcgtcatgtttaatttgtaccaacaaccctgtgagataggaaatagcttccgtatgttagcagtgagtaagctaaggatcagagaggggaggttgcttggacaactggcttagccatgattagaactccaataggttcttaaatgatgatagaaaaggtgtaggaggatgggagccgaggctggcatacctg

SEQ ID NO: 399724 - DNA, 258 bp, Homo sapiens
tgataaaaatgttgacggtgctttcacatgccactaaaacctccttcaggctgctcttgagatacactgtcatgtctacagaggcagacgcctctcaatgccaatgtcatgggacaaacaaggatcactaggtctttcctttccgtgtttcaggcatctctcattggcaaagaattcaaaacgcatttaaaaataagtactcagtgcctgaattactttttggatggagatgacatttgtgttatttttccactctta

SEQ ID NO: 399725 - DNA, 287 bp, Homo sapiens
tattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatat

SEQ ID NO: 399726 - DNA, 323 bp, Homo sapiens
tctacggtattctgttgtatcaggctagggcagacatggggcattcctacacccagacatgcggatggtttcttgatatatcacctgtgactctttctagggccttctctggccccagaagcatgcttggcttggccagtgcagggctgagcagaagtgttgaagggtcagtgcctttgggacagccctaaacagtgacaggcaggcgtcagtggacggagccccccaccctgctgctgaccctgcagtagacaactctgagacctgctttcctctgtctcccagcaagcttgagacactgtgccagccccttcccctccctg

SEQ ID NO: 399727 - DNA, 380 bp, Homo sapiens
gtagaataacattacagagaatatatggagaatgtctatctttacaaaagatcatttattttttttagtcagttggcagatagtgctgagctcccctgttggtaatgcagcgaggcgcacagggcccaggtcacttgtttagagccacacacacagcaagatagcagcagggaggaaaccgagagcaggtcttctcatccccggccctttgcttttcctctccaagtttttccttattccaagtttttctgctgtctgtaaggcccgttatccagcactggctgcgtggggtgtgcatccctgtttctcagctcagagggctgactgcacacaatagatgtccacaaggggcttgtggtacacctgtgttgcttctagca

SEQ ID NO: 399728 - DNA, 536 bp, Homo sapiens
actgaatctcacttaaaaataatttttttatagtaaatctgttctctcagttaaggatatgaatgatcctcagaagcaatacaaatgaataagacatttaaaaacttcactaagcaaaataatgcaaattaaaatgcatgttttagtcatttgtattgattcacttgtcaagttaacaaagctttacagttagaaatattcagtatttgcaaggatacaatgaaatggtactattctaaactgctgcagataatgaaactcattctgagaaattatttggaaataccaagagccagaaacaaactaaatgctcaaaaattgaaggatgattaaatttgctggtgtattcttgttatatagacataataaatatattttttaaaacaatatggaaaaatgcttgctgaataatgtgtgaaaaatcaggatagaaaattatatgtatgttccaaatgatgtttaaaacaaaacatatacattcttacattctttcttacacgtgtttcttgaaaataaaggctggatggtaaatatca

SEQ ID NO: 399729 - DNA, 107 bp, Homo sapiens
gaggcaatttattaacctagcatggtttgttctaatgcttcttgttgtcagctgccacctctccggtgattctgtccacatctctctgtccctgaggtattagtttg

SEQ ID NO: 399730 - DNA, 483 bp, Homo sapiens
gtttgacatgaaattgactttttcttctagcaacacttatgaatattcaaatacaattatggaaaagattttttgcactgatcagcataacaaacaaattagacatcccagtgtgcaaatataactttctgaatttcctagttttaaatattccagtggccaggataccctatccagaggaagcaggaccgtctcagctgaccagggcccttgcctgctaatagcatcatgcataccttgtttcttcatgaggctgcttgcccgagttccaatccaccaggaattcatcttgtatcatagctgatggatcccgtgtctcgtttctaagttggagcatcactttgcagctcccaaccagggccagccacaaaatttgaaaggcccagtgcaaaataaaaatgcagagccccttgttcaaaaagcaggaaaagaatgggccagcaaaggaactaaaataaacgaaagcttttccctttcatccat

SEQ ID NO: 399731 - DNA, 521 bp, Homo sapiens
acagagtgagactctgtctccaaaaaaaattaaaaattaaaaaaaataataaaaataagaagtttttttgggggggattaagtctcactgtgttgcccaggctggcctcaaactcctgggcttgagcaatcctcccacctcagcctcagagtagctagactacaggcatgtgccactgagcccagtttttatttcttaagaacattctgacttaagtttaataaagacacagagaggccgggcacagtggctcacacctgtaataccagcactctgggaggctaaggcgggcggatcacctgaggctgggagttccagaccagtctggccaacatggcaaaaccccgtctccactacaaatacaaaaaattacccaggcgtggtggcaagcagctgtaactccagctactcaggaggctgaggcaggagaatcgcttaaacgcgggaggcggaggttgcagtgagctaagatcatgccactgcactccagcctgggcgacagagcaagactccgtgtcaaa

SEQ ID NO: 399732 - DNA, 557 bp, Homo sapiens
gagaaatgcttcaggacattattctagacaaagattttgtgggtaagacttaaaaagcgcagatgacaataacaaaagtagacagatgggtctatatcaaactaaaaagctttggcacagcaaaggaaacaatcaacagaatgaagagataacctgttgaatggaagaaaatattttcaaactattcattcaacaatggactgatatctggaacatacaagggattcaaaggactcaacagcaaaaacaacggcaatgacaaaacctacaagcaatcccattaaaaagtgggcaaagatataaatagacatattttaaaagaagatgtacaaatggcctgatagcatatgaaaagattctcaacatcactaatcctcagggaaatgcaaatcaaaactacaaagagatattgtctcaccctagttagaatggctattatcaaagagaacaaaataaaaatgctggtgagaatgcagagaaaaggaaatttatacatgatcaatgtgaatgtaaattagtacagccattttggaaaacagcgtggaggtttctcaaaa

SEQ ID NO: 399733 - DNA, 1244 bp, Homo sapiens
tgaaaatgcctttcccttagaattctcattctctccttcagttactcacatccaaaaattatttaaggcctaaaccaagtccaatcatcttcaagcagctttcttccactcccacccaccatagagatagatctctctttcccttaccttcctgtagcactttgttatctatacctctcatgtgcacttaccccagctccaattctggatgtcttgttctcctagtgagattgtgagctcttcaaggtaaggatcatgtctttgtgcttccttcttttgtgactctgaagtgcataacatggtgatgtgccttgggaattttcaataaatattcatgggaaaaatgaacatatcaatgtattaagctcaataaagtccgttttcctaaaaacagtccttcattgctgaagtgtgaaagcatgtaaactataatctactggatttggtatttttattattcttttttactaatatatacattctaacactttttgaccactgcttagagaaaatagaaggcatgcttatcaaatttcagatggcacgaattagaagtaataagtaatgcacgagataacagaatcaaaaactagacaaattagaaataagtaaataacatttaacagggataactacaaaattagattttaaaagaacaggtacccaatttcagtatggaaagacatggctaacatcaggttttaattggctgctagactgacatgagcccagagtggtacacagaaccctgttcatagttagactcagggcactgagtggtaggtgaaatattcaggctccaacaaggcacaggcatgaatgaagattgctagatggtggccagctagagacagatggagcctcaatgtctggtaaagtctgcagtaaagagcagaatgaagtcctatactttatttaacccgggagctaaacaaataaacaatatataataagaataaataggctgggtgcagtggctcatgcctgtaatcccagcacgttgggaggccgaggcaggcggatcacctcagttgaggagtttgagactagcctgaccaacatggagaaactccgtctctactaaaaatacaaaattagccaggcgtggtggcacatgcctataatcccagctactcgggaggccgaggcaggagaatcacttgaaccccggttgcagaggttgcagtgagctgagatcgcgccattgcactccagcctgggaaacaagagcgaaactccatctc

SEQ ID NO: 399734 - DNA, 396 bp, Homo sapiens
gatgaggccttcccttagctcctcaagctgaaggcatttcccagcctccttgttcccctccgtgtgtctcagcttggtcctcatcctgggtccccgacactcctctggcacattagggtctcccgctcacctcagggcctttgcacacactgttgcccctccttggaaagctctcctttctccgtttctcctgcatacttggctaaaagtcacttctttgtttctgtgggcctcccctggatccccaaggcttctggacatttccttgagaccgcctgtcactgactcacttcgttcccatggtgcccgcagctctgcggacctcggagggctgccctgaacacctacagttaacgagggggatccagtgctgaccaaaagaaaaacccctgccct

SEQ ID NO: 399735 - DNA, 596 bp, Homo sapiens
cacaaagttttatttagacaggaagaaaaagttcaaaagttctattgtgcaatatggcaagtagagttaataacaatgtattgtttacttccaattgctgggagtagattttaagtgtacacacacacacagatacatatgtgagggaatgcaaatattaatcagcttcatttagccattccacaatgcatacatatgtgaaaacatcatgttgtatacactaattatatacatttttatttgtcagtttaaaagaataataatgaaagaaattacacagctaaatcaaaggatgcacgtgtcagagtaactggaaagacagcacatgaatgccacacaagagtcctgttacgtacaaccccactcacaatcacctcttttttcattctgtacacaccaggctcactgcccagctaatagccccattaagcaaacccaggttctcctatatttcaacctctgtttagatacattgcctcacactattaataagtatcatcagccttcctagctttgccaatgcctcaattccctttccgcctttgtgcacatcactccaacaatcactggtcgactttattgaacctgcctcatgg

SEQ ID NO: 399736 - DNA, 454 bp, Homo sapiens
ctagctacttgggaggctgagggtggaggatcctttgaccccaggagttcaagtacggcctgggtaacagagaaaaaccaggtgacttaaaaaaaaatgtaggtgccactcaggggttcaatccccagaccactggcatttgaaagcatgttacataagcgtttcatattgctagggtcaccaaatcaatttagtatgtcactaatggcatgaaaaaaagacataatacaaagtgcagaatgtttaataaatcttttgcttcaagtataaatcatgtgtatactgggtcattgcaaaatgtatttcttatgtgagttgtggctaaaacatttgaaagacattgatctaaattaacagtcttcaaaattttgtttgcatgaatttatcattgtaagtttagttacaaaggatttcatgtggattgtaagcattagcattgttaaataaaacctta

SEQ ID NO: 399737 - DNA, 278 bp, Homo sapiens
gccttaaacatgtatttctgctctaaacattcagtagtgccggcatatatgctcagataaaagagaagatatattaataacataatacaataactgacagtaaatagtgagcttggaatatatttttacctttatagctatttaaacatggcagataaggctggagccattggtgcttaattaaattgggataaaatgtggacattttgacagcaccatggggtacaagtgaaagggagttccctaaagtaagagagtaggtcattcttttgcaccta

SEQ ID NO: 399738 - DNA, 805 bp, Homo sapiens
gctgagtacctcctatgtgctagacactgcagtggttgctgaggatatggtggtgcatgtgataaaccataaacatgattcttccctttgaaacttatactctagtggagaaaggtgggattaaacagctaattatgcagtgaaattttaaattatgatcaattctgcaaatcggaaagtatacaatactatgagaatatagcaatcagggacctaacctggcttgggggaaaaagtgatgttaaggttcatggtcaagggaaagctttcttggggaaatggtattttgagttgtactctaatgatgagttgaagtcaaccagggaaaagttaggtggggaagacacgaattaaaaacttacagatcaggaaactggcacattcaaggaactgacagaaggtcagtaaggctggaacaaagaaaataagggagaaaataactcaagctggtgctgataaagtcagcaaaaggccagatgctgcagccttataaactaagtcaaaaatcttgatcttggctaggtgcggtggctcacacctctaatcccagcactttgggaggccgaggcggaagggtcaccaggtcaggagatcaagaccatcctggctaacacagtgaaaccccatctctactaaaaatacaaaaaattagccaggtgaggtggcgggcacctgtagtcccagctactcgggaggctgaggcaggagaatggcatgaacctaggaggcggagcttgcagtgaaccgagattgcaccactgcactccagcctgggcgatagagcgagactctgtctcaaaaaaaa

SEQ ID NO: 399739 - DNA, 502 bp, Homo sapiens
attctaaaacacttagtacagtatgatcttcaggttaaattataaattaacagcagaatgagactgtgttttaaagcttgtcaagacacctgttcaaggttgatttaatacatggaataatcaggctcagctatttctatgtcattctcagtgcctaaaaacaacttttacctaatttttgaagccagcaaaaacaataataacaaaacctgtagtatttacaaatatgtcatttgtactgtaaataacatactttttctcaaatatacctgaatgtgtgctatttgaaataattccaaccagcctgaccaacatggtgaaaccctgtctctactaaaaatacaaaaattagccaggcgtggtagcgcgtgcctgtaatcccagctactgggaatgctgaggcagaagaatggcttgaacccgggaagcggaggttgtagtgagccaagatcacagcactgtactccccgcctgggcaacagagcgagactccgtctccaga

SEQ ID NO: 399740 - DNA, 279 bp, Homo sapiens
cagacatagtggacaagatcaggcagaagaacatttaattaaagctaaggttctggccctaaaccacattatcagtttcctggtgagctaggccacacttcagataagtctcaagcactttctttgcctaagctctgaaaaatctacgtacctgcaaaaaaagtgggggtgtggtagggagttctgaaaaaaactccttagcttctttttctacaccttaatctctgctgtgctcaggtcaaagaaaggtaatctgagtaaagaacagacagaggggag

SEQ ID NO: 399741 - DNA, 457 bp, Homo sapiens
gtcagaatcagattaggtagaaataataaaaaaaaagttctctaattcactctacctcttacaaatagccatgctttctcagtagagaatacatatttttaaaatggtcaagctctcccaaatgttgatacaggcaacacggtagtctatgtgctcaaatgctaactcgactctatcacagctaaaccttttaaagcagtttcttcaactattaacactgcttactaaacccctattacacagactagctatgctatttatgcccacacagaatcacaagagttgatgtacatttttaagctttttaattagaaggaaaatactaccacattgatcattataatagtcttaagcacatagtacacaagtttcaaatctcctaaatcccacttcttgcccagaggcaatcaatgttaattgtttggcatatgtatttctggacatatctcttatgtct

SEQ ID NO: 399742 - DNA, 489 bp, Homo sapiens
atgcaaaatctgtatgagaaaaactaccaaactctgattaaagaaatcaaagaagaacttaacgaagaaatattctatgttcatggataagaagacacttcattgttaagacgtcagttcttcctagcttgatctaccgatttagcacaaacccaatcaaaatcccagcaagttattttgtgggtatcaacaaactaattttatatggaaaggcaaaatacccagaatagccaacatagtattacgaaaagataaaatcaaagtactgacagtccccaacttcaagatttactataaagctatagtaatcaagacagtatggtattgggggggtggggaaagacaaatagattaaaggaacagaagagagagcccagaaatacaccccacgggtacagtcaactgatctttaaccaaagaacaaaggcaattccatggaggaagaatgtcttttccacaaatgatgctagtacaactggacatccacat

SEQ ID NO: 399743 - DNA, 275 bp, Homo sapiens
caaccagtgggcaggggctggctgaccctggagaacggggcgccttgaggtgcctgaggccccaggaagggcttagtgttggcgggagccccaggccacacagaggaggacagacactcactgggcttccaggcctcctctgggactgtccccggccagaactctggctcattcggcctcggtccctacccctgttctagccggacggtcaggtgtcccaggccccgcgggctccctcactccgccctggctcctctctgaggctcccactgccg

SEQ ID NO: 399744 - DNA, 564 bp, Homo sapiens
cagttttgtacaaatatatttaacaaatgcatgtatatcatctaatataaaatgcatttcttattgtgacttgataaaaaaaatttttttaaaaaaacgttggtcaaaagttttgaccaaaacattggtcaactcaggggaaaattcacaggagtaaacatgtgaacttagggtgactaggacacatgcctgatctcatggacaactctgaagagggacagacactccatattaatgctaccacagactgtagactacaggagccaagaggtgagaacatgaacaaaagagaaggagccctggggaaagggatcaggaagtgtcaaggcacagaggagggaagtgtgaggctggttcaggagatgctgaacatgccacttagctatggaggtggagtaggagccacagctgggaaggcaaacggagccggatgaggaaggccttgaacgtcatgccaaaaagtttagactacttcacttagtaggctgaggtagtgtttcccaaactgcaggttgagaattaagaacttaaattaccgagccataactagtatttttaaaaatt

SEQ ID NO: 399745 - DNA, 1005 bp, Homo sapiens
ctcattttacaggttagaaaaatgagacccagagaggtttaagtgatttactatcattaagtagaggaattgattctagaaccaagatatcctaactctagtagaagataatttttgatgaatatccttgatattagtaaagggaggctaatcctgtatatagaaaaagaataagagacttaaaaaggctttttttttcagcatccttatttaaagagatataattgacatacagtaaatttcacacatttaaaatatgcaatttgataagcttgacatgctgataacaactgtgaaactgtcagtgcaaacaatataatgaacatatttaccactccaaaagtttctttgtgtctctttctaatctcctcctgtcattattccctttctcccagtccctactttctgtcactatagatgaatttgccttttgtggagtttttatacaaaaagaattatacagtatgtactttggaggtggggggcatggcatctttcactcaaatcatgattttgatatttcaccatgctgcagtatgtatcggtagttcaatcatttttgttgttgagtagtatttcattatatggatatataataccataatttatctttacctgttgatggatatttgggttatcaccaggtttgagatattacaaataaagatgttttgaacatttgtgtagaagttttagtggacttacactttcattattcttgtgtaaattgcctaagagaaaaatggctaaaacatatagcaggtgcatgttttgagtttttaaaaagctaccaaatgattttccaaagtagctgtatcattttacttttccactagtagtgtttaagagttctggttgttaaccaggtgcggtgttttgcacatgtggttccagccacttgggaagctgaggcaggatgatgaattgagcctgggaggtcaaggttgtagtgagaggtgattgcccctgcacactccagcccaggcaacagcaagaccctgtctc

SEQ ID NO: 399746 - DNA, 330 bp, Homo sapiens
gtcgccatctttaagaactgtgacactcactgcggggctccgcagcttcattcctgacgtcagcgagaccaataacccaccaattccagacacactgcgtcctgtgctgcagggggaaaggcacggactcaaaactgccagctttgttctgattgggagctctgcctgcctgacaggcggcctgggctgagaagagtggggcggttcacagggagagtcccgcggagcaggagggccgtgcgatgatagtgaaaaacaagaaccatctgccaaagggctgtgctgcacccaaatgggctctgaaataaggaatgggacctgagccgcctt

SEQ ID NO: 399747 - DNA, 430 bp, Homo sapiens
aaaccacatctctacaagaaatacaaaaattagccagacctggtggtaaatattgtagtttcagctactcaggaggctgaggtgggaagatcgcttgagccctggaggttgaggctgcagtgagccgagatcacaccactgcacttcagcctgggctacagagagagatcttgtctcaaaacaaaacaaaacagaaaatgaaaataagcactaaatgaacctgtaataagggtcaatgcatgcttcaaataatgatctttgagcttctaagaaggcaaggagggaaaaaagacacaatgagttatagaattctctttttgagagtggaagaagacaatttcttggagaagatgaaattccctgtcattgaattactttgaaaaatatttttttctatttataaaagtaattagataacttctgataatgt

SEQ ID NO: 399748 - DNA, 422 bp, Homo sapiens
tttgaggtgagtctcactgtcgcccagactggagtgcagtggtgtgatcaatgcagtggcccattgcaacctctgcctcctggggttcaagtgattctcctgcctcagcctcccaagtaggtgggattacaggcgtgcaccaccaggcctggctacaaaatctgaaactttttgagtgatgacatgacactctaaggaagtgcttattggagcattttatttttcagattttaagattagtagtgctaaatgccagtgttccaaaatccaaaaaaaagaaaaaaaattgaaacccaaaacacttaaggtcccaagcatttcagataaagggatacccagtctgtattaacattttattttacttgcattaccatatattcatctctttgttgctgtgtccatccattaatgtatttttatac

SEQ ID NO: 399749 - DNA, 280 bp, Homo sapiens
ctgccatcttgtcttttccgttgttcaagaattgtgcctagaactgcctttttgtttcttgtctcttcatttaagtagttgtccacatcttttaaattctccacctggagaacctgaaaatttcattaaaggaccctcctgttccatctggcatgttggtttctatgcctcccctgcaggaatgctccaggaaggctagatgggggctgagcggccttcataggggttaatcgcattgctacaaggcagccggcatcttactgagttaaacttctgcatg

SEQ ID NO: 399750 - DNA, 577 bp, Homo sapiens
tcctgagaatattctctgttaccctgcagtaagctgtctacattccaggattcgacagcctgcttgcttaatagccttcaaaaacatacatgtcctgtcatacctgtgctatgttctgactacttggtaacttgttagctcagagattaattttagggatgttttatataaggaaacctctcctctaatgctacctccttttgttacctgttaatagtcatggtgttaggtttattgaatgacttttgcctctatattattttcttctcaatgttcttttcattaggaatataatggccgggcgcggtggctcatgcctgtaatcccagcactttgggaggccgaggcgggtggatcacctgaggttgggagttcgagacccgcctgaccaacatggagaaaccctgtctctactaaaaatacatagttagctgggcgtagtggcacatgcctgtaatcctagctattcaggaggctgaggcaggagaattgcttgaacctgggaggcggaggttgtggtgagttgagattgcaccattgcactccagcctgggcaacaagagtgaaactccatctc

SEQ ID NO: 399751 - DNA, 371 bp, Homo sapiens
agggaaactcaactcagatttctttgtcccttggaggtgctgggcctccgacattgcccagctacagtccaagaagctcttatcatcggcgacctcatgacctttgggcctcagcgcaggtccctgcagatctgaaagttctttaattgctgagtcaagtcccatcctcaaggaacctcccggcccatctcccaggagaacaatctcttcctactccccactccccatctcagtgcttttagccagcctaaactacaagcccaagaggcatttctcattccttcaacaaatatttgtatatgtttattgattacctagtaagggtattctagtcagggagatcaacaacagacatgcaaacaaataaatcc

SEQ ID NO: 399752 - DNA, 1608 bp, Homo sapiens
  misc_feature (949)..(949): n is a, c, g, or t
caagttatgccctgacctggaaattccccagagttgctaaaagaactgaatgggggatactgtacataagagcacttaagcaacttaaaatgtcacatgtagggacatatgcgtgtcatgtgaatagcagctgcattttgaagttgcaataagtgtgaggaaaatgtgcttgttagctcagctctagacagatccatggatagaaagacatagacatggatccccatccagctaagtatttgcaatccgcaggtgaagcctggaaacccagagaaatggacctgttccatccgtgacagaagcgctcccaggacctaaattaaagggatgttagaatgttttgagaatcttggcagggccattaggtagtgtttgtagcttttggatgcttttggtggagggaaaatgagatgggctcacttgggaggtctgcctgcagtttccatccaaatttctaatcaacgttgtggttttatcatccatttccggaatcattaccccttaaaatgtgaggaaaacgactctccttttcttcaactccccatcttttccaaataccgctgcgagtttttgttgccaacagcttttcccaatgtgcgtgtacttaccaacgtccagactcctccctcccatcggccagccttgcttggtctagctattattcaaaggggaacatgcgtgagatatcactttgtttttgccatctaatggattccaccccccaaagtatctgactttgacactcaggctcatctgcaggacccgagggtgtcttccctcccctcccgttggctggctaaatgggttaatagaatacattctcttttccttttccgtgttttgtctggcgtttgcaatgccaagatttttttccagatgtcccctatttcctatttccacataccgcacatgaatcatcatctggcagaggaatcgtgagaatccatgngatcagtgtgcgttcccacattcacctacttttgtcttttttgatagttctttgaaaacaatgaatttttttaaaaatatgcctgaattcaagggtaaaatatcaacaatgtaccctagaaaagcccctggaagcagatctatgctaaatggtttattttattctgcacacgaggcccacccgtcgctggctcccctatgccttggacgtcactgatacacacacatcccgttcccgaacagggagagtgagctgcacattctcgtttccagctccacttcctagatctgcccaccgtaaaatctgcccttttgccatgcgctgtgggacctgttagactcaggagagaccatcatacaaattgatggctcttgatttgcagctgtatctggagcttaccgaatctagtgcagctttaaaaatagggagccgattctgtttccaagttcagaaggagcagcgatttggcatctaccggttcctgcccttcttttttgtcctgggaggaacgatggagtggatcatgattaaagtgcgcgtgggccaggagaccttctatgatgtctaccgtagaaaagcctcagaaagacagtatcagagaaggctggaagatgaatgagactgaacttcagcagtcaataaagtcaatatgaattttt

SEQ ID NO: 399753 - DNA, 445 bp, Homo sapiens
ataaaatagagacttcaggactcagcagcagagactccatctcagaaataatagtaataaaatagagacttcaggactcagcagcagagactccatctcagaaataataataaaatagagacttcaggactcagcaacagagactccatctcagaaataatagtaataaaatagagacttcaggattcagcagcagacactccatctcagaaataatagtaataaaatagagacttcaggattcggcagcagacactccatctcagaaataatagtaataaaatagagacttcaggattcggcagcagagactccatctcagaaataatagtaataaaatggagacttcaggactcggcagcagagactccatctcagaaataataataataaaatggagacttcaggactcggcagcagagactccatctcagaaataatagta

SEQ ID NO: 399754 - DNA, 219 bp, Homo sapiens
ctctcacccccaggggagcatctgacaacctagaacagcaccctcaccccgaggtgggcatctggcagcataaaacagcacccctactggcagatgagcatatgacagcctggaacagcacccacacccgctggcgagaatctgacagcctggagcaacacccacacccccaggtgagcatctgacagcctggagcagcgcccacacccccaggtgagc

SEQ ID NO: 399755 - DNA, 371 bp, Homo sapiens
ggttctaaagactgggacgtccaagatcaaggtaccagcaggattgatgtctggtgagggctgctctctgcttccaagatggtgccttgttgctgcatcctccagaggagtataacactgtgtcctcacatggtggaagggatggaatgggacaaactcactctttcaaatctttttataaaggccctaaacccatccatgagggctccaccctcgtgacttaatcacctcctgaaggcccaactgcttaattctatcacattggcaattacattttagtacttgaatttgggggatcggtgggtataaaacagtttaagaatactgaagcctgtagccaagttgcactccacaagtgaatcaccaatagt

SEQ ID NO: 399756 - DNA, 521 bp, Homo sapiens
aataataataataataaaaataaaaacataaatgcagattttctgacgcaccacagacaacccaatgagaatctccaggggtgaggcccagccagttgtggtccaatagccctcttgagatctatcggattctaaagtaaggcactttaaagggaagaaactgctgtaactttcaaatggtgacttttctactctcagtgcttcctggaatttaaatctctcgagattcagacttacccagggtcacactactacagtgtgactaagttacgtgtcttaattcaaaagcttgaaaattaaaaacaaaagagagaatataaaatttgatttggtttacacaagtattataattatttatatgacctgctcaccatttttaaataccaaaatgccatactgcttaaaattacaatacttatatattttaaaacatgtattagataagctttgttcttcattttattttgttacatgagcatggctctctctctatgactttagaagattaggacattgtgacc

SEQ ID NO: 399757 - DNA, 235 bp, Homo sapiens
caaattatattggctaacacatccagaaaaatattaagtaatagctgtaaaaatggataaactgcttttgttcttgacttcaagtttgggagcacttttatggtgcccccattaagtatgatgctgaataattttttgtatttttagtagagatgggaggcggaggttgcagtgagccgagatcatgccattgcactccagactgggtgacagagtgagactctatctcaaaaaa

SEQ ID NO: 399758 - DNA, 303 bp, Homo sapiens
caggtagaggtgtcatctatttttttcaaacagaaggcaaaaaacttagggagagggatttctattcattttatgatacttttatcaaggcattatttttcataacttctctgttgcacagaaattgatctaattggtcatcctaggtttctaggagtcccacttttagaaaatgatgtttcaggccagtgcagtggctcacgcctgtaatcctagcactttgagaggcaacaggcaggtgggttgcctgagcttaggagttcgagaccagcctggacaacgtggcaaaaccccatctctact

SEQ ID NO: 399759 - DNA, 342 bp, Homo sapiens
ggaaggcagctctccaaggtctttcattcgacattgaacatccactttgagatccacagtcatagctcagatctttaggagaagttttttggaattacctcacacagcagagagagtgtttcattcatgaaatatctctattttatatcccaacattgtggcattttccagagtgccatgctcataaatccataaattctaagttcatttagtcaaataagtccttaacctgggacatgctgttaacatttccatatgtaaggaccctccttctaccaaatactattagtctattgacctgcaggactaattttcttgttgacagagattagaagttacctg

SEQ ID NO: 399760 - DNA, 410 bp, Homo sapiens
ctgtccagggttgtgttgaaataaattttctccacaaaatgtgtgtctaattaatgaaatgtcaactttatttatttctaggtggcagtttggtttttttcaccattgcaaatgagaagaattaaaatttccagttaaaatggcagtgaacttttatttttgttaaaaacttaaggaaagtgtttgagtctgttttactcacattatttcatttgatcttagaagaagggctgaatccctacatggtctgttttgtttgctgttttccgaataaaatgcaataaatattttctccatttgagatgatcagattatttaaactaagaaggaaatttctttccaaaacctggacaaattatatagccattcaacacttgctttattctattgtgttaactccctagcaaagc

SEQ ID NO: 399761 - DNA, 377 bp, Homo sapiens
gacacacatacacacatgagtgcccacagggacggaaatgggtagaagatgggtctagagacaccggagttcaagacccgagggctgcgaaccttcacgttttcggggagggcctgaatttcccccgtatcacaaccaccgttcttccaacaaactaaacgcccaccgtcattaacctgtccgctggttgaacacccggactctaccctctccagaattaggaaagggctgcagagtccgaaggtgctggacagagtcaatcttttatggctaagactgtgagaaggcacggaaggcgagcactccaagctctaaggctaaatcagagctttcctccccagataaaggaaattttccctccctgaatacgttttcta

SEQ ID NO: 399762 - DNA, 289 bp, Homo sapiens
ctatattaccatactggctaagatttctaacacagttattcttgacttgggaagaacttttaatattttaccaataagtacaatatttacaggcgatttctagtcctagttttctaggagtttttttttttaagatcatacatggatgttgagcatcaaatgttctttgtatctctattgagattatttttctcctttagtctgctaaaattatgaatgcttttcaaagttaaaattgtattctttgaaaaatatccaccttggtcatttttgtcctttttacataatg

SEQ ID NO: 399763 - DNA, 292 bp, Homo sapiens
tacttttgcagagacggggattttaccaccttgtccaggctagtttcaaactcctggactcaagcagtcctcccaccttagcctgtcaaagtgctgggattacaggcatgagccaccacacctggcctattttctgtaattttttaaagcactagtctgaaatggtttcaggaaataaactgcccaggtgattgtgacacagggctgtgttggagagctaccagatgaccctcaggaaggtgatttgctgcccctccctctgaggttccctttatctcctcagaggtgggca

SEQ ID NO: 399764 - DNA, 339 bp, Homo sapiens
ggtccttggtggacacggttgttcccacagtatccctcaccagtggaagctggacattgtgttccctgggctctgacactgccgactcctgaggacagtggcctatttgtttaatttattggtggtcactgttcaaaggcaggccctgtatgccagccactgcccctaccctgtcctcttagcaggagtgagcagagcagagcaggcacatgcgcccagcgccgaggcatgtttctcacctgactgcgctgaccaccagaccggtcatagtctatcggaacctcgcccctgcttacccctttcctctttatgaccaacacagcctcagccagcactgaa

SEQ ID NO: 399765 - DNA, 418 bp, Homo sapiens
caggatttgttttataaagatataaaatcaggcagtcgttttccaagaattgccttggggccttgtgacatgaaggaatgggagataagacagtgtggtactcatccgggagggcaatgttccaaacagttatttgaaaggagtggcaataatatagatttgaaaagagttgcatgtttatccattaaaatagctaagaatatatcattttattgagattttctatacctgacgtgtaatacaattttttaatggagaagttgttttcatcattatcctcacagaaaatccaagaaatccagccaggcgcagtagctcacacctgtaatcctagcaccttgggaggccaaggcaggtggactgtatgcattcagaagttcgaaatcagcctaggcaacatagtgagactctgtctcta

SEQ ID NO: 399766 - DNA, 623 bp, Homo sapiens
cagagaaggcacccagctgtggctgtgggtagagggcacagccactgccataatggtgtcccttatcaccttagggagggagcaggaggaagaaatatgctctttcctcagccacctcccaccacctgccccaatctcctgccggtgcatcccatcagctaaagcagaagatgagatccactgaagtcaaccccctgggtacagcgtaggtcagaaaagagcaaagaatggatctaaaggaaagccagtatgcagatgggcataaataccagaccactgtcgagctgtgggcatgatcacagtcctgggctctgagcagtgtttctcagaggagcatccagtgctagagttggctgctcggtacacagacacatgctccagagttttcatggcatcttgggtctgggcccttccagttaggaggagacagtctgagagattggaggccgagtttcagtccaggttttgggtttctctttgttatccccagtgccccagtctatggtggaaaaggctattttgttgatgctaaagggaatgagcagtaataagatcccaggctttcaggaaactacactctgaaatcagcaccacctctttctgtcagaagtttccattcccag

SEQ ID NO: 399767 - DNA, 958 bp, Homo sapiens
gcgaggtgctctagaggatcgcaatcagttacacaaaaaacaacacaaaacaaaaaaccatgaatgcctaatgatttcccactgaaactttcaaatttacccttgtttgatgagaggaatgagcaggagcattgttgcagtagaaaggactctctggtgaagctttcctgcaaaagctttggttaactgtctcaaaaccctcttataataagcagtattttccttggtttctccagaaagtcaaccagcagaatgccttgaacttcccaaaaaactgttgccatgacctttgctcttgaccagtctgtttttgctttgactgaaccacttccaccttttggtagccattgctttggttgtgctttgtcttcaggattgtactggtaaagccatgtttcatctcctgttatagttcttcaaagaaatgcttcagggtcttgatcctacttgtttaaaatttccattgaaattgaaagctttgttctcgtctgcagctgatctgggcacaaaagttttggcatcccttgagtggaattgtgtaagctgaatcagttgagatgtctaggcaattagctattgtttcttctgttaaacattgatcctcttcaattagagcacaaacgagatgatatttttcctcacaaattgatgtgaatggtgtgcttttgcaggcttcatcttcttctctcattccttcttaaaatgagttatccatttgtaaactcctgattgtttgggtgcgttgttcccatacactttttgtaaagcatcaatgaatttcaccattcttccacccaaacctcaccataagtttgatgtttgttcttcatgtaatttttgcagaattcatgttgctctgataggggaattttttcaaactagtattttatccttcttggtgcatgaaagtagattctattcaaacatgttataagaagatggtagaagtccatttggt

SEQ ID NO: 399768 - DNA, 352 bp, Homo sapiens
ccatcaaaatcttcacatagattcatcacttctggccacatgctaggattaaacaagattactgttatatctttgagccttgtgggagaatctgcttttcacttagctgttcatgcagggcagggtgaagcaaagaaatccttcctcttgtaaggaaactttgatatctcttacctacttctgtgcttctgctttgggatgtgaaaatactctactaagtggcaacaaaatttgcaccagttcttaacaccagtgcttcccagataaagagtgaccctccaggagttcttcagctgagcctgagttagttgctcattttgaacctcatgtggtgtgtagaaatgaattaaaa

SEQ ID NO: 399769 - DNA, 453 bp, Homo sapiens
tggggagtggaggggccttgctttgcttcttcttgactgactggtactctttttattatgtatgtatttatttattcatttagcgatcctcctacctcagcctccagagtagctgggacacaggtatgcgccaccacactcggcgaattttttaattttttgtagagatggggtcttcttctattgcctagggctaatgttggactcctgggctcaagcgatcctcttgccttggcctcccagcatgttgggattacaggcatgaactaccgcacccggcccgtactctgtcttcacctcctctgggaagccttcctcagtctctggctctcaggtcgcccgtgcatacctgtcctgaaactgctttcccacctgtgttcccagggcagagagtggatgcccatggatggtttgtcaaaggaataaattagccttttttggaggaactgtcta

SEQ ID NO: 399770 - DNA, 359 bp, Homo sapiens
actacactccagcctggacgatacagcgagaccctgtctcaaaaaaacaaaaaaaggaaaaaagtggtccaagacagggctccgtgtaaaaggcggcatgaggggaggtgaggggagtcaagttcaaagggagtcgcagctgtgagctgtctgcaatgggcggggggggcagtctgcaccagctatcctgtgtactaccattttaattttactctgttttaattcatttaagttaatttgcacatttatttttagagatgggctcttgctatactgctcaggctgatcttgaactcctaggctcaagcaatcctcccacctcagcctcccaaagtgctgggattaaaggtgtacgccac

SEQ ID NO: 399771 - DNA, 672 bp, Homo sapiens
tcaattatctgagtaagtcaaggaaagtccttgtgggaccaggtcacaagccctcagtttttagagtcaggatgttggggtgggagtgatagaactgattgaagtcaatatagcctggatgtggtagattgttttatgtggaggggtagttgttcaggacactgattgttatctgaacacccaggatgctttctttggctgtcactgtagtaaaaagaacagttttaaagcctgagccaagtgtcaagcagcaggagggtgtccttcgtgaactctgaatttatggggctgagtctgagagcgaagagatgccaacagtagcgactgagaacattctggatgattttagtaaaccccgaacaaattccttatacaccaaggagcattctccttgttagaaattcctccagaccacgactctggccctggccctggggtgaggagatagggtgcctggccgtagtggatctaaaacgggatgacaccggaaacctgtggggaggacgccgtccttgtcgccccttgacagagggggcacagaggccttagagaaacaaaaataaaaatagcaattgtttgccacttccctccctaataaagtgttctctccaaacctggtttccactctatttctgaactgtttcgccccatggtgtgtaggaagccagggta

SEQ ID NO: 399772 - DNA, 417 bp, Homo sapiens
tgctgcatcatctcgtggtggaaaggtggaagggcaagagagcgaacaaacgtgagggcaaaaggtgctgttcttatcaaacccactctcctgataatgaatgccctcctaagataataacatgaatgcatttatgggggcagagccctcatgacctaataactccctcaagatcccacctgtctggacggattgtttgagctcaggaattcaaaaccagccttgagaacatggcaaaacccagtctctacaaaaaaaaattaaaaattagctgggcatggttgtacatgcctgtagtcccagctactcaggaggctggggtgggaggatcacctgagcctgggaggccgaggctgcagtgagctgaatttgcccccctacactccagcctgggtgacaaagtgagactccgtctca

SEQ ID NO: 399773 - DNA, 343 bp, Homo sapiens
tgataacatgggcaatctggaaactactcccatttgtgagggtaaatctctattatgatacatggaaaataggacagatgctaattcaggtaagaaaaggtctttgtattatacaaatatttaccttcagacagaaatgttaatgaagatggagaaggaacagttaccaagaaactagggatagtaggacacaaaaaacctggtaacctggtagtgagtatgaaccagtctggtgccttgcctccagaggagcagcaactgagcagagctactggacaaccagccctgcacttccctagagcacagaccagctcactatgcagccaccaagagataagcaccg

SEQ ID NO: 399774 - DNA, 254 bp, Homo sapiens
tcattcaacaagaatttattgaccaaaaactggcttacatactctgttaaataaagtagacataaaaatgaagaataaaagctccctcccactatggatcccattctttaaaatatgtcagtgaggtggggtgtggtggctcacacctataatcccagaactttgggaggtcaaggcaggcagatctcttgaggtcaggagttcaagatcaacctggccaatacagtgaaacccccgtcgactctactaaaaaa

SEQ ID NO: 399775 - DNA, 560 bp, Homo sapiens
tcttatttttatggaaaaggtaatattcacacgtagtcaaaacaatgtaagcagtacaaaagggtatatagtgtaaaccaaattctctcccacctgcggtcccactgccgcttctcagaagtaacccccgttgtaggctgggcgcggtggctcatgcctgtaatcccagcacgttgggaggctgaggcgggcagatcacctgacgtcaggagttcgagaccagcttgaccaacatggtgaaaccccatctctactaaaaatacaaaacttagccaagcgtggtggcaggcgcctgtaatcccagctactcgggaggcagaggcgggaggatcgcttgaatccaggaggtagaggttgcagtaagctgagattgcgccactgtactccatcctgggtgatagagtgagaccccatctcaaaaaaaaaaaggccctgttgtagttggaacagggattctgggaactttctgtgtctttagaaatagtgtttctcggaagctcagtttggagctgactgcacacgttgcgcccgggccttcctcgctgtgtcctaaaatgaca

SEQ ID NO: 399776 - DNA, 244 bp, Homo sapiens
tgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggc

SEQ ID NO: 399777 - DNA, 457 bp, Homo sapiens
ctccaaatctccaatgcattttctgtgttcctgttttatagtatttcacaccgtttgccttatctgctcctattccttcccctaagaaaaggaaggagagagagagagagagcacaaaatactcaacacaagatttgacataccatagaatctcagtaaaaaatggatagatgggctgggcatgatggctcatgtctgtaatcacagcactgtgggaggccgtggtgggtggatcacctgagttcaggagctcaagaccagcctggccaacatgatgaaaccccgtctctactaaaaatacaaaaaattagccagacgtgatggcacatgcctgtaatcccagctacttgagaggctgaagcaggagaatcactcaaacctgggaggtggaggttgcagtgagccaagatcacaccattgcactccaacttgggcaacaagagcgaaactctgtctc

SEQ ID NO: 399778 - DNA, 227 bp, Homo sapiens
acagtccccacccaactcactttccagcttccctgcgaccctccagccttcattccaactcatcgctgcctcacttgctgggagccccttgtcttcatgcctcttttccatcactgagccctgtccttagttgtgctgccaccgagccgcacacatttgctcttttcattacacagtgtcaatagtggctgctgcccacctgccatcacaggtagcggttcccgtgg

SEQ ID NO: 399779 - DNA, 442 bp, Homo sapiens
gcctgaccaataattgatattttattttatttttatttattatcctttttgagatggagtctcactctgttgccactgcatgccagcctgggcgacggagcaagactgtttcaaaaaaaaaaagtttcgtgatttctttattcctttgcatagctgaaacaagtcttatcaaaagattgtgaaactgtaatcaaattagaacaaatatttaaaaaaatcttgtactgaagcattcattctattttttagagtttctgtgaattgttcaacaatattcccagtattatattcataggaaaacagataaacagcacaacatgagtgtttcctaccacatcaattttaatgaagacactttctatattaggatcctgtcatttatgaattgtttgtattttaaatttttttgtgtcttagcgacataaattgttaatcattggga

SEQ ID NO: 399780 - DNA, 450 bp, Homo sapiens
gcgggcgggcctctctactcgaaggtgaccacgtttagattctgagacgggaagtggagggtgaataggtcaaggcggcctttttttttagtttaacttttccttttttgctgtctagtcatcctcgtcggtcttctgtccccattttcctcattagcattcccgttagcaggggcgtctcttccattttctgcctcttccacaacttccttcttctcctttaagtccttggtggtgatttcggagctggtgtctacggctgcgtctgacatggtggggcacgccggtgatccgatgcaggggattaaaaagaaagcgagagttcagggactctggcgataaagctgccggagtccgcggcggcggaggaggcgcgcggcggaggcggctgcggcgagcaaggaggcggatgaggaacaatgcaaagatggcttttcagagcagccagtg

SEQ ID NO: 399781 - DNA, 404 bp, Homo sapiens
ctccatcctcttcctcaccatcaccttcttcctcctcctcttcctccccaccttcttcctcttcttcgtctacctcattgtcagcctcctgctccccattttcctcattagcattcccgttagcaggggcgtctcttccattttctgcctcttccacaacttccttcttctcctttaagtccttggtggtgatttcggagctggtgtctacggctgcgtctgacatggtggggcacgccggtgatccgatgcaggggattaaaaagaaagcgagagttcagggactctggcgataaagctgccggagtccgcggcggcggaggaggcgcgcggcggaggcggctgcggcgagcaaggaggcggatgaggaacaatgcaaagatggcttttcagagcagccagtg

SEQ ID NO: 399782 - DNA, 486 bp, Homo sapiens
gtcctccaattgagtcagctaggacagcagagaaagctttcagaggggtagacttgcaagctcatctaaaccaactccttcaaaacagactccaaatatttcaccctacaagggatggggaactctggaagactggcatcagccgatatggctgaacagactgcaggtttggaatccaaatgtgtctacaaatgttcactgattgattgtcattttgttctccccacattttagttttgctcattttacagcccacagcctgtcttgtggaataaatgatacaagcaattgaagaaggcacactgtgcaccaaggggacgactcaggcaatctgcagcggtggtccagggctactcagctcagcctcagtcacctgcaatgaaaaccacctcttgccatcagagtcaatgatatagatgggacacttaaaaaccaaaacaggttcatattctctggtttgtaggaaagaattcatatcttcacagc

SEQ ID NO: 399783 - DNA, 827 bp, Homo sapiens
ctagaggatcccgtgatgttatcgcccaacaccttcatcggcagcatatgccatctccttgcagctctcccagccagcactaaagccagcctccaggctgtgaggctcaccttagcctgagtcaccatcccccacacttcctgagagtagttatgtttttattatccagtaattaaagataaaacatagtataaattgaattatgcatgtaaaagcatttgtattatttatatcacgagtcccaatatcatagaatacataaatgctagagccacttgtgattttttgttatttacaaaggctgataggcaggtggatttcagcatccctgccaacatggtgggatctgaggctgccagggtgggaaccactcgtcaaggagaacattccctgtgtctaccagcaaagatccaggccaactgctggctgaagagagagcaaaaagaaacaggctatgaagggcttctgctcttacaaccctataaggagtatatattttacactggaaaatctgatccttagagcaagccagtcctgtatcagcatatagtcctggtattgtccagaaaaaataaatcatcttgctacttagagacattagctagccaaacgcagtagaatctacaagatcacatagtattcaaattattattaaccaaaaatgccttgtagtactttaggggtacagagcaagcagagaaaaggtggtggtccatgaagtgccctttgtaacattcagagctgagctgtcccctgtaactgggcaccatccctgcactgctccttgggtgttgggcgataacatcacgggatacctctagagtcac

SEQ ID NO: 399784 - DNA, 387 bp, Homo sapiens
gggcttctgctcttacaaccctataaggagtatatattttacactggaaaatctgatccttagagcaagccagtcctgtatcagcatatagtcctggtattgtccagaaaaaataaatcatcttgctacttagagacattagctagccaaacgcagtagaatctacaagatcacatagtattcaaattattattaaccaaaaatgccttgtagtactttaggggtacagagcaagcagagaaaaggtggtggtccatgaagtgccctttgtaacattcagagctgagctgtcccctgtaactgggcaccatccctgcactgctccttgggtgttgggctctgaaacactccagctgactcagaaaatgattctcggtgggggatgga

SEQ ID NO: 399785 - DNA, 500 bp, Homo sapiens
gctgagctgaagatggaagagcctgtctgcgtgtctccccagtgactagtgaggcggcttttcctcccgaagctggaccttacatcagtgagaaataaacttccattgtgctaagccaccaaagtctgaaatgttacagcagctagcagtaccttaacccattgagtacaaagataaataacagtcactatctgaaaatcaagtggaatgcctatctctgggctacctgcacttttgtttgtttgtttgtttgtttgtttttgagatggagtctcactctgttacccaggctggagtgcagtggcacaatcatctcagctcactgtaacctctgcctcctgagtccaaaccattctcctgcctcagcctcccgagtagctgggattacaggcgcctgccaccatgcccagctaatttctgtatttttagtagagatgcggtttcaccatgctggttaggctggtctcaactcctgacctggtgatccaccccttggcctc

SEQ ID NO: 399786 - DNA, 508 bp, Homo sapiens
cagccctcaagtgaggtacagaaatttatgtaccatcttgaggctatgttacaggaagaatgcaagctcaaagcatggccaaaaaacaggttattgtggtgaattaggttctggtggtaagacaggttatgagagggggagaagaggggtttggctagcaaagatgtcttgataatatacatgaaacctcacaggtagcagtcctcagacagaatagatggtaaacgtttctttcaggtcctttaaggtgtcagactctcagttaatccctcctagatctggatgagggaaggctggctgcattaattgagattctgtagatgcatacctcctccaccaaagacagctttgcaggactgcttcagtctgctgtccctgtggcagccatctcaaaatatgtcaaataaatatatttcgtggtaaaatatttttatttcctttaccctctttccttttaagttctccgctggagaccaccataacaaagatacattagcaagagaaaaac

SEQ ID NO: 399787 - DNA, 466 bp, Homo sapiens
cagtgtgccatgatagttcacctgtgccatggcaacatctgggagttaccacccctttctatggcaatgctaccttcagcacactgtctgtggggtagccctgctctgcaaaggcagtcacaaagctgtaacaccaccagagctgtaacactcctgcttcaaaaaggctgttttcttctaccctaccaccggctcaccattgaaaaaataaaaaataaaaacatccaactgcccatttgtagctcataatccacttttgtaacacgttgctatctatattttgtagaaagtgggaaactaaaaggaaaaagtaattaagcatttgctaaacttaggctaactgaaatcccctgtagagacccttaatagacattgggacaaaaataagcatcccaaaagactcaccactagggtgtcttttagacagttggagttggagtaaattcaaattattagacaaattgaa

SEQ ID NO: 399788 - DNA, 604 bp, Homo sapiens
ccaccccactcttaatcagtggtggaagaacggtctcagaactgtttgtttcaattagccatttaagtttagtagtaaaagactggttaatgataacaatgcatcgtaaaaccttcagaaggaaaggagaatgttttgtggaccactttggttttcttttttgcgtgtggcagaacagcagaggaggagagggttggaacaaaattgggcagtggcctctgtgcttgctggctccccagccccaagccgcctctctgtgggaaccagggaacattcatactgctcgaacgtggctcttcccacagtcagacaccactggccagccaggatctcccctcctgttgaaaaatgctctcccttgcagctcccactaggaaacctggaaggccaaactgtttatgacattgtttccctaaaatgtgctcagacaccatgttttataaagtttctgtctcttctttctgttaagaaaggagaaaaaggatcccagctactcaggaggctgaggcatgagaattgcttgaaccagggaggtggaggttgcagtgagccgagattgtgccactgcactccagcctgggcaacagagcgagactctgtctca

SEQ ID NO: 399789 - DNA, 476 bp, Homo sapiens
tatagtaatagagttttagctgggaaaatagccacccagaatagaaactacatttcccagtctccttcacaggtagatgtggccatgtgcctatgttcttaccaatgggaaggtgtggaagtattaacattttgttgctgcttttgagaaccttccctaggagatagcggggatgggtctttggcctcttcatgactttctctttcttgctgcatttctgctctgccagcttaggtgatgaggatacaggtcctactgtagggatggcagaggagtgagccagaaggagcctgcacactctgaggtctctgcggagtggagctcccataccagcctggaatattcacctctgggcttcatacagctgagagctaaataaacttcagtcttgtttaacttccacagttatctaggagtttccatcacttgcagtcacacccaactctaataaaatgcaagaatgatttttattttta

SEQ ID NO: 399790 - DNA, 241 bp, Homo sapiens
agatgctatagatgttactcttatactgtaaaacattgtgaaatcagattgcttaaaaatgatgtattacaaagttatggaaaaaagcagttgtgactatggaagcccaaggcttatatcctagctctgtcttacactaaatgtgggtacagtgtttccactttttgtaaaatgggagctaatatcctccaacctgtgtgcctgacatggtgattaaaaggattaatcgaaacaacagttt

SEQ ID NO: 399791 - DNA, 1061 bp, Homo sapiens
caatctgcctgtctcggcctcccaaattgctgggattacaggtgtgggacactgtgccgggcctacattccttttgtgtttccttttttaaattttttaaagataggtcttgctttgttgctcaggctgaagtgcggtggcacaatcacagctcactgcaaccttgaactcctgggctcaagcaatcctcccatcttggcctcctgagtagctggaactacaaggcacatgccaccaagcctagctaattaattgttttttctttttttgtagagatggggtcttactatgtggcccaggctggtctcaaactcctgggctcaagcaattcttggactccgtggctcacgcctgtaatctcagcactttgggaagctgtggtgggaggatcacttgaggccaggagttcaacaccagcctgggcaatctagcaagatccccatttttacaaaacgaaaaatcgaaaaacaaagataggcatgcagacaaacagttatacacattatacacaagtatgtacagatactgttgcagaaaggagaatttagatttgaggaggtcaggaaatactttaaatggagctgacgcctgagcttggtctcgacaggacagttacgtttgtgagggtgggcatggggcagagagaagagtgaagacaaaggctcagaagcatgagggtagcagtgggttaaagaatcagagaggagttttctgtggcaaaacagccctgtggagtggcagagcagatgtcattacctagtccacagggtgtacatggacatatcacttagctaagccagtttcctcatctgtgaaaagggacactttagaatatcagtactgctcaaaatgtggacggtggacgggcagcatcagcaccattgatccaccagttagaaatgcaaattcagtggcccacccagaccttctcatcagaatctctgagtgtgtgtccaaacactgctttcacaagtgtatcaggcaatttttataacatcaaagtttaaaaagttgctttaaattagggcctagcaaaccataggtcgtgggccgaactagcc

SEQ ID NO: 399792 - DNA, 268 bp, Homo sapiens
gtgtggtcctcttatttatttactgtggtggtggggttggctaattccaacattggtaaaacagttaaacacatttaaccagtaggggcggcaggggaggattggattagcagaaacagaagttacttgtgcgatgcgcctcctgctggcactgaagtgcatttgtttgggatttgctgctgtcttgcataggttctgggattgagttaaatattgtgttagtgtcctgcaagaccttttaatttagaatcctgaaagactgcctttt

SEQ ID NO: 399793 - DNA, 401 bp, Homo sapiens
caaaatatgttatttcttaatagtgtcatacatgtttaaaaaatgaaaatgctttaattcttgagtacagatttctaatctatcaaccttacaatttctctttttattgtggtaaaaatacatataacataaaattaccatcttaaccatttttaagcataaggtccagtggcattaaaaacgttcataatgtcctgtatacctgttctttacagtccttatatgtactaaatgtatatgcagactggtgaattgctccttttattatttttctgtaaccttttttcccaataatgctttggcttcaaaatatatttcttaaacattattataagaagtaacatcatctttctttgcttatatttacctcaaatataattttccatttcttcacattcata

SEQ ID NO: 399794 - DNA, 482 bp, Homo sapiens
atcaaaaggaaggtttaactctgttaatgaatccacacatcacaaagctgtttcacagatagcttctttctattttttatctcaggatattcggtttttccttgtaggattcaatgggctttaaaatgtcacttcacttatgctacaaaaagagtgtttccaacctgcttaatcaaaagaaaggcttaactttgtgagataaatccacacatcacaaagcagcttcacatagggcttctttctagtttttagctgggcattttccatttttccccataggcctcaatgggttcccaaatgtctcttcgcagatcctacaaaatgtctgttaccaacctgctgaatcaaaagaaaggtttaattatgtgagatgaatccacacatcacaaagcagtttcacagataacttctttccaatttttattttgggatatttggtttttctccataggcctaaattgtcccccaaatccctttcagag

SEQ ID NO: 399795 - DNA, 483 bp, Homo sapiens
gttttgtttccaagcagtttcattcagaaggatgtgaaagggactctgttccacagctgcactggttcatggtggtggaataatcacaagatgaaacaatcgtatcattgcttttccagcaaagtcaggcactgtgctcacaatacactacattcatggaagcctctttgttataggaatttgctttgctctaggggcgttcttttaattttacggttggaggattgagttctcaattaagggatcagcaacaaatagatattaggtatgatcaattagctatctgggaagtatgaatgttctttcagttacctagcactaattaaacaagtgtcttgccttgtgagggggagaggctcataaagacaccctcttttctctcaagggctatctgtcttggagccttggagatgagacttgtacacagactgctccctaaagagcagaatgaggccagtccctcggagaggtaggtggagagag

SEQ ID NO: 399796 - DNA, 567 bp, Homo sapiens
ttcgtgatgattcagtcttcctcactgtgaagaacgaaaccccagtcctgcaaagatttgaaactgtatttaaggccaaagtaaggttgcctgggaattaagagtactggagtcaggcaggctttgatcagatccctcccccaacacttcctgtgtgagtgacttcagcaagttgctttactttacctttctgagcctcatttcccttacttgtaacacagaaatatgaatagttactatccagggtttttttttaggatcaaaggagttactatgtgtggagcatgtcacccagaggctggtatgcagcaagtgctttgtaaatagtagcgatgggcactactgaaacctgaatgtctgcctctgcctgtttgcgaatgactccaccttcccaaatcccaacagggaaggtgagtcagcttgagaccacttgagaggcatctagcagaagggaggcaaaacttctgttaaaggataatttttagggaaaaaaaggtaagatgatgactctcatacagatattaaaaatgaattcatcatgaagattttattttactcgtatgatgg

SEQ ID NO: 399797 - DNA, 754 bp, Homo sapiens
acactgagcatttgaattagtatgttctaatcagaatattcccaaatgtgtatctttatttcattgttttattttgtttgtaaatagtaattgaaacatttccacagaagaaaatttttctcctatagccctcctctatagctgaatatatactaaaatataaagctatattcagctgaaattcagtttttagtaagtgtaaagctttaaatggctgcattcccacagttggaaacacgagtatgtggttggcatggtgaatttatttgaaataaaacatgccaccatttaagcaataaggttttcaggtagttttgaatgaataaggagcaaagcagttgagattttaagtgaggataaagtataatcattttagaagttctaaatttttggatctgtgatgctgtcttcaaaggtaaaaaaaaattttaagttctaaattttagtttgaaaacatatatagcggccgggcatggtggctcacgcctctaatcccagcttgggaggccaaggcgggtggattacttgaggtcaggagttcgagaccagcctggcaacatggtgaaactccatctctattaaaaatacaaaaattagtcgggcatggtggtgggcacggtggcaggcacctgtaatcccagctgctcaggaggctgaggcatgagcattgcttgaacccgggaggcgaaggtttcagttagccaagaaccacactccagcctgggcagtggagcccaacacagtctcaaaaaaa

SEQ ID NO: 399798 - DNA, 632 bp, Homo sapiens
tcaaaatttttaattgactgggtttgtttattttaacactttttacaagatattttagacataccaaaagtgattttttttcagtgcctcttgtaactataaatctctctaatttatagtctcatagcatcaagtgtcattacaatgatgagagtaagtgcacacacctgcatagtcttcaatggatgcctggcctgctccatgtgctttacatacagacttctctagtttccccacaagcacacaaggcagatactttccccatggcaagcaatcaaaaaagccaggacacagaggggcggaacagctgctgaggactgtactgatgcacaccccggtaggcagattcccaagcccttgttctggagtttgtgtgctggacggcctgtaactagtacaaactgacctttgtgtgtctcttctctgtcctccctgcatccatattgtaggacaggagaaagaaagggagaagtctgttgcattattaaatcttccacagcagatagttatggagaatcaacagtttggggtttacacatgaggggttcacccagctgggggtttacagccatgtctgatgtgctcctgctccagggaaagcctttattccactcacccatcagccgtagatg

SEQ ID NO: 399799 - DNA, 359 bp, Homo sapiens
aaacaatacacaggagagcactttatgaaccgtaaaatgctatacaactactataagacagtgtcaccatgtaattatgtgtaatatggcactagaattcatgtactatttcataaattcccctggataattaggttcccggagtattttcaggtagcacatgccgatttctcaatactaagggagacttgagaaatattcttgccacagggttctgttagtatattttattagtgggaaaaactgtattacacatatatatgaaaatatcaaaaattgcacaatagggctgcaacctgcccatctcacaaccaccaacatttgcctttttctgaataaacatatgtgctctgggggtt

SEQ ID NO: 399800 - DNA, 526 bp, Homo sapiens
ggaaaggcaagtttagacatgaggtgacaacaatgatttcaaatgcacatgtacataaaataccttgaagatatgagactgaatcccaaaagagaaaattaaaaaatacaagtaatttctgaagagataatagttgaaaagataaggaataaatactgaaaactaaataacaaagggagaataagtagaagaagagcctacaaggcctaaggaaggataaaaccatttcagaaatgagactaaccaacacaaaaatttgaaagagacagggagctgcatgagaaaaacaataaagacagtaatatacttttcatctgtgaggtccactgtcaattattaaacactatcacaactgtttttgctttcagaatggcctgataagattgatatttactattctcgttttataaacgtataaaattaggttaagtgacttaactaaaatcaaactgcttgtgagttatggaactgtgtctcaaatccagttcttctcactacctaggcactcagatgtagcccagtttcc

SEQ ID NO: 399801 - DNA, 602 bp, Homo sapiens
ggcgcatgctacaacatggatgaacctgaaggatttatgctaagtgaaataagccagtcacaaaaggacaaatactgtgtgattccttatatgagtccctaaaataggcaatttcatagagacagaaatagatagaggttgccagaggtgaggggaagggaatggaagttactgtgtaataggtatgaagtttcagctttatgagatgaaacagttctgtggatggatggtggtgatggttgcacagccatgtgggtgtacttaataccattgaatggtacgcttgaaaatggctaaaacgggaaattttatgttatatgtattttatcaaaataaaaagacaagtgagtgaatgaaactctttctgcatatctctatattatagactaaagcagctcccattggcttgaattcctggcaaggaacacacgaaaagcctccctctagactaagaggggatggtgtttgctgatgtttcaaccaagggtctggatattgtggcacagacagtgaagaatcccatttgatcaggctgttttccctgggtgatctggagccatctggtcccagagcctttgaaaatccttgtactgtccaataag

SEQ ID NO: 399802 - DNA, 374 bp, Homo sapiens
aatgctgagcgtgcacactgccacatttagaaaggttggaactgatgattcttcagatagaaagcttttgttgactcatgatgagacccacccatttcaatgaggtacttaggcagcacaccgtcacagagctgatcaaagctctggcatgggttcaatcaggattattccatgggccatatcaaagttcctcactgcaccttcacttcatgtaaaaacaattcatttataattgttttacacttcatgtaaaaacaattcattatataaacttctttctatgatcaggagctcagggtaaattattttaccaactcaccttttcaccattataaatatgattgcaaattataaataaaatattaaaaaaattg

SEQ ID NO: 399803 - DNA, 320 bp, Homo sapiens
tatctctggccacccctttccagcccctctctagctcagtgacaagctgagaaagagccagacctcctgagaccccatgaagaaacaatactgcacaggaagtttgatggtgacccccagggctgccgccagtgggaatcatcctcccaaagcacagaagggcttaccgcagcccttcctgaattcttacacttccacgggagaataatatcactctttgatttaattatagtagagctttgctctttccatgcaggaaggccttagtgatagggcccagtgagaaaatatagaggctgttctcagcagacctgataaat

SEQ ID NO: 399804 - DNA, 519 bp, Homo sapiens
tgtagggatggggtctcactattgcccaggctggtcttaaactcctggtctcaagtgatcttcctgctccacttcccaaagtgctggaattacaggtgtgagccactactcccagccttatataattttattttaattaattaattaattaattttttcatttttttgagacagggtctctgtctgtcacccaggctggagtgcagtggcgtgatcttggctcactgaaacctctgcctcccaggttcaagtgattcttccacctcagcctcctgagtagctgtgactacaggcgtataccaccatgcccagctaatttttgtattttttggtagagacagggtctcaccatgttggccaggctggtctcgaactcctgacctcaagtgagctgcctgccctagcctcccaaagtgctgggattacaggtgtgagtcactgcacctggcccccagccttacataattttaaagttttgggtttttagtttccttcttgaatgtctggtaggaggtttag

SEQ ID NO: 399805 - DNA, 949 bp, Homo sapiens
tgtctgtctctaactttcttttagaacaattctcaaatcacatttcctccaaatatctttctctcattgctctgggctacgtagaaaaaaaaatgcccaattctattttgaagttctgaagaggattgatttgtatcacttttttagcattcagaactgacttaaaattcttagtcttccctccatttcaagatgctttctacctagctgtattgcaaactgcttaaggtaaaaagtggtcttttgtacactcacatcactctctactgagcatagtgctcacctaagacaactttgattagtttttgctgataaaagaaaatcagaaaacctatcttccaaaatatagaaagtttgcaaaatcgtagagttgtttggggactttttcttatatttgtgaagtctggaagcaaaattacaggtactctaatcccacagtttttttttacttgcatttgaaactttgctagataaactgttacttgctaaaataaaaccagacagatcgataaacaaagaggacaagaacagacatctatgctgataagcggcatgctttcttttgctaactagcttgttcttttgtgatgatattttgcttagttacctttatctgttttgaacgataccaagcattccgttgacttattttactcataagcaatgataattcgcatgaggataaaaaagggacaagacggcagagtccatttgaaaggagtttcccgccaaccatgttggagactcctgattcctcctcacttgactggaaattcaggtgatagttatctggtgataatcattaggattaatgtatacaatttattttgattttataatctgtaatggtcatataagcactaatatgatttcctgaattcactattctactggaaagaaaatgttttgatcagctaacaaatatatacatccttcatttaaaaaaaaa

SEQ ID NO: 399806 - DNA, 484 bp, Homo sapiens
  misc_feature (475)..(475): n is a, c, g, or t
tgaggaatttcactttagttgattcaccagatacaagaaagagggtttagtattattattaattgtatttccttagttatatttgtcagactgccttttggatggatagatgggtggagtggagccagtttgctaggtatattcaggttgatctcaagaaagcaaatgaaccagccaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggnaatttggga

SEQ ID NO: 399807 - DNA, 291 bp, Homo sapiens
cccccttcccatatatttcaactgtttaaatcaatttccataacttgtaactgaaagagccctgacttatacttagggaagtctctctggtgaagtgatctttgagctgaaggggctgatttggggccaggagtgagggtaggggatggtgagggggaaggagagttctgggaaggaagtgagaaattggctacccctgcgtgtctgggtctaaggtcttcaccacatgactacacaagtgcaataaacttgctctgccccgttgcggtgttgaataaaccaaacaaaacg

SEQ ID NO: 399808 - DNA, 532 bp, Homo sapiens
tgttgtctcatccataaaatgggcctgaccatgcccaagtcaacggaaggatttaaatagatcagcgccctgaggtcggtgctggacgccgagtacacgcgcccagtacacagggcttgagctcattacacgccccagttctgttcctggggtggtggcgtgaaccccactgcctttgcctttaattgcactgaaaatatccagcaccgctgatatcaagggcccaggtcccggcggaaatgaactcccagacttgggcgcccaggtttccgtgcgcgaccccagcccctccggctgcagctcagcccatcggccctgcgcgggaacagtgtcacccgggcacccgggccagaacaggccacgcgtgtcccaggagcgcgggaagctcccacgccccctcccccgcaccgctcctttggctggcagagcgggtcctcagcgcgtctcagccgcaccaagcgcctcccgctcccgcgccacccgggcgcgctgctggggcctgatttccataataatcagccagagatctccc

SEQ ID NO: 399809 - DNA, 346 bp, Homo sapiens
tgctgggattacaggcgtgagccaccacacccagccaagttgattagattcttgagactctttaacagttgataaccctcatagaatttcctacattctgaatttgacagaatatacccttaaggtacaatttaacatgcttctctattctctgaacttcctttaaactgacagttaaactgaagactggattagatttaggttcaattgctttagaaaagaaaacttttaatttttattttttggagacaggatcttgctctgtcacttaggctgaagtgcagtggtatgattgtggctcactgcagtctctacctcctgagctcaagtgatcctcccacttcag

SEQ ID NO: 399810 - DNA, 1734 bp, Homo sapiens
attagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagatcctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgcgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatc

SEQ ID NO: 399811 - DNA, 1043 bp, Homo sapiens
atattcacctaagacctggtgcccccacatctgagacattctcatagtcccaggacccctgagacagcaggacccctgagaaagtttcaaacagagtttgaaactctgttatgctctggaatctccagatgctgcccctcaaatctacccacgacttagtgcccacagacctggcctccagtccgggaacactgaagtctaagatgtccagggaactcccagacaccctgggaccccagactcttaagatgcactgagtgctcggatatactgaaacacgagctgttctcttaccaaaatgacttgggagacccatcccagagcccccaagatccagatatcagacaccaagatgctctggaagccagggatcaaagacctccataggtccacccacccccaagccagggttctcaggagctttggatatcatttataggactcagaggtgcctggggtcctcagatgtgcgactgaaggccaccaacacctcaggacccgagatactggtctcgagttctcaaatagccctctcttgcagtccctcctggacctggattttgagaccccaaatgtcctggaatcttcagcttctttctacccacagattcccaaccccttaagggctgggagtccagctcccagaagaggggatgctcatggtgacccagacctctgatgcccttggccctcagcccttgagtgaccctaaggactaaagagcacgggtccctacccagtgtacccaccccacaattaggattgagaccgcctggcgtgttgaacgtttaaacaaacaaactcagggccggacaacgctaagatgttaatcagcggtgaaccacacggtacacgtacacaaacccgaacctccagataaaaggcgccacccacgtgagaaaggcgtagacaccagcagcgtccaagtgtatggcggcacgtactcggcacgaccgaaccgaccacacacaacacgagccccgcacgcgaacacacgagctcagagcacatgaacacccgacccatcgaaccaccaccgtacg

SEQ ID NO: 399812 - DNA, 636 bp, Homo sapiens
ttctgtgggtgtgtctgtccttacaggtgtcacatcaggcctgctgcacttgcccctgcttgcccagggacttcccttctaacaacgagatctgacagcatctctaagttgaagaatgctgcctgacacagggccttggaaagaccccacgctatcagaggcccgatgcccaaggtccattaacttctctgtggaatcatccctgggagccggggtgcgctcccgatgctggtcctccacagtccctctctaagatggtgagggtctgccccgagcttggccttggtgctgagaccctacacacagactgcaggtccctgagcactcccagatagtcaagcatcagggtccccagccctgcctctggccatccccccacctgcagcccatgcacacgaggtgaagaagcagcaagaggcacacagagggccaccttctcacaccaggatccttcagcggctcaagaacccaaagtcaccccagaccccaggcctggccatctttccctttccctcagctgagttctgatcagcttgctcctttccaagtaccattacctgccacttatgggctgcaaaaagaaatatatggcagttcatagattttcagacataataaaacacgcttgtcaaggcc

SEQ ID NO: 399813 - DNA, 529 bp, Homo sapiens
ctaatgattagcacaaaaagggaaaggctttttaaaaccaagataaaatcactttaattccaaaagtgtccatttaagaaatataaactgtgaagataagcaatggctattttctctaaaggaaagtattttcaaatgaacagaacaggcaaatgtagacttaattaggtggagtcagatgggtattaattattcacctttccagggtgagaataatagcattgttgctaaagaaatgaaataaggcatgacacttctttcttcttcattctgtgaaagctgctctgatctgaacaggttaaagatgggataacaggaggacagactgaaaatttgctcttcccttcacaattgagggtagatagtctttcgagagtgtagtatcctccattgaaataaaatgttattgactacctgcttggagacataaaaaccttctcatgtttggaatgtacatgtacttctctgttttgctctcttgaacattttcaaaatagctaaataaaatttgtcctcattcttagagttc

SEQ ID NO: 399814 - DNA, 677 bp, Homo sapiens
gcctgtaatcccagctactcaggaggctgagacaggagaattgcttgaaccgaggaggcagaggttgtagtgagacgagatcatgccactacactccagccagggcgacggagcaagactccatctccgaaaaaaaaaaaagtgtaatgtagcctaagtacacagtgttgataaagtctatagtagtgtgcagtaatgtcctaggccctcactctcactcacccagagcaactccaggtcctgtaagctccactcatggtaagtgccctatataagtgtaccattttaaaattttatttactgtacctttttttgtttggatacgtttaggtacacaaatacttcccattgtgttataatagcctaccgtgttcagcacagtcacatggctgcacaggtttggagcctaggagcaacaggctgtcccatacagcctaggtgtggagtaggctctgccacccaggtctgtgcaagtgcactctgtgatgattgcacaacaatgaaatcacctaacaacacattactcagaatgtatcgccattattgacacatgactgtatatatacatatacatgtatatacacatttcggcttacaaataataaatagctgcataatcatatccaggcaagaaacagaatgttaacagaaccccagaaacccacaatgtgtccctc

SEQ ID NO: 399815 - DNA, 498 bp, Homo sapiens
gctactggtggtcatcggggacgcagatatgtgtgtctccattttgcagatgaggacatggaggcctcaagaggttaagtgacttgctcagccacacacagctgatgggaatgaaacagatggaaacagagactccccaagctgacaggcggactacagatctgggggttctgctccaggctcaacacaagtggcctgggcgagggagggcctggtagaccatgacacccagcatcgaggaattctgcttccccagcaggctcagaaggaagaagtctgcttcaggggccaggcctggtcaaagactccatcttccctggatggccagagtcaaatccttgcaaatcccgttcaccatggagcagagacgagacctatgttacccaggctgtatgtgaattcctggactcaagcaatcctcccatctcagcctcgtgagtagttgggacaagtctcacaccaccatacccagcttaatttaatttgaattttaatagc

SEQ ID NO: 399816 - DNA, 404 bp, Homo sapiens
gattttaacccccaggaattaacctatgtaaatgacttctgggtagcaggaaagattttttccaaaaagcactcagcccagaagtagctcttttcttgccaacattctgggtgatttatacaactgttctcactgaatagtgcagagagaagggattttgcagcagaacgtgattgtagaactggaggcaagagatgtcccctgaagttgtaataattgcacagaggcagagtgaaaagatcagctggaccaagacaaagacatttattttagccgtaacagcgtgctgatgtgatggacttaataaataatgccttggctacatgatttttattactatctattatttgtaaataataactagtatgtgcttattgtatttacgatatattacaataatgtaa

SEQ ID NO: 399817 - DNA, 516 bp, Homo sapiens
tgggatggaatgaaatattttgcatgtgagaaggacatgtattttggggggcttggatgcaatgctatagactgaatgagtctcccccaaaactcatatgtagaaacctaattcccaatgtgatgttatttggatagggcctttgggaagttaataggtcatgaggtcattaatggaattagtgcccttataaaaggaaccccagaaagctcttccttccatcatttgaggttacagccatcttatcagtgagaaagtagacctttgtcagacactaaatctgccagcactttgatctagtactttttagtccccagaactgtgagaagtaaatttctattatttacctagtctatggtattttgtcatagcagtctgaatggaccaagacagaatcttatggtaagcctgctaaaaaagtaaagacacagagaaaatattaaaagcagccagagcaaaaaaggcacattgctttcaagtgggggcagtaataaaacctagagctaactaatcacc

SEQ ID NO: 399818 - DNA, 271 bp, Homo sapiens
taaatagcattcctatttcaggagccgatggtgtgattcgaaacaactgcttggttgaaggatggggggcaggatcgagaaggagagagggaaggggcagtgctgattctggattaggtgtatgtaggttttgtcttggtttattttaaagatcagagagtaattggaaacaattattttttaattaataacttgggaaaggtgaacagaagcatttcacagggttttaccgtgtgcacactgaaaataaaacactttatgctatgcttca

SEQ ID NO: 399819 - DNA, 403 bp, Homo sapiens
atataagcttattctaaaaatttttatgaaaaagtagaggatttggaataggtaaacaattttagaaaaaaatgaaataaagtggatggagtcatcctactcaagtaattaaaaagacttaacgagcttactaaagagttacagcagtcaaggcagtgtggtactggcagagggttaaacacatagataagtagaacaaaccattggcccaagaaatataccaaaaaattaactttttattattaaaaaaatgttttagagacagactctcgctatgtcacccagcctggagtagagtggcatgatcatagctcactgtaacctcactcctgggctaaatgatcctcctgcctcagcctccagagtagctaggactatttttagtcctagccaggctaatttt

SEQ ID NO: 399820 - DNA, 359 bp, Homo sapiens
gctttttagttaagtaagtatctattggtatttcatcagctcagattttttcctcagttatatccagtctactgataagcccatttctgttattgtgtttttgatctctagtatttctttttgtttcttagaatttccatctctattcttgtctttttttatttctttttctggagaacggggtcttgctatattgcccaggcaggtctcgaactcctgggctcaagctatcctcccacctcttgcctccctgagagctgggattacaggcgtgagccaccgtgcctggcatagaatttccatctctattcttatattgctcatcttttcttgcatgctgcctactttatcctttagaa

SEQ ID NO: 399821 - DNA, 171 bp, Homo sapiens
aaagctagttatcaaaatagtatagtactgacataaagacagatatatagaacaacggaacagaacagagagcccagaaataaatccatttatgtacagtcacctgatcttacacaaggctgcaaataatacacaacggggaaagaaaaatgtcctcaacaaatggtgttg

SEQ ID NO: 399822 - DNA, 90 bp, Homo sapiens
ttttataaacacaaggtgaaaattcattagaatgacatattcccaaaaaggggattgactttgacatatgaaactgtaagataattaatt

SEQ ID NO: 399823 - DNA, 444 bp, Homo sapiens
gtgttacatgtatttagcacattatggagaaaatagagtgataacttgagttctagtgagctccaaagggatggaatgatatgtaaaaatcaccagaaatttgtttaagccatactgaacctttctataatgagacctaaatagaataaggtactgggtaatgaatgtttcccaaattatggcatgaatgtttaaggactatttcattttaagagatgcagtgtccagaaattgtcaccatggtagtagtttttaaaatgtgttcctcagagctgattggctccaggagtgtgtaactcaggagtgtcatctaccatctgtttatctatctagttaactatctattgtagagaaggttgtggtggagtaaaccaaacaggcagcttgggattcatttgttggggatctgcacaagatattgttagaaaatagtttgggctgcta

SEQ ID NO: 399824 - DNA, 270 bp, Homo sapiens
cagcatagaaatcagagtgggcttgctggatcatgtaatacagaagcgggtggtccttgtggctatcttcggtaaccactagtgcacctggatggggacaggtgcatgaatgggcccatatgtggacccacagagctggttctgtcattgtccccttgagagcagtgctccccacgcctagtttacagccatccatagcatgtaccgcagagttctggactgggctttaaacactcgggggaggaatcaataaaacagacaagactgtga

SEQ ID NO: 399825 - DNA, 633 bp, Homo sapiens
aacaagagctgttttgaggaataataggagtggcagccagatggagttggttgagggtaaggtagggaggataagatggaaaagaatagatctttctctccaggggtttgatgtgaaaacaggagagaaatcggagggggatgatggaatggactgtggggacatggaaatattttaatttcattttttaaaatttaagttattgaatagattttaaaaagtacctgtttctaaattcacaaatgatagggcttagccatagacctcctatgatttgctgggccaaaccaggcaaaaaactttatgaaataatgctttagatgaaatgattcatagagttctagccctgaaattctctactgagttatgattaatcttgctttctaaataatgtagatacttgtcacatagatgtggccaataataattactggaaggaattagatttgctggtaattatgatttcactccaatacttaggagtattgataagtgctcacttcagcagcacagacatcaaaattggaatgatacagaaaaaattagcatggcctgtaagaaaagaaaaaagaagaccagtctgagcaataaagtgagacctcatctctccaaaaaataaaaaaaaattagcca

SEQ ID NO: 399826 - DNA, 360 bp, Homo sapiens
tctctctgagccaccttagtccctgtggtatccccagtgcggccagccagggacctggcccattgtagatgctcactggcaaataatgactcagtgattgaatggagaaaagaaaaagaatcgcaaagaaaatttaaaatgcacttgacttctaaagtgcaagagaggaaaacatgaaaacttgcattaagacctattgtcaccagcggtgacagagaagccattatatatatgttttttggtttttttttttttttgagatggtgtctagctctgttgctcaggctggagtacagtgagcagagattgtgccactgcactccagcctggcaacagagtcagactctgtctcaaaaaaag

SEQ ID NO: 399827 - DNA, 614 bp, Homo sapiens
aagagacatcagtgaacttaaccagacagacccatgtcctacctgatagaaatgtgtacacatactcaccaaaagatatgtataggaatatccttagtaacagtatttgtaatagccaaaactagaaacaatgcaaacgtccatcaagaggaaaataggtaaaccagtatggtatatttatgtatatttggaatgttatttaacaatgagaatgaatgaactataactatatgtaactacataatgctaagtaaaagaagtgcttgatttcatttataaaaaatggaaaaacttgatttcatttataaaaaatagaaaaacaagagaaattaaccttgggggttagaaatcagattaatagttatttttgggggaatggtgattggaaggaggaagaactatttcttgatctaagtgttagttccatgggtatgttcactttatgaaaattcattaaactctatacctatgatgtgtggcccttttttgtatatttttattttatttgactaaaaagtttactttcataacaaaaacaagcctgccttcatggaacttacatttttgtgggagtatacatataagtaaacaagacagtcagttacaaagtgata

SEQ ID NO: 399828 - DNA, 459 bp, Homo sapiens
gatgtgctgagaatacttgaggaaacaaggcctgaggagatggaaagagaatttaaaacatttatctattatgtgattattataatatgaacctctgtttcctatgtgatgttccctgagtgtagaatttgtttctttcttactgtgatatacccagcacttgagatggtactgacagattgtatatgcttagtaaaatttgttgaatgactgaaagaattgcattgggagtttagtttatctcacacctgatggatatatgaaaaattatgaattggtaaaggagtgtttaaaagtagaaagaagagctgtgggagctcacatccactgctcatctttccaataaagtaggcaggggaattgcttaccagaaggatttggcgtatttagggcttaaagaaagttgaagagtctagaataacaccttccataagtgtgctaaggcattaactaataaaa

SEQ ID NO: 399829 - DNA, 1161 bp, Homo sapiens
actgcttgatgactgccacctggttggaagtattgtcagatgccataaattgtaagatacaccttgatttcaaatatgtgaaaaattgtgctcagtgttaagcattgaggaaattatcatatccaatctaagccacaatttggccatttaaagctaagaaaaactgagaacatggatcttgaagatacttggactggatcagctcttcctttcccatcattaatttggaaaactagaacagatctatccctggacagtccaagtaaacaaattattttgcttaattgctttactaggtttttgaatgaatgtgctgatggtttagaatttctgctttcttcgtaatgactcacctacatttttgccttttaagaactatcctcatctgttgtattatcaggattataatatcagtgtagaaagagctagtgaaattttgatattacttcctccttgaaattttcaataaaacaaaaaatatctcctccatctgtacttacatccaattctcattcacaatgctgtaattatctttttcctttgattagctatactaaaatcaagtattaatattttttcacaaagccttaataagtctattttattttcaaattcattaactccttttaatgatcctcccttctttcttatattgacttatttttcccttagtttcttgagtttaatgcttcttcattcttttaacagttttataagtgattactatgttaaagagacagtattaagtcactgggagtagagtggtgagcaggagaaacaaagtgctggccctcaatatttgtttcctgaatatattaacaggttactgatttttcactgagcacaggtttggccacattcacaaattctgatcttaccattcatttctaaattgtcctttatggtttcattttctttttgatctagtgtcattatattattggagattttaaatttccgaaatgccaaagtactactctacagatcgtttactaaattaaaagaaatatttagctctacaacagagaaacctggtgattaccatatgaagcaagtatttcagttacctatcgctgtgtggcaaactactccaaaacttagtggcttaaaacaggccatattttaaacgtaaatctgcaatttgggcaggctcatggggga

SEQ ID NO: 399830 - DNA, 790 bp, Homo sapiens
gaaaaataaaagtattttttactgtcgtttgcacagtctagttgctgtagttggtgacactcgctggctctctctgaaccatgtttccctattcactgttttgccctggctggagttgcatggaggtggagcccctcccagggcctccagctttttctgcttgagtatattgctgcccctttagcattaaaggctgtcagagagggggtgctctttttcacaccatttattttctccaaatttacctcacagggtcaattaccacattcaaccagtgatctcagatgcaacaaatgattttagtacaagcaaagtctcacacaaagacatgtacaccattatttgtaacactcctataataactctggtaaaaagtaagagaagcagaagttcttatgtttaagaaacattttcttgagtgacacaaaaggtgattacagtagtgaagctgtaggactatgtgattaagtaccaaactgtgtcacacatcatggataatagttaaaagcatgtgatatggtttggctcttgtgcctccacccaaatctcatgttgaattgtaatccccagcgttggggaatggacatggtgggaggcgattggattgtggcagcagaacagcaagttctcatgatagtgagtgagttctcgcaagatctgattgtttaatgttcttgcttccccttcacccttctgccatgattataagcttcctgaggcctccccacccacgcctgctgtacagcctgtggaattgtgagtcaattaaacctcttttctttataaatga

SEQ ID NO: 399831 - DNA, 844 bp, Homo sapiens
gaaaaataaaagtattttttactgtcgtttgcacagtctagttgctgtagttggtgacactcgctggctctctctgaaccatgtttccctattcactgttttgccctggctggagttgcatggaggtggagcccctcccagggcctccagctttttctgcttgagtatattgctgcccctttagcattaaaggctgtcagagagggggtgctctttttcacaccatttattttctccaaatttacctcacagggtcaattaccacattcaaccagtgatctcagatgcaacaaatgattttagtacaagcaaagtctcacacaaagacatgtacaccattatttgtaacactcctataataactctggtaaaaagtaagagaagcagaagttcttatgtttaagaaacattttcttgagtgacacaaaaggtgattacagtagtgaagctgtaggactatgtgattaagtaccaaactgtgtcacacatcatggataatagttaaaagcatgtgatatggtttggctcttgtgcctccacccaaatctcatgttgaattgtaatccccagcgttggggaatggacatggtgggaggcgattggattgtggcagcagaacagcaagttctcatgatagtgagtgagttctcgcaagatctgattgtttaaaagtgtgtagcacttcctgcttccctctctctctctcctgccaccatgggaagatgttcttgcttccccttcacccttctgccatgattataagcttcctgaggcctccccacccacgcctgctgtacagcctgtggaattgtgagtcaattaaacctcttttctttataaatga

SEQ ID NO: 399832 - DNA, 282 bp, Homo sapiens
ggctactcattaccattctttaactgttacaatttatatcagcatataatgttaaataattacagggagcggagctcactctagtgaggatataaacgcgctgtgggaatctacagatttaaacaaataacactcacagcagggggtgagcggatgaattagcattaatatcctgcctgggagatcccagtgcactggtactgcttaaatacagatcttttctgtaacagtcaatatgacagctcccggcaatacggcccctttcccttctgtcgtcttctc

SEQ ID NO: 399833 - DNA, 651 bp, Homo sapiens
gggctgatgggataataccattttcccagtcctggctgaatctgagcataaatctattttcttatggcctcaccttcttacaaggctcctaagttctttaggaaaacagaatccttgtggtttccctaccccaacaaaggttccagaccctctctacctcacacatggcatcaacacaattttagctataaacctgatagctttagactcttggttccctaagggagatagatacagggacccatctgtgtaccaccatccccagcacgtattttaaagttattcagacacacctcagaactagggtaagtgcagtttaggatctcaactatgaaaaccagaggcaactggcacactttcattattaactgcaatgaaccatttaccaaccagctaattgctttctcctcaatctcctcccatttcttgtgccacttatgtcagggaattgaataggatgaataaatcactttagtactttggtactggagaagagcatatcattcttagacagggtcttgctctgtcacccaggcaggagtgcagtggcatgatcatggctcatgcagccttgacctcccaggctcaagagatcttcccacttccgcctcccaagtagctgagactacatgtatgcactactacacctag

SEQ ID NO: 399834 - DNA, 398 bp, Homo sapiens
tgaatacagaatgacataggaacatgccatagaaatgtgttatagttgtcaatttcaacagctcatattataaaacatcttttataccttggatcattacagtacaaatacaaaatatccatatcatggaagattaagctgctatgtaaaataatgaggaaattctccttaattggtataaaaaggtctccatgatatttttaggtgaaaattgcaaggtgaagcaaggtgttgtctccaaaaattaataaaattggttggggtcatggtgtaagtgggcagatggtatcaaaggtagaggttagactttttatgttcttttgattttggaaccgtgtgtaagttttaccttataaaataaaagagtgcctttgaggggttgcatggaaagaaaagta

SEQ ID NO: 399835 - DNA, 454 bp, Homo sapiens
caaattcacgtacagttgcaagggccctgagtaaccaaagcagtctttaaatgggacaaaattagaggactcacactccccaatttcagaacctactacagagttatggtaatcaaaccaccatggtacttgcataggaatagacatatagatcaatggaatgggactgaatccagaagtaaacccatacaactgtagccaattgatttttgaccagggaaccacatttattcagtggggaaagatagttcaccaaatggtgctagatttctgcatacaaaagaacaaagttagacccctaccttacaccatgtacaaaaatcaactcaaaattgaaaaacaacttaaatataagagttaaaataccaagactcttagaagaaaacacaggggtaaatctttatgaccttggatttaacagtggattcttagatgtgtcaccaaaagcacaagc

SEQ ID NO: 399836 - DNA, 481 bp, Homo sapiens
ttgtagagacagggtctcattatgttgcccaggctgctctcaaacttctgggctcaagggatcctcccacctcagtctccccaaacgcgtgagtcaccatgctggacctcagcctcattttgatatgcgttgtttccaacaggctggaacaccaggtttggacataattttttcatccagtcaaacaccagaggcagcaggcaccagcacacatgtctaaggcttgactccctgaagattctttgatgtgggattctcactacagttcattagaaacaacaagcacacatgagtcttctctgtcagaagcccctgattctggggctgggaatgttccttgaggaagtgccagtgtctcaggaggtgccagcagaaccacccgcattgcccctgggtgctaaaattctaaattctcaactctgaaaatgcacacatactggggacaaaataactaactgtatgtcagtgagctttagggcca

SEQ ID NO: 399837 - DNA, 446 bp, Homo sapiens
caaagcaaggatcttttcccaccttctctgtcagatgaactcctcatccttatgtcttggtatatgaggcctttttcaggtaatgaattttgttagaattgtttgtgagcaagaggaagtcacttctgagcaaaggcctgagggccgcctgtaagaaaaagtttgggctaggccgggcgtggtggctcacgcctgtaatcccagcactttgggagactgaggcaggtggatcacctgaggtcaggagtttgagaccagcctggccaacatgggcgaaaccccacctctactaaaaattagccaggattggtggtacatgcctgtagtctcagctgctcgggaggctgagacaggagactcgcgtgaacccggggggcggcagttgcagtgagctgagatgggtccactacactccagcctgggtgacagaaggagactccgccctc

SEQ ID NO: 399838 - DNA, 476 bp, Homo sapiens
acaaggagtgaagaaaggagcaaaaggaagaagaccagaatctgagacaaggaattgtcccatgtgctcgaagtctttgaagagcaaaaatcaaggagagtaagaatggaagccactcaactactgcttcagaacaaagttagcacgggctcctgagaaatgactagaagatatgcctgggattcaaaggacctcagagccacccatagctaatgtccctgtcatccaacagatgctgtggctttgggaaagaacagcctttcttgacctcaaatctttgtgtctgaaaaatgagaggggtaccagatgctacctaagcagtcttcctacctaaaatgtatgagtataagaagaatgatcaattttaatctcaaaatacaattctcacctttcagttaccaagatacagcccccttcccttaacctgagctacaacaaaacataagttcaatagagaattgattaatgagtataaa

SEQ ID NO: 399839 - DNA, 471 bp, Homo sapiens
  misc_feature (46)..(48): n is a, c, g, or t
  misc_feature (54)..(55): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (66)..(67): n is a, c, g, or t
  misc_feature (78)..(79): n is a, c, g, or t
actcaaattttttgctgctctgcacatggcatgccgtgtaactgannncctggnnanantgncaanntggcactgtannttgttttggggggttttaaagaaattttacccagtaggtaaattcaggaatgcagctttcacaaataatgaaaatctaccatatattgaaagtagagcgggctggacgtggtggctcatgcctgtaatcccagcattttgggaggccgaggcagatggatcacttgaggccaggagttcaagaccaacctggccactggccatcatggtgaaaccgtgtctctactaaaaatacaaaaaattaaccaggcctggtggcacacgcctatagtcccagctactagggaggctgaggcaccagaattgcctgacccaggaggcggaggttgcagtgagccaagattgcccccactgcactccagctgggctgacagagcagcaagaccctgtctc

SEQ ID NO: 399840 - DNA, 498 bp, Homo sapiens
aattatttgaatgttgaacttactgatttctcatctacctcttttttgcttggttttcttattcgctatcttttttctgagatttccccagctttatctttcaacaattctattgagtttttatcttgtttttaattaattatctttttaaaaatagcatctttagtctcttggagtgctagaaatgttcggtatctaggtgttgataacacaggtatatgcacatgtaaaaactcattgagcatttagtatgcatatggtgattaattattaacctgcttctgtattacaggttctcaactgacagtaaacctcaggctaaagacttgttttataccttccaaagctagtctaccatctttagaagctggggaaggggggtgggcagctgccagttggtacagaattaaggagggtatctacgagtccacctgttttttaccattattatttagagacagggtctcattttgttgcccaggctggagtgcaatggtg

SEQ ID NO: 399841 - DNA, 396 bp, Homo sapiens
ggatataggaaccctcttaaaagggttcccactggccacatgtgggataagttgagcaccaacataattaagaacagtaataaagcataaaccattcaaaaaatgggaatctggctgggcgcggtggctcacacctgtaatcccagcactttgggaggcctaggcgggtgcatcacctgaggtcaggagttcaagaccagcctggccaacatggtgaaaccccatctctactaaaaatacaaaaattagccaggtatggtggcacacgcctgtaatcccagctactggggaagctgagacaggagaattgcttgaacccaggaggcagaggttgcagtgagccaagattgtgccattgcactccagcctgggagacaagaactaaactctgtctca

SEQ ID NO: 399842 - DNA, 645 bp, Homo sapiens
ggtgatgtttatatgaaagtttaataataaatagctggtttgagttgtgttactaccttttttggcaataacataatatgaaattgatggactacatgtttgctttgacagtgagaaaaccttgtgtatcaaaatctagacttttcatgcagatgtattttggaggtgatactcatatttcagaagtaaactgaattccataaaaggatgagcagctccttatcatagttagatatttacatatttttatccaagtaaagtgagttagacctagttaaagcattagagaccagcacaatttgaaagaatctgttatcattcaagtctttgagttaaagtaactttaggagtcacttaatcaacgtcactgattttatagatgaggtagctaaagccaaataaatagctccaaatttgcattgtaagtcagcgggaaatgtagttttacaagcattaggattaaacctgactttacatctgttatctagatagaatgaattatgtatttactagaaaaaaagtgttatcaagagcatttatgtctttcaattttagatcatactcttggtagcagatgctaaaaagacgagttctaaataatgttctggtactgtgactttaaagcatgctattgcatacttgatt

SEQ ID NO: 399843 - DNA, 514 bp, Homo sapiens
tgtgctatgaggaaaagcaaaacaggttgaagagatagctatgtggtgggagtgggactatttcgtacagggcactgattgtagacctctgatgagataacatttgacaagagatctgcagggagctatgtgtcatgggggaaggcattggagggttttgtgcaggacagtgatgtgtgatcagatttagtttaaaagaataatttgggctgggcatggtggttcctgcctgtaatcccagcactttgggagggtgaggtgggcgaatcacttgaatctgggagtttgataccagttcgggcaacatggcgaaatcccgtctctacaaaaaatacaaaaattagccagtgtggtggcacgcgcctgcagtcccagctacttgggaggctgaggtgggagaattgcttggatctgggaggtggaggttgcagtgaactcagattgcgccactgcactccagcctgagattgtgccactgcactccagccactgcactccaggaagaccctctcag

SEQ ID NO: 399844 - DNA, 428 bp, Homo sapiens
tgagccccggggacacccaccaaagcagtcgtgactctgtccacctggccatcagagggcacagtgcctcctcccccaggacgacggacccatgcacagccaccaccccaggacctccggacacactcccataccctgtacctgtcccttcttcaccagcatccaccaagggcttcctgggcccgacacctggacactgtgcagacacctccgggggtgggggcggctggggcagaaattctgcagctgttggccttgggggaaggacgcgggccgaagcagttgctgccctctaacttctccgagtggcaggctcacaggagcagagtgggctccagtggctccgccaggacaaggcactggttcacttccaatcccagccacccattccctgacccgggccagtcctgtcgtcagcccgtcctcca

SEQ ID NO: 399845 - DNA, 498 bp, Homo sapiens
tataattgtagagtgttaattgctttataacatatagatttggatgtatgttttgtttaccaaaacaatgaaaatggtaccttcttcaagcttttctcattggtttttaaggacattttgattcctaaacttggtgagactaccaagaaaattatctcatttctgtgtccccagttttttatattaaaaaatttaaacatatattagaaaaattaattgtgcggcagggcagtgactcatgcctgtaatcccagcaccttgggaggtgaggcaggtggatctcttgaggtcaggagtttgaggcctgcctggccaacatggtgaaaccctgtctctactaaaaatacaaaaattagctgggcatggtggtaggtgcctgtaatctcagcttctcgggaggctgaggcaggagaatcgcttgaacctggggggcggaggttgcagtgagccgagaccatgccactgcactccagcctgggcaacagagtagactccatc

SEQ ID NO: 399846 - DNA, 493 bp, Homo sapiens
ttggggcctggtcacgtggcccagctgcccataaaaccaaagcattgatctccgctctccagcaagcctctaagccacgggaatgatggagggggtgcgtcttggaaacctgtaatcttccaccatacatctcaggtggcatgtttgaagtcctaggatgagttatttatattatttttgcaacatgtactgaaagggcattagccaaaactcctggcaatggggcttacaggggcctggccacttaaaaaaatagggcggaccaacgggtccccctagcaagtaactcatgaggtggattttctttgggtagccagataatcaaagccagatcatcttgcccagacttccccaaatccgggttgttcaaggatcaccttcccaacttctgccgtattggtgtaccgcttgatctgttattcacttcatgctttttattttaaatcgctactttttacttggcttcattccaaacaatatccacaaaatcaca

SEQ ID NO: 399847 - DNA, 2018 bp, Homo sapiens
  misc_feature (1418)..(1418): n is a, c, g, or t
aaaataccttctggggttttctaaggtacctgaaatgcctgacagagatttgaacagagtatcagaatgagtcatcagactaaggaaacaactaatacaaaggcctgccgtgcgaggaacttggctccacttagtcttctctgagctccacagtgagagaaccatccctctacttgaccactctgatgggaaactttctggcatgtcaaacttactgtgaccaaaatagaacttgtgatttatttttctcccccagtctcttccttcttaattagtggcaccatcatctatttacccaaattaataagcccagaaatgtaaaaattatcttagattccttctgcccttctgtatcctttccttccttacttctgtctgatctttctccaaaatatatcttgaattcatcttctcttcctctctagggatatcactgtgatcctagcctctgtcatctctcacctgtcttacttcttccagtcttgtctctcccattcagtctgttgttctccacccaggagccagagtaatcctttaaaaatgtaaatcagattagattatttatgtatgttagtcatttctactactttcattaattactggttcatatttatcatcccatttgataaaaaatctccagcatttccttttgcacgtgtataaaatccaagttagctgttaccatgtcgtgtatgatgtttctttcccttgctcctttttcaggcttcatcccatgccacttgccccatcacctgtaatgctaattctagttattttgttgttattttgtccttcctttcagttccttcccatcagcttttactccttcaatgtctatgcatttgccttttctggaatttctcctcctagctgtttgcatggctggcttcatttcatccaaagtagtttcttcctgttatattctgataacatcctgttttctccttcattgtatttataacaggctttaattatttgtttacattttactttttgactcccctagtttaatgttagctctgtgagaacagggacagatattcagcctagcctagaatattgcctagtatactgtagacattcatactcaggtagattaaagcaaatatagaaggaatgaaagttcaatgtcagaagtttaggctgtatagaaattagaaacttctgcatgtcagactctatagtatatttccataaatcgagggaaaaaaataaaatgatgatacagagtatcattctaaaaattctggaaagcactacaacctcaatagaaaaagtggacaaaagtccatcaatgatagactgcattaagaaaatgtggcacatacacaccatagaatactatgcagccatagaaatggatgagttcatgtcctttgtagggacatggatgaagctggaaaccatcattctcagcnaactattgcaaggacaaaaaaccaaacaccgcatgttctcacatgtgggaattgaacaatgagaacacctggacagagggtggggaacatcacacacggggacctgtcatggggttgggggagggggggagggatagcattaggagatatacctaatgctaaatgacgagttaacgggtgcagcacaccaacatggcacatgtatacatatgtaacaaacctgcgcattgtgcacatgtaccctagaacttaaagtataataataataataaaaaagaagaagtggacaaaaggtatggaacaataattaatgaaataaatagaaatgactaacatacaaaagaaaaaaatttttcccagtatccaaaaatacaaattaaagcatgttatttttgcctcatattttcaaagtgtaagaaaatagtatttttaaggttgggataagataatttacacacaactggagggaatataaaattggtataggccagggacaatgtctcgtgcctgtagttccagcactttgggaggccaaggcaggaggattgcttgagtccaggagtttgagcctgggtgagacagtgagaccctgtctctacc

SEQ ID NO: 399848 - DNA, 488 bp, Homo sapiens
aattggaaaagtcttgactagaaatttccacattttgcttagatgatagaagcaaatgacagtttggccagctgccccaggtgcattaaaattcatgtggcccctggactaactggatcgattccaaatgtagatcttccaaatgaaactgaagacattgaattgaatccagattttacaggggaatagctaaaatgaatagaagaaagcagtgatgtcatactgtgtggtcagaaccctgccgtattatcctcctcagtatgacttttgttgtagctatctgtggagccacacattgactgggctgtctacatttgttagaacagagaaaaggatgctaccttttccctaagatgtcattgtatcttggaggaagactagaaagggataagatgtttctcatttcatctattagttcgatatctctctaagcaactcaggtatcaggcaccatagattgaaaaaagaaagctgttttataaaaatac

SEQ ID NO: 399849 - DNA, 408 bp, Homo sapiens
cttttccctttaccttaagacaacctacttctgtaactcttataaagattattcaatacctttctaattggtctctttgtcttctgtcttctctttccttgtccaacaccccagttccgatacacaaactgatttactactctaagactttaacctttgtaattattatggccctcatcctgttattcttctgtttaagaaacaagaggctccctttacaacaaatcctcttcgtgactttcccacacatttgtaacatcacctaccttttcctcagtatcttatttgttactatcccctgtatacattctttattctaattaatttgaaattggtaatgccctcacatgtgcctttactatccctgtatgtatgtgtgtagacaaatgagtctatgcatacatgctt

SEQ ID NO: 399850 - DNA, 344 bp, Homo sapiens
gcacatgtatttgaaattttgttagatatatttgtaaaaagttgttgaggatattcagcccggccgggcacggtggctcacgcctgtaattccagcacttcgagaggctgagtggggcagatcacttgaggtcaggagtttgagaccagcctggacaacatggtgaaaccctatctctactaaaaatacaaaaattaaccaggcgtagtagcacgtgtctgtaatcccagctacccgggaggctgaggcaggagaatcacttgtacctgggaagcgcaggttgcagtgagctgagatcatgccattgcactccagcctggacaacagagcaagaccttctctca

SEQ ID NO: 399851 - DNA, 520 bp, Homo sapiens
gatggtcaacaactgcacatatttcttttttcttctttgacttaagtgaagggagtaacaagagagttttctctgcaggagaaagagttgggggtggggtggggagtcaacaaatatgtcccaccacctgtttctataaagttttattggaacatatccatgcccatttcgtaacttgttgactgtgcatacagcctatgctcactttcatgctaaaacagctgaattgagtagttgcaacagagatatgactttcaaagcctaacataattgctgcctggtcctgtataaaaacaattgtggatccctgacatttgactataaccaatactagttgggaaggccagtggaaaggcatgtggccacatggaggaggctaaaataaaagtgtttgataaataatccagaggatggctacttagttcttaattaatttgtagttacatattttctcgatttgtacaattgctgagatctgttacattatttgtaaataaaactatcctcgttgacatattat

SEQ ID NO: 399852 - DNA, 450 bp, Homo sapiens
catgctcaacatcgctaatcatcagggaattacaagttaaaaccacagtgagatatcatctcctcccagttagaatggctatttcaaaaagacaacaaataaatgctggtgaggtggcggagaaaagagaactcttatacaacattggtgggaatgaacattagcatgccattatgaaaaacagtatggagaattctcaaaatactaaatatagaactaccatgtgatccagcaatcccactcctggatatttatccaaaagaaaggagatcagtatatcaaagggatacctgcactcacatgtttagtgcagcactattcacagtggccaagatacggaatcaacctatatgtccagcaacagatgaatatatatgtgtatgtgtatacaatttgaatactatttgcccataaaaaataaaacgctgtcatttgcagcaacatggatgg

SEQ ID NO: 399853 - DNA, 957 bp, Homo sapiens
gaagtagatataatcccttccttatataagtacctatcaagaacttacactataccaggcattcttttaggtatccaggattcctcaacctcagcactattgacactttgggctaaatcattctttgttgtgaggaaactgttctgtgcatgacaggacattcagcaccatccctggcctctacccactagatgtcagcagcacccctcaccctcgccaagttatgagaagcaaaactgtctccagactttgccaaatatccccagggaacaaaatcgcctctggttacgaaccactgtactagatacacaaaaattgccctgcctactagttgcaatttttgttttatgctccttaaggacagtcagtcctcaaaaactcagtgcattatctggtgtacaggttgtcaaacctcctcttctccattgctgggctactgctgacttctgaccaagtggaggaggttgcgggggttctgggagcatccagttccttactctcagttatgctttctaagtctctcatcatttccattagcattctgatcttttagaaagcttttctagagcagcaaatctctaacattcatctgatatttatattgtccataaatatttgaagtatcaaatcaacatacaaaaataagaagtgcaagttttgcattgaagtggaaattttaggaaatgttctacatcagtaggcatctcctgttagaggtttgtgattctaagtaattagtaccaagatgtttcctagttatccttttcaactcagagttggctgtgactaagggataaagaatgggagggaggtgtttgtttatgtttagttttcacaaacatgtcatgatgtattgtgagaccacagcgacttattaatgcaactttcatccagtgacttgaaaaccttcaaaaatattcattaacagatacgctgatgaggtttgcaggctttcaa

SEQ ID NO: 399854 - DNA, 512 bp, Homo sapiens
aaaatgtaattattttattaagcattatattcaatgtaaaggctttaaccaccataatcaccatgatagaatatgtgtgtatgtataaaaaatacccattgaacatgccttaagaggtataattatgtttttaaatctatgcaacatgagatgtaatttgaaataaagaacgactaatcagaagcatgaaaaaaccctgttttaatatgaatctattgctgattctggaataatggtcacgtgtatgtccttagtcacactgggtttctccagttttgattagagtaatgtgtgttccacaacaccaattctaatgtccatctgaacagtttcttgcttcagttttgttaagctctgtttaatcttaaccaaagaatcaccacctcttaaccaaagaatcaccatcagtcatgctgctgcacttttcttccatttctagttttacatgttctgtcttctgtagcctcagacagaagtctggtcctttcaattactccaccacttccttgctg

SEQ ID NO: 399855 - DNA, 255 bp, Homo sapiens
cacagctgaaaattcctggtcttatggaatttacattagttaattaattgattaattaataggcttcaagataatctgacttggagattataagcccatttgtctcccaatttcaatgctacttgaaacaccagagaacagctgtaacataggttattgtatcagagtttcaaagttatagctgccactatttggccttgaattagccagcgcttttggttttctcaaagaatgtggtgtgtttctttgcacttt

SEQ ID NO: 399856 - DNA, 460 bp, Homo sapiens
attatatacaaagtgatagaaagtgggtggcctggtgtggtcctttcctctccagcctcttctccctcctgtctcctacagatatcctctgtccaactacactgagccacttttcaagcttcttgaatttgtcaaagtgccttcttgccagggtacctttacttggaatgccctcctgtcccctatctccagctacctgcaagctttttactttctgtggcatccatcttaatagaattgatcactcgttccttgtgctatcattgtacctcttacacattctcatgtcagtacttgtcacaccaaactgcagttatttgtttccatgtcactctcttctcctgggctgtgagctccttgagaatagagactgtgtctgttttatctttatgaagtccaagaacttcatgcggaacctgacacttagtagaaagtgaatgaatgaatgaaagagaatctc

SEQ ID NO: 399857 - DNA, 1903 bp, Homo sapiens
  misc_feature (970)..(970): n is a, c, g, or t
  misc_feature (1277)..(1277): n is a, c, g, or t
  misc_feature (1305)..(1306): n is a, c, g, or t
  misc_feature (1590)..(1590): n is a, c, g, or t
  misc_feature (1731)..(1731): n is a, c, g, or t
  misc_feature (1813)..(1813): n is a, c, g, or t
  misc_feature (1894)..(1894): n is a, c, g, or t
atcttctcctctctgcaaacctctcctgtgctgatgcctgggcaccagagatgaggtgggagcagtacctgccctaggcggggctcacggtctagtgcccacagcagctgtccagggagtgcaggctgaagcagtgagatggcaggggggacggagtgagaaaagagcctctcagaagggcaggaggggcggggaggggcggggtggcacatggagctgccaggaaccccagaggcagctctgttcccagagttcagaaacctccaagaaaagctggtggcattgtccgttttgttgtttgcctatctggcctttggctattgactggatggcatcttgggaatcctctgaagggctggagtttaccccaagcacagggacagagggagcaggtggagtcacttctcgttgatgtccagctgagctgggctggtggctgcctcagaagggagggggcagctactaggagcagcagcctcaccccagggctctgtggacctccttagcctgtgatggccttggcaatggggatggcctggttgggggactgagcaaaaggcaggcagtagggatgggtgttcccagccttgagtcagatcctgagaagctccagggcggggcacgttctgtctctgccatctggaaacctaccagctacagcaattgtcacctccaacaagaacccctgagcccggaagctgggtgagaggaacctccaggtacaactctccacccagcacagaccaggtctgctgatctgtgccattccctgatgcactgtggcatcccgtgaccacagactgtcacccacatccccagaacctgcacggtgcttgcttggtacagactaactactgagtgtccattaagccaaactggtaccaccatctggacctgtgaaatgtccttcaacactcccccacccaccccttcctgccacgcccctccctcccttccacgtccctccctnccacgcccctccctcccttccatgcccctcccttccacacccctccctccctccctcccacaaacttgtcttgagacctactgtgttgggtggcgaggagacgaaggccttgggaaccacattcctgttgctcccgtggcccagaaccagccctcatgcctcctgcgcacaccatgttcacctgttctccccctgagctccagcgcagagaccctccctgcccaagttcactgcagtgtctcagcccccagctgagcgcctggcatagagcaggcactttccaaattttttaatgatctagaaatgnaataaatactgaggggctcagggtgtcnnacagcaagtgtgaaagggcttgggtgcagtggctcacgcctgtaatcccagcactttgggaggccaaggcaggcagatcacctgaggtcaggagattgagaccagctgaccaatatagagaaaccccgtctctactaaaaatacaaaatcagctgggcgtggtgttgcatgccagtaatcccagctactcgggaggctgaggcaagaggatcacttgaacctgggaggtggagattgtggtgagctgagattgcaccattgcactccagcctggacaatgagantgaaactctgtctcaaaaaaaaaaaccaaaaaggccgggcgcggtggctcacgcctgtaatcccagcactttgggaggccgaggcgggcagatcacgaggtcaggagatcgagaccatcctggctaacacggtgaaacccngtctctactaaaaatacaaaaaattagccgggtgcggtggcgggcacctgtagtcccagctactagggaggctgaggcaggngaatggcctgaacccgggaggcggagcttgcagtgagccgagatcgcgccactgtactcccgcctgggcaaaagagcgagnctccgtctt

SEQ ID NO: 399858 - DNA, 582 bp, Homo sapiens
agtcatctgaagacttgactggggctggagaacctcctctcaaggcaactcccacacaagcctaggaagttcattctggctgttggcaaggggcttctgttccttgccatgtggactgcttgccataggctgcttgagtggcctcatcacagacatggtggttggctttccccagagtgagtaatccgagagagagagcaaggaggaagccttggtgccttttatgaccccagtctcagaagtcacataccatcaattctgccatagtctatctttatttagaagtgagccatcatatcccactcacactcaaggggagaagagttagtttctcccttttgaagggggaagtgtcaaagaatttgtggatgtattttaaaaccaccacaccaagaaagagttgcaagggggaaggatgctaattaaatgacaaataacaacaacaaacaaacaagaaaggctgggtgcagtggctcatgcctgtatcccagtgttttgagagacctaggtgggaggattgcttgaggccaggagtttgagaccagcctgggcaacacagggagaccccatctcaaaaaaaaa

SEQ ID NO: 399859 - DNA, 338 bp, Homo sapiens
aagcgaagagagtgagttcaactgagccaaaatgatttttgtgtgttaagctctgaaaatactttggggagaacacagtgatatcatttaaaagttctctgcaggaaaccaggaaattaagtactagagtggatggtccgagcgggtccgctcgagaccactcgaagacacagtgactgaggaagctggatgtctgcagtcctcgtgacgtccatgcccaacgtgaacagcatgcggcagcccctcccagcctacccctcctgcgctgccccagagcctgggaaggaggccgctatgcagggtagcactgggaacaggagacccacctgaggctcagc

SEQ ID NO: 399860 - DNA, 563 bp, Homo sapiens
tcaaaaatatggccggacacattgtgttttttcccttagatgaaatgctttctcattgtaaggagttcaaatgagcacttcacacaaaaaaaatgctacgtaatcattgtccagaaggaacagatttgtggcttgtttttattgacaagcagttatttgtatttgttggtcgtaaggtataaaggaagggggtaaaaactaaattaaaccaagtatttcctcactctatcttacatgccttaaatttcatgcaaaacacttgagaaaatatgagtgcctattacttaaatcatttaaacagaaaataccatcagttgctatctagataggacacaggtaaacattcatattatgcagcagctcagcctgacaggactagattcaatcatgaagatttgaatatgcctcctacaatgagtaagacatgattccctctgactttaggaggctcacgcatatgtgatttccaatataaggtgacaggtgccagaacacaaacatgggcgaaggcacagaaggccgctcctgtgcagtggtctgtcttggctcttttgcttcatgct

SEQ ID NO: 399861 - DNA, 474 bp, Homo sapiens
cggtttatgtgttggatttgtcaggtgtccttcagcgttatttggtgaaggtgggcaaattaaatttgcctttttcaatatcctctgaatttttaatgagctgctatatgtcttgtcactttttctgcccatagctattgttttcagcataactgtgttctgtaattcttttttctctgcaatagtaatttatttattttacttttcaagatggcttccatttgtgttatgcaagttttagattttgtacaatatagagtgtataagacaccttttttttttttttaaactgaagagctatggaatctagtatacccagtgatatagctatgacacatttatctaagaaggaatatgttaccacaaagacagtttctttcttttggagaaattttcaaatgcatcagtgctttaaaaaaatcaccattttggtatccatatgtgagggtgagtgattttttcagagagaaaaaa

SEQ ID NO: 399862 - DNA, 390 bp, Homo sapiens
tcagcctcccttgctgctcaggatgaaatatgtagagctggagaagagacatggttagtccttacgtcctgccttaaatgatgatgtgatggccattatctggatccttcatggaatttcggcagttccaacgtgtcaggccagtgtctgggattctctcagcctttcgctttttcccctgggagtcggacagctgctgcagctcagtcagaccaaacctctctgaataccaccaagaatcgggatcttgttctgttgtccaggctggagtgcagtggtacaatcacagctcactgcagccttaacctcctgggctcaagacatcctcccacgtctgcctctcgagtagctcggaccacaggtacatgccaccacccccagctaattaaa

SEQ ID NO: 399863 - DNA, 1474 bp, Homo sapiens
ttcatattttaaccagtttagccagagtttttagtactagtattaacttttgaattatgtttaaggtcttagactttacagcatgtttagtttattttcatttcttattagtatttttcagtacttaatagtctcttgcccccacctccaacaagaactttcctctctgttcaacatcagaaacattttccttttggcatgtgctttctagttccccaaacagtataagcaaattggaaagtttagctgtcattcttggaaggttacagatcacactagcagcctgagtaatccaagaggttttaagtatcatagcatttagtttaaagtgaaatttgctctgacagggctggcagaccaataggaaaaagaaatatttgtgcttggagaagtgcatatgtagagaccaaaagtataactgatggctggaagtgatttcagtctaaaaaaacaaatcattaagagagtgcataggggtaaaatacacagttcatattttaaagagtctcaaaatgaaccagcaactaaggttagcattacatagtaattagttgtggtgttcaggctttaactcactcagtaccagacagtatagttaaactgtcgctgaaaaaacattgctacttacatgatattctctagtttaaacctatagcagtaatttttgtaccttaaaaaaccaaggtattatgacagattatataaatgttgaaccagtaacagacaaacaattatttaaaggacgtgctaatgactcagtttattgacctaggggttatttaagccgctcagcaagttcccttaacatttggtggtatgaaatgaagcattgcttgatagtatagaactgccagtttcaagaagtccttgtacttaatggaagaaatgtaagttaaagatgactagatggcataccttcattaaaatattgccagaaaaagccaaagacctttataggtttgagtaaatattcatttcaacttgataatcacatctgacaacttccattaggtacctattagagcattttttctgttaataactacaaataaggaaaaataaaatatattttaatggctccagttatttcttgcacgtcatttttctcttcaagaaagcctattatgagccagaggaatctaaaatttatatttttttccttgaatatgcagataaataataataaaatgggtcagacacggtggcttacgcctgtaatctcagcattttgggaggctgaggcaggcggatcacctgagttcaggagttcgagactagcctggacaacgtggcaaaaccccatctctactaaaaatacaaaaattagccaggcattgtggcacgggcctgtaatcccagctacttgggaggctaaggcaggagagtcacttgaacccaggaggtggaggttgcagtgagccaggattgcaccattgcactctagcctgggcaagaagagtgaaactccacctcg

SEQ ID NO: 399864 - DNA, 775 bp, Homo sapiens
tgtaatcctagctacttaggaggctgaggtgggaggactgcttgcacccaggaattccaggccagagtgagcagcatagcaaaaccctgtctcaatttaaaaaaaaagaaaagaaaaaagcatcaggatatcatgtaaggacacggagccttacatgttctttctgagattgaaagccactaaaggctctaagcagaggagtagaagagtgacatatatgaattcaactttaaatgaatcattataggtgcccccttgtcaagaaggggttgtagaggacaagaaagaaagcaaggaggccagctaagaacttacaataatccaggcaacatgatggtgtcatggaccaggctggtagcagcggagataatgagaagcagggaaattctggaggttaatccaaaagaatctgctaatgtgagataccagtgaaggaggcatcaaggatacctccaagatttttagtcttcttaacaaatatctgagtatctactatggtccaggctctgtactacagttcacatctttccatttaattcaatcaattttttcaaagtaggggttatcagcccctatctaaaagagaagttcagagagactttaaaactagcctttaggccgggcatggtggctcacacctgtaatcccagcactgtgggaggccaaggcaggtggatcccttgaggtcaggagtttgagaccagactggccaacatggtgaaaccccgtctctactaacaatacaaaaattagctgggtgtggttgcgcctgcat

SEQ ID NO: 399865 - DNA, 1315 bp, Homo sapiens
  misc_feature (994)..(994): n is a, c, g, or t
aaacagctaccattttaatgttttggtactgggaaatgtgttagttgaaaatttcacttacgagtaatccttttatttctctatggtaacaagacaggtaaggcatatcagttggcccagactcattggtcctcaatgactgactgccggactcagagttgagggtctgatctcagaggacgcaggttgtgttgccagcccagatacctatgacaccctttcctagcaagtggacgctgttttctgaaatatctgtcactaccttgaggcaatcctcattattttaatctttattcttaggctaatgtcttgagccatgtatcagagagagacaggcaggttgttgatttttgagatgaagaacaactatctggccagggagagaaagagaaaatcggcttataagttagaatggtacagagtgctctgccttctcagattattttgtttccaagaatcactgattatatagcttttttttttaagtttaagcccatacccattctgcatatttcagagtgaaatgtcctttcgggacaatcttattaaatcactaatctgaaattttatgttccctagttggccatgccagtattttggttagggttttaggtgatttttatatccactgtaaacttggatataacttaccattaaccagatacttaaaaccagggtattttcctaaggtttaacattggaagtggtatgtgagctgagccttgaagggtgacaccaagttttttgacacgaaaaggttggatgagctagctaaagggcttgttttttatcctgtagggcaggagtggttgtagatgccctctcatgtgctgacatactgattgatggtggcttctaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagtnaaggattctgatcttatgtgagaccattttcagactgtcctagtctgccctcacatatccctggaatggacacatacaggctggtcagggctttcttggggcactgaggtgggagaagctggaggcctgggcagggtagtggaactgagagtgagaagccccctacacttggatctcttgcgtatcacacgagactcatttattgatgactgcctagctggctcataatactgatggctgaatgggggtatgaaaactggtcctcaagagtatccagtcttattggaggaataatgcaaaaacaaacaaacaaaaaaggat

SEQ ID NO: 399866 - DNA, 297 bp, Homo sapiens
gcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccacccaatgtttagcaagcctggggatgtgccacgtcccccagggatccagcacgcacccaaggagacactgtcccggcgaggagcctggagcctgggaaatacaag

SEQ ID NO: 399867 - DNA, 428 bp, Homo sapiens
ctccattcttctggattttgtacgttctctgtcctctaagttgcatgtcctctcctcaatcattctcaattaatagccttgtttagaaaattgaagcaatgagagaaaaaattccacagaatctcagcatcacccacacccacataccagcctctactttgccttccccaccctcacatggttgaattgccgtgctcctagctaaaggagtattgtcaccaagacatagattccagtactatcttgcctaatcaagatcctcactgtcactccagcaattatccgcctattctgttttatcagtatttctctactgggtcattctgataagcttacaagcagctgtgatttttccaatcctacagattcttctctttgacctatttctactgtcagctatcacctatttctctactccctttacaaca

SEQ ID NO: 399868 - DNA, 542 bp, Homo sapiens
aggatgaagatagtagagctgcaaatggagagggcgaagagacacacataaatgtttattcagagatgtatctctgaaaaatgctgtgaatcaaaggataggcctaataaattttagggctatacttattaggaatactttagagaataataataataaggtatagaagtactatctaataggcttataaatagataatttagtttataagtagctaaaacattcaaatacatttgtaaaaaccaagtaaaattcaagagtcttggccaggtgtagtggctcacacctgtaatcccaacactttggaaagccaggacaggaggacagtctgaagtctggagttactcgcctggccaacatggtgaaaccccatctctactaaaaatacaaaaaattagctgggcatggtggcacccacccgtagtcccagctacttgggaggctgaggcaggagaatcgcttgaaccccagaggtggaggctgcagtgagccgagatcatgccactgtactccagtgtggtgacagaacaagactccgtctc

SEQ ID NO: 399869 - DNA, 551 bp, Homo sapiens
  misc_feature (2)..(2): n is a, c, g, or t
  misc_feature (36)..(36): n is a, c, g, or t
gntcgacgcagtgtttgcctttctatgtctggcctntttcatttaacgtaagaatctccaattccacacgtgttgctgcaaatgacagggtttcattcttttttacgggtgagtagtattccattgcgtgtaggtaccacattctctagattccttcgtccgtgttggacaccgaggttgattccatgttttggctgtggtgaacagtgtggtgataaacgtgggggtgcaggtgcttcctcttgttataaagacccttgccattgagtttaggcccaccctaatcatccaggatgatctggtctggggattctttttttgttggagacggagctgagactctgtcaccaggctggagttgcagtgagcctacattgcgccatggcactccagcctgggcaacaagagtgaaactctatctcaaaaaaaaaaaaataaaaagaactctggattctgcctgtcaataagaaagcaagtaaaaagtgtcacagatgtgtgaaattggtccttgtttataccggagtttaccatgagaatgaagagttcatctc

SEQ ID NO: 399870 - DNA, 402 bp, Homo sapiens
ctcaaactatctttgggtaggactgacccctttcccagctattgagctggagccttattagtttaacctactcaacatatcccactccctagctatagtgattaagtgtgaacacggaacccaattaaaaccagagaaatcctagcactttgggaggccaaggtgggtggatcacttgaggtcaggagttcaaggccaccctggccaacacagtgaaacctcgtctctactaaaaatacaaaaaaatttagccagacatggtggcaggcacctgtaatcccagctactggggaggctgaggcaggagaatctcttgaacccaggaggtgaaggttgcagtgagctgagatcacaccgctgcactccagcctggatgacagagtgagactctgtctcaaaaaa

SEQ ID NO: 399871 - DNA, 463 bp, Homo sapiens
ttgagacattgtctcatcttgctctgtcacccaggctggagtacagtggcgtgatctcggctcactgaaacctctgcctcctgggttcaagagattctcctgcctcagcccgcagagtagctgaggtgggaggatccttgagcctgagatgttgaggctgcagtaagccttgactgtgccagtgctctccagcctgggtgacacagcaagacttgtcacttaaaaaaaaaaaaagaaaaaaaaagttttacaactaaaacacacctttttcttggacttaggctggttcagcatgtacagcattttgctcaagtcaaatgatgacctgatgagactgagccactccatgtcagagctggtataatccaactacctcacttaagggatgcagcaattatgagcagagacattttctctagagcagtggttggttcttcatgggggtgttactgccctgtagggg

SEQ ID NO: 399872 - DNA, 2313 bp, Homo sapiens
  misc_feature (321)..(321): n is a, c, g, or t
ttttggacttttttgctgtggactgcaccaaaaatgtagacagtcagttgattgaatgatacaatttttaaaaggtaaaagctttataaagccttataaataagttaaggctataggcctactgtcttcacttttgagaaatagagtttgtggatggacgtacttatactgttgcattaggggctcgtaggccaagattggtttctgcaggaaactcaattttgtttgtcccaagttaaagataaatctcatgtgatttaaaatgttttgagatgttgcacttaggctgggaaagagtaaagattacagaaaaccaacttntagatgttttttagcattttccttttttaaaaattataccaaatatgtaatatatttgcttccacttagatatatctaagtttattaagatggtttggggaaaaatttgtgtatttaccaattgttcacatagaaacaatcttaaataaataacttgatttttaagtgttatgcctgggaggaaggctggcatagctggaattcattagttaatacagaaaaccaggatgttaactgctgtattttcattgtcatgcagagcctaaaagtagactttaatttgtgttataaaataaactgaagacttgagaaggcaggaagcctgggtggccaccccacacatttactcctgtattgttagggtgatccttcattgttacaatcattttctttttatagcatagttaagaacaaaggcttgggagccagaatgcctcagtttgaatcccagccctgtgatcttagacaagttatttaacctcactgtatcacagttttctcatgtgcaaaatggacatgagtccgttttgtacctgctttacagagttttgtgaggattaggtgaattaaaccacgtggaacagtgcctagcacagagaaaacattatgcaagtgttagttgttattgttttcattcccatttattttccatttaattgctttaatcttaaagactgggacagagaaagcactatacaagtgttagctattattattttcatttccacttattttgcattttgttactttaatcttacgaaagagtaatatgtttctactttgtatgcatgtttgtgtgtgcacgtgaataagtgaaaataaaaaaaatttttcctgtttgaataggacaataccatttgaggggttatttacaatcctaaattcttagaactgcctttgagtcatgccttttctttatttccatatttggttacttgcaggtcatgtcagtgattagtttcacttagacatctttcccctgctatatttgagatcctcaagatcgggttcattgattcactagaaagattgacacattatagtcatacgcatggctgtgatttatcatagccaaaagacgcaaaacaaaatcagcacatggggtgaaatccagaggaaaccagacacaaggcttccaagagtcctcttcctgtggagtcacaggacaggctaattcagattgaattaagacaacatgtgtgaaatattgtttatcagggaagctccttagagactttattcagtgttagaggctggtcatgtaggtgcccttggctaatgttccaaaattccaaactctcagaaggaaggtaggtggtcaacataaaccacatattttatacaggcatgaagcacagtgagccattcttaggagttagggaatggtgaggtcccctctggataaacaaggtcccagacacctgccaagggccaaccttgcaagcaagactttctaaggacagcagcagcaggcctgctgtgggaactcttttctgcccacctgcccataattaccctagtgtttgtcctcatcatcttttaaacctcatttttcaaagcctattaactggcttccctgagttccagcatactgtacttggatctgtcccactaatctcctatctttaactaggcttttattgtgtctttttcctgctcatgacctttcattagctccttatttaatcatgtctgtaaaaggactttgggggccgggcgcagtggctcatgcctgtaatcacagaacatggggaagctgaggcaggcagattgcttgaggccaggagttagagaccagcctggccaacatagtcaaactctgtctctactaaaaatacaaaaattagccaggtgtaggggctcatgcctgtaatcctcccaagaagctgggctgaggcacgagaattgcttgaacccaaggggcataggttgcagtgagccaagatcatgctgctgccctccagcttgggcaataaagcaagactctgtccc

SEQ ID NO: 399873 - DNA, 381 bp, Homo sapiens
tctacatgttatgcatgtgcctagtgagcattctctgagggttgagaaacatttcccaactatcctgtacaattctctacatgtgaattatcatgtaatccctttgaactacatatcatgcacagaatttatgatttcaagttctatcctgtgctatttaatttctaagctgaacacatatttaacagaaggcaagaaagaagatgaaatgtggttcacacatttttcatcataatccatttatataagataacttggaaaagaatctgtaagtcatttttattagtctgtcaaagaaatggctgctaataaaactgccgaatcaaatcattaccagtactgtgcattgacccttggcataggtagaactttctttccatc

SEQ ID NO: 399874 - DNA, 866 bp, Homo sapiens
tgattggaatatgtaattgctacaggggtgttttcatccttctaccttcatatcccagaggaactacaggctctcctaatccaaagttaaggtcatttggaggttccctctcctactgtgcccacactaggcgctcttggcccagttacccctaactcaggggttattgtcagctctccttctctgtgaccggcccacatctgagtgagtctggttcgttacccctaaatctctctcaaattattcatccatcctcattacggttgctccctcactctcctgtcttggccagtactagcctctgactgttctctctcagtctctttcacctgctgtcctctctgccccaggcgtgttgctaaaatagaaatgatcatgtgtgtcctctggttcggccttgcactctggacagagaccaatcttcagtgcttcctagtctgtgtccctcagaaatgcccctgaaacataatgtatttttttcttcagtgcttttgcacatgtttgttactgtctggaatgttcttctctcagcttcttcccctcccacaccaaatggccacctctctaaccgcccttcattccttgaaactcagtattgccacttctacagtaacctttgaagcctctccctttgtctgatgcacttctgcccttttttttttctttctttctttttgctcttaaactcactgtattgtcatttatttgtttaaagactgtcttcagtggaccaggagctccttgaagacacatcatttgtcttacacgttctatgttgtagtatctagtatggagtctgaggaagtgctcaagtgtgctgaatggctaagaaatttgaaaacggtgcataattagctttaattaaa

SEQ ID NO: 399875 - DNA, 827 bp, Homo sapiens
acacaccaccatacgcacatgtcaccaccacacacacaccacataccatacacacacaacataccacacacacagcaccacacataccacacacatacctgcacacatactacacacaccacatacacatcacaccacatatactacacacacaaacataccacatactacacacatcacacacacacgactagcccaaccatacgcacatgtcaccaccacacacacacacacacacacacaccacacacacacacacaggttcctcaccataagctttggggaaaattcttggcttttttgctgggggagagagcagtgcccagggaagattggctgatctcagagctggagggtttatgcgggactggccagccccttcagctgagtgggacagcaacacagtgggtggtaaggggcttcataagatgtacaagatgagggagaggcccctccagccaaccctgtgtctaaagagtcaggtaacgaagaactttccagagacagctgtgagtccgtctggcttaaggggttgtacaggtgtctgagaatggggcctgaaggtgcagggcctgcaggctgccctgtttggaaggttcctgtccttctgtcttggtagaaaatggcagctagccttgtaaagggcctccttgtgtagcgagatagaccatgtagccccagatgcccccatggcttcacttccctcttgggggtctctcagtatatgtctagtgccaccactattggtggagagtttccttctggaataaccttggggtggtggatgggttttattttaataaaagaagaatgtctcattcaaaaat

SEQ ID NO: 399876 - DNA, 629 bp, Homo sapiens
  misc_feature (626)..(627): n is a, c, g, or t
  misc_feature (629)..(629): n is a, c, g, or t
caggtctggttgggttgagcaaaagaatgaaattaggcgtttagaaactagaccaggagctgaagacaggaagcagtcaaaaactctccatgagtgaagaggtagcacttttttgatccaggcatgaaaggagtattaataggaatggggaagttggaacgtgtttccctccatattcctcacgtctattttagcttttccttccatttgtttcttactctttttctttctaacattctctgctagtgtttgaagagcagttgtgagggaacttaaatgatattccccttttccttttccctaataaccttcctgccagattttcaagtaggcaatgataacagcaggtgagatattaggaactgtgactacgaagtatgtagatggagatgtgcagaaggatccagagacttagagcaatgcttcacatgcttttggtaagcatgctccctactgtgggtaaaccaaacatgtaccaacccccccagaattatgatattctactgcagtaaccagcctcttcttttaacatcagatagctaaaggacgttatcctcaaagtcatggaaaagcaggaagtttttcatgacaaatcagtttgccatagtacagttaaaaaaaaaaanntn

SEQ ID NO: 399877 - DNA, 482 bp, Homo sapiens
agctctgtggtggacagagatctcaggctgcccagattcagggggtagtaagtagccagtcagttcccattgatcacagctctttaaggatgctgcgcttatgtttccaagtctatctacttttcagattttcatgtgaaatctcttgtatcgaaatattcagtcaaatgtgtaaagaaccattcaaatgtataaagaggccaggcgcggtggctgacaccgtaatccaaacactttgggaggccaaggtgggtggatcacatgaggctaggagttcaagaccagcccagccaacatggcaaaaccccatctctactaaaaatacaaaagaattcgccaggcatggtggcacacacctgtaatcccagccactcgggaggctgaggcatgagaatcacttgaacccgggaggcagaagttgcagtaagttgagatcatgccactgcactccagcctgggtgatggagtgagactatgtctca

SEQ ID NO: 399878 - DNA, 388 bp, Homo sapiens
tagtgattgacatggcattaaactccagatctgtttctagagccagtatgctacattgccttggaaaatatatcctgtatgcacagatattacccaaacatttcttctaatgttacgaataagtaaaatgtaaataaaatgttgattaggactggtgaggactgattaacaagaactaaaaaatgaaaattaggaatattgggagatataccaaatgagctacaatataccaatttacgttgcaagagtattaactgatgtattttacttgctggaatgagttgataaaccatttactactggctggcagtttcaggttaggagaagtatatgattttggtcactcaatttcttatctagtctttacctctgagatttgaaaaaaaaa

SEQ ID NO: 399879 - DNA, 368 bp, Homo sapiens
atatttcatagtatggacataccatgtttcatatatccattcatcagttgatgaacatttgaattgtttctactttggggccattatgaacaatgctactagggacttttgtgggtgtatgttttcattattttattgggtgtttacttaggagtgcagttgctggatcttatggcaactctataacttaacattttgaagaagtgtcaaaaggttttccaaagtcactctaccattttatattcccagctccctccacgggtttcatctctgttttctttctttaaacaaggaattggcaaactatggcccatgggccaaatccagcacactgtctgttcttatgaataaagttttattggaatgga

SEQ ID NO: 399880 - DNA, 511 bp, Homo sapiens
aggaaatggagcgagaatcaagaggaagtttggcagaatgagatgctgagttccccttggggagtaagctccttaatggcaggagtcttatcttctgctcactgttgtggctccccacacctatgggatactcagatgaatattcactgaggatttttatttttatttttatttttctgagatggagtctcactctgtcacccaggctggagtgcagtggtgcaatctcagctcactacaacctccaccttctgggttcaagcaaatctcatgcctcagaaaaaaaaaaaaaaaaaaaaaaaagcctaattagtgcttgatgatgtttagtgtaaagctgtgcttctcaacagggaacgaggcaattattccccccagtacaggagacgcttgtcaatatctgaagacatttttggtggtcacacttcaggggtgctattggcacataatgaatagaagctgaggatgttgctttccaccctacgctgcacaggacagctttctaccaaaa

SEQ ID NO: 399881 - DNA, 608 bp, Homo sapiens
atttcggactcctccaggttccatgatcgtatggaacagggcagtctgttccctaatgctggaggagtagagcttggagagatttgctgctgaactcgctgcgctaaccagacacgtaatcacagtggcttcagagggactcgcacaacaatttccattagctacggacaagcattccaaactttagcctttaggtttaatcattgacacaccttccctggtcactgagtctcctctagaaactcagtataaacatccaacgatgtgttaacagggtgttttgtaattttcttttgaagattattctaggtggtgggcgtcacagggtcaataaaactatacatttctctcaaagactgcaatcctgatggcaaagctggaggaagctccgggaaacctgtaattgtgggaatccaagactcccctacagctgggctgtgcgaaggggcactacctaggagaagaaatcccctacagctgggctgtgggaaggagccctacctaggagaaatcccctacagctgacaggtgggctgtgggaaggggccctacctaggagaagaaatcaaatcccctacagctgggctgtgcgaaggggcactacctag

SEQ ID NO: 399882 - DNA, 414 bp, Homo sapiens
caacacatgaacagattggcactggggtttgttaatgagcgtcttgtgatcagtgttggtgtgaacaagttttgaaacagtcactccatgaagcccaggcccctagccatccaatctgatcagtcagcctctggtgcaccaagtaaaacgtctgaggctgctgagtctccggagtgacttctggcctcagagaccctgggctgccagccaaagctcggggcagggaaacagtgaaagaggaggccatcgtcatctttctcatctcctgcccttgctcacctttagcagggccctgcactaactctgtgaccctgagctgacctctctgagccattatctggaagagggataacagaacaacctgacagctcccggacagtagtagatgctcaataaacgatgtgtattattaac

SEQ ID NO: 399883 - DNA, 398 bp, Homo sapiens
actgaaataagtaggattcaaacagagttggaaagaaaacctgtgctctgttcaatacattaagcccattgagctaaataactagtaagtgtttaataagtgtgtttcaaaagtaaaagaaaaagagtaagaatgagacagaagtgaagaaatccacctgggggaagtgtggagattaaagatgtgtagggtttggatgcatgaggaagcgaaaatgcagggcctggaaagagtcacaaagagtcccccaaacagcagagtacagaccagtctgatcaggaaagagacacagtgggaaacaaataagacctcacctggtagggtgaaatagtgagcagggagtgtacatcgcacctgataggaagaagaacggatcagtataaaagtgtggtttcagt

SEQ ID NO: 399884 - DNA, 619 bp, Homo sapiens
agggaagagttctatgacaaactcatagatgcagactaacatgtaataaaagttttaaatgcagaaagaaacctcaaactattattggaataggtaacaagaattacagttgaccagctgtattgaagatagacacacgtataggaacagtttggtaaatgaatcaggaatggtttttaaagtataagattttgcaaaatagtattatctatatagaatcttgtttaaatgggaacccacatatataaagcacctaacaaccatttattgagagactgccatgtgccaggcacagagacattaaggatacgagaccaaagaaaacatttttttggctgggtccagtagctcacacctgtaatcccagcactttgggaggccgaggcgggtggactgcttgaggtctggagttcaagaccagcctgaccaacatggcgacacgccatctctactaaaaaaatacaaaaaattagctgggcatggtggcacgtgcctgtaatcccagctactaaggaggccgaggcaggagaatcacttgaacctgggacgcagaggttgcagtgagctgagattgcgccattgctctccagcctgggagacagagcgagactccatctca

SEQ ID NO: 399885 - DNA, 446 bp, Homo sapiens
ataagatggtttcttaaatgcctcatatgcccctacttcttcctctttacatatagacacctttttcaggagtctaataaggataaaaaggcttaggccatgacctaatgctttggtaggaagatccagggctgggatgataccactggtgctcaaggcattgctggttgacacctcgtgatccaggatgacttcttgatttctcaggacctctatgaattttattttagtgttcattctagagataatataaacccctaatttatcactgtataccttgaattaatatatcatttcacttatgaagtaagagtcttacagcaatgtttcaatttacacttctatttcttgtgctgtcatatattttattgctataaattataaaccctatgtaatgttattatttttgccttccaagagccaactgacttttaaagaattttttt

SEQ ID NO: 399886 - DNA, 986 bp, Homo sapiens
  misc_feature (122)..(123): n is a, c, g, or t
  misc_feature (368)..(368): n is a, c, g, or t
ttcccaagtttaaattgaaggagagacgaaaacctttctgctttctgtccgttaaagagctcctcatctgatcttgcagctagaccctttgagacttaagagctgcataccaggatcagaanncagggctaatggggtaggacaatattcccagcccctaagctctgtagataatgcataagaagcaccaagtcaggctcagatgcaactaaaacacatcttgagccttttctttttcccttctcccctttctaaacaaaaaccttcctaggatggcatctttgctctaactgggagacagtcataattggttgtagtcaattctactaagcagtgtggggtggttggaaagtctcttttttgtaatntgtttttgcaaatcatgtgaggccactttttctttctttctttctttctttctttctttctttctttctttctttcgttctttcgttctttcgttctttctttctttctttctctttctttctttgctttccttctttcatctcttttttgtaatttgtagtgcaaactcatgtgaggccacttttctttccccttccttccttccttttttttctgttttgtattatttttattttttccccagaggtctggctcgggcccccaggtgggaggtgcacggggcccgaacccgcgggcatcacgggcatccccattcgtgtcaccttggggatccaaagcgaaaccaaccggacatcaagacactccacaaagtaaagcctggggacaataacaagggccaatacagccacaaacgcccacaatacaaaatgacaggataattaatgaggcagcgcgcgggggatcacacccaaagaaggccaggcatagggattgcagaaaccccgtgaagcaccaagataaacgtggcaaccacggcctcccaacaggtgatctgctaacacggatggtagcccgcgggacgagacccacttattactccctacatatagggaaca

SEQ ID NO: 399887 - DNA, 937 bp, Homo sapiens
  misc_feature (73)..(74): n is a, c, g, or t
  misc_feature (319)..(319): n is a, c, g, or t
cagacccaccaccacccccccacaacatcgcaggacgagcctgcgctgaatcggacgaggacaggatcagaanncagggctaatggggtaggacaatattcccagcccctaagctctgtagataatgcataagaagcaccaagtcaggctcagatgcaactaaaacacatcttgagccttttctttttcccttctcccctttctaaacaaaaaccttcctaggatggcatctttgctctaactgggagacagtcataattggttgtagtcaattctactaagcagtgtggggtggttggaaagtctcttttttgtaatntgtttttgcaaatcatgtgaggccactttttctttctttctttctttctttctttctttctttctttctttctttcgttctttcgttctttcgttctttctttctttctttctctttctttctttgctttccttctttcatctcttttttgtaatttgtagtgcaaactcatgtgaggccacttttctttccccttccttccttccttttttttctgttttgtattatttttattttttccccagaggtctggctcgggcccccaggtgggaggtgcacggggcccgaacccgcgggcatcacgggcatccccattcgtgtcaccttggggatccaaagcgaaaccaaccggacatcaagacactccacaaagtaaagcctggggacaataacaagggccaatacagccacaaacgcccacaatacaaaatgacaggataattaatgaggcagcgcgcgggggatcacacccaaagaaggccaggcatagggattgcagaaaccccgtgaagcaccaagataaacgtggcaaccacggcctcccaacaggtgatctgctaacacggatggtagcccgcgggacgagacccacttattactccctacatatagggaaca

SEQ ID NO: 399888 - DNA, 410 bp, Homo sapiens
aatgtgaaggaagtgtctaattgtgagaactggcatgcccccagtctcccgattttgctcaatttggtggcgatgatgtcagccgggggtgtcgttttgcagagatgtgctgtctacccattcttcagtggtgattataataccgtttggtccaattatcacttatgattacataacgtgttttgattgaagagtttctgagaaaataaaggtaccctgtcttcccctgcacacaaaaagaacccccgcaagccattcgagcaggcaggctgacctaccaagaaacactgggaattattaggctaaattatgagttgaacttgatttggaaacaaagtatccattgtacataactccccacgacatccaggaagatgtcattgtttttctgacagcaagtttctccccag

SEQ ID NO: 399889 - DNA, 444 bp, Homo sapiens
agtccctaccccaggtttcctagacatggggaatgcattctgaggacaggtggagaagcctacggtaggatggggtcctcgtaggtgagcaggaaacggctaagagcagaggagttctgcttgcgccagtcacaagccgcgcaggcgcccctggtcgttcgcttttgataactagcacataaagaactagaaataatgaatgattgctttcttaaccattactttcaggcccgcattgttttagtgcacgtgaaaggctcttcccctacactcaatatgtctttttctactttttgaccgaaaagaaaaattgctgcctaaacacgtttaatgccattaattaagaaaaggcatgtaatgggaagaaatgctgaaaatcttgatttaattggcttttaaggaactagtagacgacaaaaaaaaatcacacgagtgggcaaagct

SEQ ID NO: 399890 - DNA, 584 bp, Homo sapiens
  misc_feature (34)..(34): n is a, c, g, or t
ccagcccacttcagctatcttgtcccacataaanggggaagtggaagaaacctgagaagcaggcatgaagttcacagtccagagaccttgccatcgtatccccttttggagacacaagccaggaaggaagctcttcagtgcagctgtgaatagagaaatgctggctgaggttttggagacactgggtgatcattcccagtgaaatttttagatccctggggacatgagctgctttgtcttttccaaggtcaggataaacagaataacttcaggcttctctacccagaaagaacatgtggcataaatatcaactgcagaataaatatgattaatctggtacatggacgaagatgttttctaggagatgcttatcctgggatgagagctttcataagcattgatatttacatgactcttaccgtgtgtcaggaactgttctaattgttttacctatgtcaattcatttgatagtcacaaccactgaaaggagtaagtactcttattacttccattttacagatagggaaactgaggtatagagaagtcaagtgacttgcccgaggttattaaactacttaatgtca

SEQ ID NO: 399891 - DNA, 734 bp, Homo sapiens
gtaggagtacggcacgagcgactctgaagttgcactgacctgtccagccctgtcacttaccaggttgtggtctgccctcaggggaagctgtctaaccagagcctaacccactagggttttatcagaacttaactgacctgaggaaaagaaatactcaactccagcaagctccagccttccaaatggaggaggagaaaaaacctgagaagcaggcatgaagttcacagtccagagaccttgccatcgtatccccttttggagacacaagccaggaaggaagctcttcagtgcagctgtgaatagagaaatgctggctgaggttttggagacactgggtgatcattcccagtgaaatttttagatccctggggacatgagctgctttgtcttttccaaggtcaggataaacagaataacttcaggcttctctacccagaaagaacatgtggcataaatatcaactgcagaataaatatgattaatctggtacatggacgaagatgttttctaggagatgcttatcctgggatgagagctttcataagcattgatatttacatgactcttaccgtgtgtcaggaactgttctaattgttttacctatgtcaattcatttgatagtcacaaccactgaaaggagtaagtactcttattacttccattttacagatagggaaactgaggtatagagaagtcaagtgacttgcccgaggttattaaactacttaatgtca

SEQ ID NO: 399892 - DNA, 1653 bp, Homo sapiens
ttctgggatggggccctcaggaagctatgagcatttccaggaagagctggcacatttctttgatggcctagtggtttttatatttttctgcctgaagttcaccactttctacccatgtactcctctcctgttttcatgaccctccttatttcaggaccacttgaaacccttcatttctgcccaacttctggatgttcttccctatactctattagacctccaaacagcttgagaaggagatattattgcacaatgtttaagagccctggcttctgagttggactggcttggatttgtagtagttctattacctactaactacctaatagtaggtaatagaactacctaatagtagttctattacctactaactttgaggctttgggctgattacttaatttcttggtacctgatttttcatacctgtaaactggtagaaattatgataacatctacttcataggatggttatcatgattaaaaatgccagggatttcttgtttctagtttgacgtagaagcagcttgaaggtccccactccatcataaaaacaagtaaatatctgaagaaatggtaaaaaaaaaaaaaaaaaaaaatcaacacttcttcttagatacataagagaaggaagatcacaagggaaactactgcccccagaattggagggacagataggcagataaagagaatcacaacttgctggagcagaaacctatgggctgaaacatccattggaaccagtgccagggtaggaaaacctgaactatacattgatttatttctggaggctcagtgtcaacaagtcagagataaatctcccagaggatccagaagtagggagtaccatacttttatgggttttacctctggaagctctaatacattcttacattgaatatctgagaaaaatttcctcacgctttggcaagaggagaaaaaaaggaagcattttgaaatagagcaatgcattcttttttttttaaacagggtctgccctcaggggaagctgtctaaccagagcctaacccactagggttttatcagaacttaactgacctgaggaaaagaaatactcaactccagcaagctccagccttccaaatggaggaggagaaaaaacctgagaagcaggcatgaagttcacagtccagagaccttgccatcgtatccccttttggagacacaagccaggaaggaagctcttcagtgcagctgtgaatagagaaatgctggctgaggttttggagacactgggtgatcattcccagtgaaatttttagatccctggggacatgagctgctttgtcttttccaaggtcaggataaacagaataacttcaggcttctctacccagaaagaacatgtggcataaatatcaactgcagaataaatatgattaatctggtacatggacgaagatgttttctaggagatgcttatcctgggatgagagctttcataagcattgatatttacatgactcttaccgtgtgtcaggaactgttctaattgttttacctatgtcaattcatttgatagtcacaaccactgaaaggagtaagtactcttattacttccattttacagatagggaaactgaggtatagagaagtcaagtgacttgcccgaggttattaaactacttaatgtca

SEQ ID NO: 399893 - DNA, 1600 bp, Homo sapiens
ttctgggatggggccctcaggaagctatgagcatttccaggaagagctggcacatttctttgatggcctagtggtttttatatttttctgcctgaagttcaccactttctacccatgtactcctctcctgttttcatgaccctccttatttcaggaccacttgaaacccttcatttctgcccaacttctggatgttcttccctatactctattagacctccaaacagcttgagaaggagatattattgcacaatgtttaagagccctggcttctgagttggactggcttggatttgtagtagttctattacctactaactttgaggctttgggctgattacttaatttcttggtacctgatttttcatacctgtaaactggtagaaattatgataacatctacttcataggatggttatcatgattaaaaatgccagggatttcttgtttctagtttgacgtagaagcagcttgaaggtccccactccatcataaaaacaagtaaatatctgaagaaatggtaaaaaaaaaaaaaaaaaaaaatcaacacttcttcttagatacataagagaaggaagatcacaagggaaactactgcccccagaattggagggacagataggcagataaagagaatcacaacttgctggagcagaaacctatgggctgaaacatccattggaaccagtgccagggtaggaaaacctgaactatacattgatttatttctggaggctcagtgtcaacaagtcagagataaatctcccagaggatccagaagtagggagtaccatacttttatgggttttacctctggaagctctaatacattcttacattgaatatctgagaaaaatttcctcacgctttggcaagaggagaaaaaaaggaagcattttgaaatagagcaatgcattcttttttttttaaacagggtctgccctcaggggaagctgtctaaccagagcctaacccactagggttttatcagaacttaactgacctgaggaaaagaaatactcaactccagcaagctccagccttccaaatggaggaggagaaaaaacctgagaagcaggcatgaagttcacagtccagagaccttgccatcgtatccccttttggagacacaagccaggaaggaagctcttcagtgcagctgtgaatagagaaatgctggctgaggttttggagacactgggtgatcattcccagtgaaatttttagatccctggggacatgagctgctttgtcttttccaaggtcaggataaacagaataacttcaggcttctctacccagaaagaacatgtggcataaatatcaactgcagaataaatatgattaatctggtacatggacgaagatgttttctaggagatgcttatcctgggatgagagctttcataagcattgatatttacatgactcttaccgtgtgtcaggaactgttctaattgttttacctatgtcaattcatttgatagtcacaaccactgaaaggagtaagtactcttattacttccattttacagatagggaaactgaggtatagagaagtcaagtgacttgcccgaggttattaaactacttaatgtca

SEQ ID NO: 399894 - DNA, 176 bp, Homo sapiens
ggtagtatatgagccatcctcttcaagaagcctggaaaccctgcttccccacctacaggcatgcccctcaggactgtgaaagtggcagctttcctctccctgcctcagccatcacttcagagcaggctactgctgctgcctcccagaggggcttgcagcctccagctcttgctcct

SEQ ID NO: 399895 - DNA, 746 bp, Homo sapiens
acaaatcatagattaggccactaacataaagaaatgaggtaaattccctgcagtcttcttgtggggccatgtaacagtagagaccacttgagtttgccaagtttggtggccaagtcccatgttttgtctgagaacagacagaggctcagggatattgggatgatatttggtatgaagggtttcttatttggactgcaccaagttaactgtgtgctgtgaaacattatatggcttcattttcattgggagaactagtgatataaatgatgtaacgtgaactaagtgatttagctaattacacatatttttggatgcttctaaaaaactaatatgtgatccttggagtagaggaagttgtacattcaaggttttctaccctttttgtgtgtgtttattttaatgaggacaatgggaactacaccatttctttcctgttagttcatcctggattacctttttatatccattaaacatagaaattctgaagccatgtctgcctacatgtcatcctgattgcctttgtgtataattgcagatcaaatgtagaagcagtgactacttaaaaaaaaagttgttatagaccaaggcttgaggaaagagaaaggtacagtgacaatgagatatcttgggggaaatttggtcccgtagaccaggggttagcaaatcatatcctgtgggccaaaccacagtcacctgcctgttttggtaggcctataagctaggaatggtttttacatttttttaaa

SEQ ID NO: 399896 - DNA, 402 bp, Homo sapiens
tattcagagaaaacttaagccactaagttttatggtgttttgttctgtagcagaagcataggcatactgacaatacaaaccgaaatccttctaacgtagtggaccttttcaggccagcattttttccttgaaaacctggagcatgtatccatcttatagcagagatcactttcacaatgtttgggctcttgatttgaattgatgatgtaatgagccctctatccagattgtaactaattactctgcgaattgactggattccacacccttctaatattttacttttcctcttttatcaactctcattctcgctgccatgatcaatggaccaactatgcttataaccacaaattttgatatgcttaaacaaatgaacaaatatatttaataatttcttttttt

SEQ ID NO: 399897 - DNA, 484 bp, Homo sapiens
gcttaaccccggcctcagcgactttgagcttcttattctggtgagtcttgacgtgcttcgcgaggtggtcgctgcgcatgaagcgcttgccgcactcgggacaggcaaagcgcttctcgcccgtgtgagtccgcaggtgccgctgcagctcgtccgagcgcgtgaagctcttcccgcagaagagccagttgcacacgaagggtcgctcgcccgtgtgccagcgcaggtgcgccttcaggtgcgacgtcttcccgtacaccttgccgcagcccggcacgtggcacacgtgctgcttcttcttccccggctccgcctcgggggcgccgcccgccgcctggcagttgggacagcggcagcggcggcacctcctggccgtggccgccaggggggccttggtctgcagcagcgcggcgatctggctctggtactgcgcaaagtccgacgggcccaacaccaggcctctttgtagggcggcggcggccgc

SEQ ID NO: 399898 - DNA, 316 bp, Homo sapiens
ctatagacagataaaattacccacccaggcatggtggcatgcccctgtggtttcagctactcagaggctgaggcaggaggatcactcgagcccaggggttcaaggctgaagtgagctatgattgcaccagtgcactccagcctgcatgagacattgggaccttgtcccccacccccgaaaaaagaaaaattaatcaggtcagatgcgatggcttatgcctctaatcccagcactttgggaggccaacgcagtaggattgcttgagagttaaggagtttgaaaccagcctaggcaacataagactctgtctccacaa

SEQ ID NO: 399899 - DNA, 497 bp, Homo sapiens
atccataggtatgtttttaaaaattaaaacataaacatgcctttccttttagaaaaacagtatatatatagtatacaagtaaatacagtatacaagtaaattatctacatatacataaatgtatatgtatatgcaaaagagagagataaatttcacaattctaccactcaagataattgctatcaatatctaggtgtatatccttctagaacttttaaaatagacacgtttatatacattatttacaaaacacaatatctcattttaggctatgtttaaaacctgttgtcttttccatttaccaatttaggattattgtctttccatgagaagacgtgttgttgaagcttggaattccctactaactcattttcaaaggaatctgtgattgaggtaaatccagttttctagagagaaagaggaaatgtcttttgaagccatgcctgggaagtatgatcagcgaatgttactgcacagatttttttccatcacagctt

SEQ ID NO: 399900 - DNA, 353 bp, Homo sapiens
gcagacttacactgaaggaacttgaaagaatatacttcaggctgggtatggtgacacacacctgtaatcccagcattttgggaggtcaagccaggaagattgcttgaggccagttcaagaccagtctgcacaatacagtgagaccctagctctacaaaaataaataaataaattagccaaatgggtggtgtatacctgtagtcctagctactcaggaggctgaggcgggagaatcactagagcacaggagtttaagactgcagtgagccttgatcacaccactgtactccagcttggatgacaaagtacaaccctgtctctaaataaaagaaaaaaaaagcgtatacttcaga

SEQ ID NO: 399901 - DNA, 474 bp, Homo sapiens
cattaaattgtcaccttggatattctagaagactaaatatatcctttagggggaaaaagtgtgattgtaccaaagttttaagcatggagtgtatgggatggtggaaggggaaggcacttggtatctgttggttggcagtgagtaggttgggagagttataatggagaacttagaataactttgatcatttcatgtttttttctgaggatatcagtagaatactaaatattaaaattcctaccatttctttttcctccagtctcaaagagagagggtggtaaaaacactataggtagggcaagcctattatttgctatctacacttatgcagtaaaaacaggtgtaatctgagtttgtcctgggcagaccagggatatgtggtcactcactatagaaatttccaaatcaaattttgagagatttttttttaaccaggacattattggtcattatattttacaaaaataattctgc

SEQ ID NO: 399902 - DNA, 236 bp, Homo sapiens
tccccatactcttgtttaaatatttgttgcctttttaatgtaattgctttccaattctgaaaacaataagtgaatgattagaaactgaagacttcatttaaaatatgtgaaatcggccaggcgtggttgctcacgcctgtaatcccagcactttgggaggccgaggcaggcggatcacttgaggtcaggagttcaagaccaacctggccaacatgacaaaaccccggctctactga

SEQ ID NO: 399903 - DNA, 964 bp, Homo sapiens
cttgaccaggctgatcctcaactcctgagctcagatgctcctgccttagcctcccaaagtgcttgaagtacaggcgttagccaccatgcataatggactaagacaacacccaaatggagatgttaggcaattgactacatgaagagagtttcggaggagaatgacagctaggaatatcaatttgagaattagtatataaatgctatttaaaaccatgggaacacttcatttttacagttagaaggtggaaagatgaatagaaactagtgaagactaagaataaaggatcatgagtgtagaataagacccagagatgtgaagtcccaaaagccaagtgaagaaagcagttcaagaaggaaggaagattgagttgataaaatgctgctgaaagttcaaataagataaggattggtaaataattattggacttggcaacatgaaggtaattagtgacctggaaaaaataatctctttatattgagggaataaaacctgaactgaagtggttttaagccagaagaaagagacaatgagtataggtaactcttgaggaattttgctgtagaagggttcagggacatggggcagtgactggaatacgacaggaagtcatgggaagaattttctaaggtgtaagaaatactataccaagttggtatggtgaggggatgattctcaacactggctaaataatagaactaactggggaatttattaaaggatagctgcatgagttcaatggcagactgattaaatcaaatctttgggaattggaccatggtatcagtatgtttgtttgttttacagttactcagatgattctaatatgcatccaaagttgatctgctttggagcagatcagtcaaattaactcgttatataagttaaacagtatatccaacacagttgaaaattaggaacaatagaaattacacagaatgcagcatagatatattaaaaatgg

SEQ ID NO: 399904 - DNA, 1021 bp, Homo sapiens
atcaagaggtcaagggacgaaatacaataaattaagtacaatggtagcaaaaatactgacattaaaaaatagaagttccaggccaggcacagtaggtcagacctgtgctcccaaagtgcttgaagtacaggcgttagccaccatgcataatggactaagacaacacccaaatggagatgttaggcaattgactacatgaagagagtttcggaggagaatgacagctaggaatatcaatttgagaattagtatataaatgctatttaaaaccatgggaacacttcatttttacagttagaaggtggaaagatgaatagaaactagtgaagactaagaataaaggatcatgagtgtagaataagacccagagatgtgaagtcccaaaagccaagtgaagaaagcagttcaagaaggaaggaagattgagttgataaaatgctgctgaaagttcaaataagataaggattggtaaataattattggacttggcaacatgaaggtaattagtgacctggaaaaaataatctctttatattgagggaataaaacctgaactgaagtggttttaagccagaagaaagagacaatgagtataggtaactcttgaggaattttgctgtagaagggttcagggacatggggcagtgactggaatacgacaggaagtcatgggaagaattttctaaggtgtaagaaatactataccaagttggtatggtgaggggatgattctcaacactggctaaataatagaactaactggggaatttattaaaggatagctgcatgagttcaatggcagactgattaaatcaaatctttgggaattggaccatggtatcagtatgtttgtttgttttacagttactcagatgattctaatatgcatccaaagttgatctgctttggagcagatcagtcaaattaactcgttatataagttaaacagtatatccaacacagttgaaaattaggaacaatagaaattacacagaatgcagcatagatatattaaaaatgg

SEQ ID NO: 399905 - DNA, 756 bp, Homo sapiens
gtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggccc

SEQ ID NO: 399906 - DNA, 232 bp, Homo sapiens
ttaagttttttatttataaaaagtttttataaaaatttattaatataatttaaaaattacaaccagttaaccatgtgtatgatattagtgtttatagtatttaaacaaataaggctgggcacagtggctcacaccatcccagcactttgggaggccaaggcgggtggatcatgaggtcaggggagggagaccatcctggctaacatggtgaaatacaaaaatacaaataaca

SEQ ID NO: 399907 - DNA, 158 bp, Homo sapiens
tctttactaatcattttggattttttctttaaattattgggcagggaagatacttatgtatggaagattactgctctaatttgagcaaaatagaagtttattagtgcgaggcaaacataaaaaaataagtaaataaataggtgaaggaggggaaaatc

SEQ ID NO: 399908 - DNA, 495 bp, Homo sapiens
tctaataactcatgtttcaaatattttaactattattttctatacagaaatactacatttttattgtaatcaatttagaaaacacagataaagaaaataaaaaccatacaggccacacaaataatgccaaatcctgccttataacacataaactgtgagccatttggtacccagaatactttatgttgagatggcagagaaagatacgatttttaaataaatattatagagactaaaatatgcatatatccggggagttcatagggtccccacccccaccatgttgtctcatggagataatgcacaaagaggcagaataggagataccaaaagtgagattggtttccatcaaggaagggcagagaagaagacgtagaaaaagattgagtcctggaaggcagaaaagggagactagcataggatgaatcatggggcaacttttccagggtcttgtaactgagactaaaaattaaagagtctgtttatactttcttt

SEQ ID NO: 399909 - DNA, 472 bp, Homo sapiens
attctaaaagggtacatgtgcaggtttgttaataatgtcatatctgcaccaatatatatgaatctgcatacaagcaaaggcaggtgtactttctgctgttagctgaaatagaggtagttcaattcccacatagattccatttctagctaagctaaaaagtacggcccctcataatctgcctaagcttccagcagggcatgtgcatttccttcaccaaaaaaccaaggcttattgcagaaaaataaaggcaagccttgttaattatgacctagagaatgtgaaattcctagtaagtcaacttcagctggcttgaaatttggaaatgaatttgctgagtaaattaacaatcaaacacaattggaggagagatgtttgaagacttaagggaacaaatgatttttcaagcacttgggaagcattatttacatacagctaattactatgtgaaaagagctgtggtacctggaaagag

SEQ ID NO: 399910 - DNA, 596 bp, Homo sapiens
agtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctaca

SEQ ID NO: 399911 - DNA, 532 bp, Homo sapiens
gtttcggatatttaccccctttcaggctttctctcctcaaggatgccagagggcgatctagtgtatgttaactatgcacgaactgaagacttctttaaattggaacgggacatgaaaatcaattgctctgggaaaattgtaattgccagatatgggaaagtttttcagaggaaataaggttaaaaatgcccagctggcaggggccaaaggattcattctctactccgaccctgctgactactttgctcctgggattgggctatcaattgatagcccaatcccaggagggttttttgcttcacccagaaaagaattcaagggtgagccaaatgtagaagaaaacagctttattgaagtgtcagtgttatagcttaggcagtggtacagctccatgactgcttctacggaatagggctgccccacaggcagtgtgctgagattagcagcttagggcagttctgcagtcagatttatacctacttttaattgcatgcatattaagaggcggtttatgaagacatgtctagggaaa

SEQ ID NO: 399912 - DNA, 451 bp, Homo sapiens
ctcaaaagccctgcaggtgaatttttacgtagaccaagacgctccatttccaccacaagctaccttgtaccttttgtatcctccacccctccctttcccctgactttccagccataagcttacgcagaaagaccccttctcccgatcatggggagtgtgcacaccagctgtgtgaaccccgtgacactctcaccgcccccaagtcagatgggagtcatttttctctggacctgaccagtactctgactttatctctttgaggccatctccccctgacccctgccatctggtgtttgctagtaatttgcattcggcccttaagttttgctcattaaacaccctccttggcagctctgtggctcccctgcaacttttacagcttggctttgggtacaggctgcttccaacagagcctgaaggtacaaaatctcagtgagatcagaatgttaaa
